United States Patent 6,812,339 (POLYMORPHISMS IN KNOWN GENES ASSOCIATED WITH HUMAN DISEASE, METHODS OF DETECTION AND USES THEREOF) - sequence listing, part 17

SEQ ID NO: 12378 - DNA, 119153 bp, Human
  misc_feature (1)...(119153): n = A,T,C or G
gagttgttttttaaggaaagtctacatggacaatcattttgctagttgagacagttttatttcttcctttccaatttgtatttcttttctttttcttgcttgttgcattggctgggacttccagtatagtgttagatagaagtagtaagagacatctttgccttgtttctcatatggtgagaacattcagtttctcaccattaattatgatgttggctgtaagttttttaaagatgccctttattaggttgaggaaattcacttcttagtttgctgagaatgaattattcttattgtgaattcataatcatgaatagatattgaaatgtgtcaaatgctttttctcaatctattgatattatgtggttttccttatttagtctgttaatatggtgaattatattgattttcatattttgaattagcattacatttcttgaaccccacttggttgtgatgtattatctttttatatattactggatttaattagctaatattttatggactatttgaatattttgttgactgtgaccatgaggaacattggtctttagttttcttgtaatatctttgtctgcttttagtattagggcaatgctggtctggtaaaataagttagaaggtgttccttccttttctatcttctggcatagattatataaaattggtattattccttaaatgtttcttgttacctactaatgaagccaccttgatctggagttttctttttttagaaggtttttaatgtatgaattcaatttcatatttatatgtgtgtatatatatgtgtgtgtgtgtctgtacacacacatgcacccacacatatctactcatttatattcaggttctctatttcttcttgagcttttggtagcttgaatctttcagtgaactgacccattttatctacatggatgaacttaaaagtatagggctatttgtagtgtttattatcttttaatgtatgttagatcattaatgatgtttcctctttcatttatgatgccagtaatttgtgtcttctctgtttttttcttggtcatcttgactagagttttatcaattttattgatcttttcagataatcaacttttggttttattgatattctctatttttctatttttattaatttctactctgatttttatttttatttttctgcttacactggctgtaatttgttcttctttttctaattttctatagaagaatcataggttactgatttctgtccttcctccttttctaatatatgcatttaatgctgtacattttgaacaaagtttatatttaaattttagcaaagccacatggtttatcaagaaagctttctgaaagaatggggttcatggggcacataaaaagaaaaatgttgcagtatcatggagtttatttgaacaagtgggagagaataacagtctgacagaggaagaaagaataagacattcatgtttgggcatgtgcctgtagtctcagctactcgaaaggctgaggtggcaggatcgcttgagcccagaaagcagaggttgcagtgggctgagattgcgtccctgtactccagcctgcgtgacagagcaagaccctgtctcaaaaaaaaaaaaagaaaaagaaaaaagaaattcatgtttgtaagtgaaactactatgaaagaagggcattaaagataaaaactacctttaaggtgtatttaacaattatagattggtatttaacattgtattaatgtttaacgattaggtacttacattttattttagaaatggtgttagtgatggtgataacctctgtacaattgccactgaaaagaacagcgtgtgactacactggaagtactcaaatgcctttttgaagacatcattgtgctgcagactgtgtctaatacaaatcacctgtacagtattcttttttcattcacggatgatatggttatcaatataggagaagcctatgttcattttgctgattcttaggttttttccccccttcttttcctacagaaatgctgagccgattatcaggattagcaaatgttgttttgcatgaattatcaggagatgatgacactgatcagaatatgagggctcccctagaccctgtgagtagttctgttctgatttaaactggtaagacatatgttctgtgttcttctaaggaaaataatttaagatagaagggtgtgcgaagcctccctggtactaggtgaagcgaggattaagaaaaatattgaaattttataagtgatccttctcttgtaagtttttagcttaaaagccacagtgatgggaaacaagtcctggatacaatttgaaagggctttctcatttgtctccctgggccttgtttggtgccagagtgttttaagtcctttgttctcatccttggctattccttttccacaggaaaggtctaagtgacaaatgaggaaactggaacaccttttgggtttcagaatatctgtttgctttgtaatttcatttaccacttctcctatagtttgtattgtattttcttttttttttaagatgatacaaattggcagtatgtattatattttctgaagtccacataaggaattaataaaacttcttagttttctgaaaagacaagaagtaatgcgtagtggttaagagagttttacttaactactcttaattttaacttttggccttttacccttactggtttatgatttttgctttcctttatttttctctttggtaaaattaggataataataccttaaatgggataatgtttgtaaaatgcttaacatttataaaatacttaatatattgtaatggctatgataatgattattattggatcagagttagattcttaagttaacaagaatatgaattgggcaaaacataaaaagttggaatgaagaaactcctgttgggaagctaataccttttcctggtgcactggcaacttttttcctaaatattaggaattacaccaagaatctgacatggaatttaataatactacacaagaagatgttcaggagcgcctggcttatgcagagcaattggtggtggagctaaaagatattattagacagaaggatgttcaactgcagcagaaagatgaagctctacaggtactattgtttttatcctttcttgtggagcatttgataaaggacagatgatacactactcactttaatttttgtctccacttagattattagggaatctgattatctccctagtactgtaaccttatgcctactgaaaataacttttgggtcggtgtggtagctcacacctgtaatcccagcattttgggaggctgagatgggaggatttcttgaggccaggagttcgagatcagcctgggcaacatagtgagaccctgtctccacaaaaaaaaatttaaaaaaaattagctgggcatggtattgggcacctgtagtcccagctactctggaggctgagataggatcgcttgagcctgggagttagaggctgcagtgagttgtgattgtgccactgcactccagccctggtaacagagagataccctgtctctgaaagtaataataataaaaataacttttagtatgtgctagataagaggggaataaacatttatgtatttaccatcattgtttttgggcaggaagagagaaaagctgctgataacaaaattaaaaaactaaaacttcatgcgaaggccaaattaacttctttgaataaatacatagaagaaatgaaagcacaaggagggactgttctgcctacagaacctcagtcagaggagcaactttccaaggtatggtgactgggtgtagtgtatatttcctaagttgaaaaaacctaccaatacagcagatcttcaccaatcacaaacatttaggatgctaaaatgatacagcactaaataatgttttgttttgttttttcttatagagcttgtagttcagctggactgtaggccacacacagggagaatgaaagatgtacagaaaacatggatatgaaatgccagttgtgacctggactttcagggattaaaaaaggcttacaggaagaaataagtactgaagtgaggcatttagagaggagggaaacataccttttggaggagtttcatcattgattagaagattaaactagattatctctaaggtttcttccagctctgaaactttttaattcaatgacttaacacagaatattctgtgtcctcatatatagtcacatagtggtggattaaagcttcatgcatgtgggctgaatcagctgaattacctgggactctctaaaagggaggctcactaggtttatgactgcagccaacaaagcagtttaaggttggagatacagaggaggaataaggaaagtactgccctgtgaggaatattgtcccagtactcaaattttcattatctttcctgtatggttaaactccacatattcacattcagtcagctatttagagaacaagaaacttcagttttgtggagagtttgatacagattatatggaggcaggcatatcacatgcatactgtagttatagagtgagcctagacttcaccgtgtgtaagaaatctttttatttttttagtttcattttgttttgctttgacctgctagtatccttagttcttgggaaatgagattttaatcagttttctaggcacaacctttgggatcgctagttagtgacccagttcctgcttagtctttcctctcagggcctaatgatcagagaacattactttccctgaattgataatcttatttaacttcttgaagcctattttaaaagcttttctcaatcttctcaaataatttcaccttgatccttcttttccttttggtttttcctctgtcagttctcttcccctcactgtggtagcaccaacctctctcctcatattgctttgttccctccagcttctcctcagctatgatgtcagatttttaaattatccattttatactctgctttttaatttcatttttagctctgagaccttaaagcagtaatgtcttagagttcattttctttctctgttaaagaaatgatttctaagtttcagcaatcagtcatagcaaccctttaactattatatactcaatacagagctaggtattctgtggaaagtatagttgaagaaatgacaacagtcctcaggtgcttgactgacttatgtgaaagtataaaagtattctttgtaattccagtaagcagaaatagctttgtttagggggttgggagggactaaatttacaaagaggcagaatctcagtctaagggagagcttttggaaaaaaaaatagattattgaaaaaattggatttcccctccctggctcttttttgaaggggtggttttcccttagcaacagctatagtttcctgagctctctccctgatttttcaaggcaacaaaacttcggggtttttaataaaggttagtcccgcatggccctgactggttttgccctcagaataaaaactgtcaaaatgggaaactcgggaccctttttttccaatatcccatcccccccaggattttcctgcctttgggtgctctcccgtattttcaaaaaactgttttttatattgtccccagttttggggtcccaagcttggtgtgaggggaaaaaaaaaaaaaaaaaaaaaaaatatatatatatatatatatatatatatgtgtgtgtgtgtatgtatttcacagtttatagctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactaatcagcactttgcaagcccagcttactcaggcacaggcagaacaacctgcacaggtaggggtggaagttacttcataatcattaggttaatgaatcactaaaaccaatggattattatgtgacaaatacatttttctagatgcacaatgggcatttatctatgtatatatcagtctccttcttttcttcatttcttcttgtctggtaattttattagaatatgcattggtgtttgtcatttttagttgttattcatagatacccagtatactctttcaatatatggtttcacatattttaagtttgtttttttgtttgttgttttatttcactttaggccttctattttttgtttgtttttgtgttttttctgtttttttatcttctatactgcaatgattttttcttttctattggatttttcatgagttcagtcacctcatttctgatttttctaaatctgatttatgtttttctctcatctctgtataatttttttttcttttcttttctttttttttttttttttttgagacagggtgtcactctgttggccaggctggagtggagcagtacagtctcagctctctgtaacctctgcttgccaggttcaagcaattctcctgcctcagcctcctgagtagctgggattacaggcatgcaccaccatgcctggctaattttttgtatttttagtagaaatggggtttcaccatgttagctaggctggtctggaactcctgacctcaagtgatccacctgcctgggcctcccaaagtgctggtattacaggtgtgagccaccatgcctggcctgtataattttcttaatttttaaaaactttttgaaatagattgcaattttgatttttttttttttagtgtggctctggtatgcttttatcacctataatcatatcattctgctccttagttttgtttttaatttataataacagaaatttaatttaatttaaataaatttatttcttacatttatggaggctgagaagtctaaagttgagggactgcatctggtgagggtcttcttgctgatagggctctcagtggtgtcgcaaggcagcgcaagtcatcacatagtgagggggctgagtgtgctaatttgccagctcaggtctctcttcttcttataaagctaccagttccccttctatgacaacccattaatccattaatctgtgaatgtgttaatccattgctgagttcagagacctcctgaaccagtcctttcttaaaggcctcttgtcacactggggattcagtttcaacgtgagttttggaggggacattcacatcatagccttccacccttggctctccaaaactcatattcttctcacatacaaatacattaattgcatccccacagccccaaagtcttagctcattcctgcaccaatttctgtgagcctgtgaaataaaaacacattatcttcctccaagatacaatggtaggacaagcatagggttcacattctcattctaaaagggagaactaggcaagaagaaagagagtaacagaccccaagcaagtttgaaaaccaagagagtagacattgggccttaaaattccagaataatcttcttttactccattttcagcatcctctgccggtacaggggttgggtccccaagacctcaggcagttctgtccctatggctttgctgggcttagtccagccagcattcccaggctgactttgcattgcacactggtagctctatagttctggtatggcagtggtagtcccacaccgtgattccactaggcattactctagtggggactctgcagggcaattccaacccctcatttccccttggcattgctctagtggggctctctgtggtggttctgcctcaagacaagcctctgcctgagccccctggctattgatgacatccttcgacatgtaagtggagactaccaagcctccacagctcttgctttctgtgagcctgcagaattagcaccatgtggatgttaccaagttttacaactcgtaccttttgagctgtgacatgagccatacctggggctgctttgcactaaccagaacagctgggctgcaaggagcagtatcctgaagtggcacagagcagtggtatctcagggcctattcacagaaaccattctgtcctcttagggctttgggcctgtgatgggggctgttggggcagccttaaagatttctaaaatgcattctgaaatgcctttagggctttttcccattgtcttaactgttagaaactggctcccttttagccgtgttaatttctttagcaagtggtggctgtgccttcttggattcccatcctgaaatcttctccattctttaccacatggccaggttgcaaattttccaattttttttttttttgctctgttttctttttctctgttcactgtaagcagatagaagtaaccacatagcagctcaagcagtttgctgcttaaaattttctcctgccatataccctagttcatcactctcaagctcagccttctacaaagttcttggccatacaaaaactggacaagttcagccaagttcattgctaatttatagcaaggctgggctttactctagtttctgatactttgttcctcatttctgtctgaagcctcaccagaatgggctttactatttatgtttctatcagcattgtggtcacaaccgcttaaccaatctccaaggagtgctaagctttctgtagttgtcttatcttctaagccctcatcagaatctaggcattttttttttgagctagttcctcagaatttttccagcctctgcccattacccagttccaaaactgcttccacattttcaaataatcattatcaacgatgaccccacttgtcaataccaattttcctttttagtccgttttctcttgcgtgtaacagaatacctgaaactgggtaatttataagaagttatggaggctgagaagaccaagggtgagaggctgcatctggtgagggtcctcttgctagtgggggctactctgtttttttaatagtaacttaaatgggatatgaccttcatccttttctgttccttatttttgtgtcaaatttattctcctaaacctctatttggaaggaggcttgattcaggaaagcttttcttaacagacttcctttttctattgtttttgtgttgtgttcaaagatatgggagccggatttctgagatttcctggctttcttccttctgcccttcacttggtttatgccagcactgtccaatagtaataggtttatttgtaataattaaagactggaaacaactcacatgcccatcaatagggaaatatttaaactgtggtatatccacacactggaatactacttagaagtgaaaaggaaccaactatacaacaatagaaggccttcattttaaattttgaaatgtgtctatatttatttttgaacttggaaaataattcaattataataaatgtttatattgcaatttaattattagttatgattaaattggtatcaactgttactaatgctgtctgcattaagtatacaaataaacatattacagtgttatataggggtctagaaaaatgttaaactgaatcaacccattgataccaactgcatatacacttgttgcttgtgcagcacctcaacagtaacttacatgatgcaacagataagatgaaatatagtcatgccaaaacaaagttgtacttaatggaaaaataatctatatttcagttttcaaattaaaattaaataatgttaaaaattaaaaatatttcttttctatcagacccattttaagccctctatatccacatgtggctagttgatactgaattatacaatacgtttgtagacctctttcttctgtctctttaattccttttctgcataatttttatttcactcctcgcagtttcttcttagtacaggttcatgtctcagaagggagccatgatgagtcagttgtgagagttcagggggcctagattgctctagcccttttagtccttcttaccttactgtgcaccccttgcatttacctagtattaaagaatggcaaagccctgccactattctaaaattggccagctgttcattccagcaaataaatacattggctgtttagggctgtccctttctcagacccatcagatttcactcttttgctgccttctttttcttacacaatgtaagactctaatacaatgtagttcttgtgggttttggtggtttgtccttattagcttatattttagggtttttaggacggtctgcctaatttaactgtaaatgttatctgtggtttttttggttttactatcttgtgctgtctctatgtgaggagtcagagaaattgaaaaattgccactactgcttctgtcttcttctgacaaataaaattttgataatgcatgcaatttccttttgggttcaatggaaactagaaggaaatatggtaggcatttaggttaagcaagaaagggaggtcaaagaattaataatgctcattcttttgcttaaataattttttttccttctatgtcttcggtttgataagagttctacagagatggaagaatttgtaatgatgaagcaacagctccaggagaaggaagaattcattagcactttacaagcccagctcagccagacacaggcagagcaagctgcacaggtagggacctcacaaaattaggataaagagctatgaagtccagtgggttattacgcacaagtcaattcagtgagtcactttaaaaaatcctagtagataaaagtatagtagcatgggtgttgcactagaaattagaaggatatgtagtagaagagattaggagatgtgtggtaggtaagtgtgtcattagggaacaccagaaaacctcacaatgtgttatttaccttgatgaattttctatagcctaattgatgactgtttcttagttctgcatgtccagaaacttaattttaatagcagacagagattcagtcttttgggaatggactcatgctgagttcaaaagagaccaataagtaaaccaaaagaaataaaaataattaggttcattctttcccaaaataatatctatcttaataggaaataaattatagttagattacttagtgagcctgtaatgagaaagtggtgtaggtcatgtgattttatgttaaatggcaccagtatgtgacattcttcttcccatttttttcatctgtcaagaccagaccatttggattggcatcctcaactttttctatttttctaggtttcttggttggccacgcactcccacatatttatttttgaaattgggtctcactctgttgcccaagctggagtacaagtggtacaatcatagctcactgcagcctcagtctcctgggctcaagccatcctctcactcacctcagcttcccaagtagctgggactacaggcatgtgccactgcatctggctaaattttttacattttttgaagagacaggttctcaatatgttgcccaggcaggccttgcactcctgagttcaagtgatcctcacacctcggcctcccaaagtgctgggattacaggcactgtaattttttttggggggtgggggcagcggtgggggaatgcttatgaatcatgaaagatttttttccctgaagtacctttgtacatagctaattatccattaggtgtttactttattaataatttgtagtattagtagtgccttctctctgtggttggcctactgctatgtatacagttaaaattgtatatcctgaaattcttggttttacctattagcttttattgtgtcctttttaaattttttatttattttttattgtgtcctttttatgtataagcactatatacagtgcaggatgaagaaatacaaaatatggtttttaacctatgtgttgctaaaatatggaaagccaagatacatacatgtgttaagagattcatcgtaatttaaggctttccgaataagtgccaaagcaagcagcaatacaaacaaaatattttggaaggcgaaagaggttactgtgagtttgacagttaaggaaaattacacggaaaagttgggatttaggcaaaaccatgatatatagataatattccagacaagctgggggagatatttcagtgatggggaacggtgtgagcaaaactgcagagaaggaaaagaatatggaacagttatgggaaaggagttagagatgtttggctaatgaaagactccagtgcctacacacttgaaacacaagagtccaaattcctagtgaggtcacaattcagataataaaaacattctgaggatttgtttttctcctaccaaaaaagaaagccaaagtttgattcaaggtgtcacaaactgagatatcagcagtaaaggaccaatgcaaaataggcaagctaacagctaagcagcatgctccaccatagatcttaaggagatgaataagcagatgcacacactcacaacctaaaaacaagacagaagcactgatactgagcagctcaccatcagtccatttatttccatttcattctgttcagagccagttaaaaatgagcatgatctagaaggctgcaagtaatgacagctgaaaacagctgtctggggaggtggtgtggatttagaagcacatgaggttctttggtagaagcaattctttgaaaataagactagaaagatagattggtatttccagttgtagagaatcttgaataaatgatatgttagtttgaattttcatttatagggcatgagaattttactgaaagcttttcagccatgagcaagaagtgtccagggtttaatagaaatctaacttaacttcaccttatgtgtttaatatcttaatctttttagaactttaaaaaatacacttcttgtatatttaaaacatttctagtaaccatgaacatataatttttgatcaaaatttatgtttaggctaacttctgaatttgaaaataggctttctctcgcatttcatagttactgtccagcctatctctcttccaacatcctcatccttgacaatcaaaatttcactttaaaaagctactatcaagtctcagtgtctgtcttggaaagtagtctgtgagttttatttgtgcaatattcggggagtgtaacttgcatagtttctctggtatgtgtcttcagttgagttccatgcagcaggtggtccgagagaaagatgcccgctttgaaacacaagttcgtcttcatgaagatgagcttcttcagttagtaacccaggcagatgtggaaacagagatgcaacaggtgtgttgctaaaactcggtagaatgactgtcattttggttaatatttaatccatcacagccaatttcctacccttacccactgctcttcacttggtgttagtgttttccttattggcctcttttgtgtccttgtcttctgttgcataaaaattatttattttttcttatccttttcttgccttttacccctctaatcaggttgttggtgctcaaaagctgagtttagttggtgaatttatgtggtagtcaaaaattggtttctcttcagttttctgattatagctacctttgtgcattacacacctaacccaaagcttcaaatcaatgaagtcagttttaaatatttaaaaaattagagaagacaaagaatgattttgaagacatgaagtcttttattagatcagtaattcttttttaaaaaaatttgagtagattttgaaaattggcttcattgtatttgagttcaccatctactaactcaaagtattttatttcacttagtgtgtagtgcattgtggtactgaaaggcacttcagtgatactttatgtttgatctgtttaattagattgaaaattaattagaattaattagaacggaaacttttaagttctaagcaatctttcagaatgcaccactaaataaagttttagaatacaacatattattaagtagaatactaattgtatatgtgtatcattgctttatttattcaacaattttttttcaagtgcctgcccagtgcatgaaactaggagaagagaaatgattcttgcctgcagagaatgttctcttgggtgggtaagatgtacatgtacctatgctatctaggtacaggttattaactgtatgattttgaaggcagatatgtgttattgttttttctaatttttaaagagactccctaattcagggacttgcttgtgtctgggtctggttgttgttggtgctctggagaagacattttggagactcttcgttgctgctggatggggggagcatggcatgctggtctcccactctttaaactgtcattttcaacaccccaaaatttaagtatacaaatctacatgacattttgaaagataagcaaatacaagcactcatttgttagcatattatgtctaaaatgttttcttctcagaaattgagggtgctgcaaaggaagcttgaggaacacgaagaatccttggtgggccgtgctcaggtcgttgacttgctgcaacaggagctgactgctgctgagcagagaaaccaggtactgccttttaatctttacttcctgccttggagggtattcatttccactttcgtttgccaggcagtagatataaaagcctatttaaagtcttcagagaattgatgccatttattcattctttcaacaaatacctcgtacttaagtggtggggatgcagtacaattatgagcaaaactaaatacagttctttccctcatggagcatacattgcacttctttattgttgctctttccctttgccattttagatctagggtcctagtttatctagaatgtcatacagattgagtatgcctaatctgaaaatccaaaatgctgcaaaatctgaaattttctgagcaccaacatgacaccacaagtggaaaatgccacaactgaccttgtggaacagggtaacagatcaaaggcaaatatgcacaaaatcatttaaaatactgtataaaattatctttaggctatgtgtatacgatgtatatgaaacaaatgaatttcatgtttagacttgcgtcctatcccaagatatccaagatattccaccatctgaaaaaaatggaaaactaaaatacttctggtcccaagcatttagaataagggatacttgacctgtattatcctttagtgagtttctttttcatcagttactcttctctgtcttgaatggtttttgtgctttatgtacagcccatcttttcttgtttttgtaaattgaccttctgttagattgaaatgatctcgttctgcaatattctcttgagtatgaaggtaatcagtaatgctgatctgactataatccatcctgccattttctttctcatattgtcctgatcttcattctcattgaattccattgaattccactttgcttctctagtatgttaattcttccttacccttgctcctttctgtgtcctatatggacccatgcttgacagtttgaactaccttttttctaccccttggattccttgtgttcctatcctgtcacatccaagtagtctcatcataatgcagaattggtgctatagtccacattctctgtttgtttttctgggtgcctgtgtgctgctggggagtcagccatctcctctcttcttaattttcaactctccttcttgagaagggctttctctctagcatagaaacatgttcccatttttttccatcctataagaaaaagcactttacaatgcttgttgaaatgaaataatgtatttatggctcatgagactttgtcttttttcttagattctctctcagcagttacagcagatggaagctgagcataatactttgaggaacactgtggaaacagaaagagaggagtccaagattctactggaaaagatggaacttgaagtggcagagagaaaattatccttccataatctgcaggaagaaatgcatcatcttttagaacagtttgagcaagcaggccaagcccaggctgaactagagtctcggtatagtgctttggagcagaagcacaaagcagaaatggaagagaagacctctcatattttgagtcttcaaaagactggacaagagctgcagtctgcctgtgatgctctaaaggatcaaaattcaaagcttctccaagataagaatgaacaggcagttcagtcagcccagaccattcagcaactggaaggtcagtagctgattgcttttgaagtccacatctctaccatctgagtggcttgtatttcatattttcagggatctgttaatgaaatctgtactcaaaccaattgaaccaatagaaggactgagaaaaacagctcttctgaacttcttgatgcatttttcttgcctctgactggctataatctttcttaatattataattatcattacaatactaaaaatgtgatagtgatgttccagatattaaatagaatgctatgttaaatatgactgatctgaaggattcaatgactgaaacgagaaggatttgaattagtttttggaaaactcaggccagatctaggtgcataggttaggagactaaattgcatggagttatccataaatctgaagaaggatggatctcagtgcttttcttataggtgaaaatctcttttcacctgatttcttgtcttacaggtgaaaatttatcctttatgaaggtataaaggaaacttttaaaaaatgtgttattataaaagtaatatgtgcctataaaaaattgaacattttagaactttataaattaaaaagtgaaacttcctcaacaccaatactccatctcaccaatactcttccccaaattataacctttactaatatattgacatagacataaaggaaagattttagaaacaattaagttgaaaatttgtattgaataactgaatgttagccagacagttttgttttttgttttttttttttgtgacagagtttcactcttgttgcccaggatggagtgcaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcaagctgttctcttaagcatgctgatgtttaaaaccatgtggtggaatcttggtgggatccataatacctaagtcgagagtgaagaaaacaaaaaccctaaagccattttcaagggggaaagggaaaatgaacttgtaaaaaatgcctagggctaggcctccccacgcctgctattccagcactttggggaggtcaaggtgggggggattacctgaggtcaggagttcgagaccagcctggccaacatggtgaaactccatctctactaaagatacaaaaaaaaaaaaaaaaaaaaattagccaggcatggtgacgcatgcctgtaatcctggctacttggaaggctgaggcaagagaatccttgaacccatgagtcagaggttacagggagccgagatcgcaccactgcactccagcttaggcaacagagggagactccgtatcaaaaaaaaaaaaaaaaagtgcctaggcctattttattttacttttgaaggaagtgatttactgaggtgtcctttggttcttgagaacatttaacatttagctaataataatgttgtcattggcatcataattttaactaaggaaactaaactagtaaacagcatacagtgtatctttagaagataataataactacatttcagacttgaagcaaatattacatttattttttttcttttccttagatcagctccagcaaaaatccaaagaaattagccaatttctaaatagactgcccttgcaacaacatgaaacagcatctcagacttctttcccagatgtttataatgagggcacacaggtaattaaatgtgaacttcttatgaatattaactgtttgtctttgctgtatctgtacttcggtgctctaatgaggatttattccagagagctatataaaccttctgttttttctgcctgaaaaaatacttttttgaggacaattctatttgaaaggaatcatgaaaggcattaatgcagtgtttcaacaataaagaatgagaaaataatagataacaaataccatggtctcagaagcctttctgattctaaggtcttaacaatttgtatcggagatgaatcattacttttgcttctgtagttaattttcccagttcggaagtcttttttttttttggtaaactaagatttgatcaggtttagtgaacacgagtcagtctaatcaaacttaaaagtctactatggaaatcatattgttcccattaattaattaacagtaaaaaagtatataatggccaagtagcttcttattggccagtatattctttctttcatctacaaaaatctctgtagagagctagattataatcatcgaaggctgattcaggctgattgagcctgaatatcagaatgaaggcagttagtttgatgttcttaattgactaatgtcaagttgagataactagattcagtcatctccattgtaagattatacccttccaaactcacaaacatattggtcagcagagtcctgtcattcctgggctatgctgtccactgataaaaatttttgcctcttggtttctagcatctaggctttccagtctcttctgttctcccattctcgactttttcctccaatgttttgttaagacgttttccaaccattcgaataagttgcaagagttttgtagcgaacatctgtatacccaccatctgaattctatcattaacattttagcacgtttgctttatcaaatgtctatctatttattcatccctctgcccatccatcagttcatcttaaatttataatacatttcactgtaagttgtggacatcagtacatttctctctaaatttgtcagcattcatatcattgactatattttaatatttatttataattgttctttttcttttgaggtaagatttacaaacctttaaatgcacagatctgaagtataccattccttgagttttgtcaaatgcatacacctgtgttacccaaacccctattcaagatatatcacattaccatcacctcacaaagtatccctatacccctttacagtcatcctcacccttcccctccaaagacaactactgatttttcaccatagattaattttgcctgtttcacagcatcatatacatttaaccatacaataggtcctcttatgtgtaaagcttttactcagcatatttggagattcatccatattgtgcatgtattataatttaatctttaatattgctgagaagtattttattttatgaacatgctgaattttccttttgcatgattgtactgcattttcctattgatggacacctggactttttcatgctttggctattatgaatcaaactgctgtgaacattctcatacaaatagttatgtggacatatgttttcatttatcttcagtaaatactagttgaggaattgctttgctgggtcatagagtacctatgtatttagctttataaggaactgccaggtcttttcccaaagtggttgtactattttttttttccaagacggagtcttggtctgtcgcccatgctggagaacagtggtgcgatctcggctcactgcaacctcgacctcccgggttcaggcaattctcctgcctcagcctcccaagtagctgggattacaggtacccgccaccacacccggctaatttttgtatttttagtagagacagggtttcaccatgttggccaggctggtctcaaactcctgacctcgtgatccgcccacctcggcctcccaaagtgctgggattacaggcatgagccaccgcacctggctgtggttgtactattttatactcccacctaaaatatatgagagttccatttgttccacatcttctccaagatttggtggtgtcagttttaaaacattttagccattctaatgggtatgtagtggtatttcattgtggtttaaatttgcatttccctgatgacaaattatgttgaactttttttcttgagattcttagccatatgtacaccttctgttggtgaagtgtctgttcacatcatttccccattcttaaatttgagttgtctttttattatcaagtaggaattctttatatattctgaatgccaatctattatcatatatgtttggtgaatattttctcccatgctgtggctttgtggcttgcctattcattttcattatgatatcttttcattagcacacacttttaaattttgatgagcttaattatttatcattttttattgttttttttttctgtgtcctgtctgtgaaacctttgcttagccccagtttatgaagatattctcttatgctttcttccacaagctttatggttttagttttcatttgaagtctctgaatctcaaatgaatttttgtgtgtgttgtaaggtgaaggtcaagttgttttgttttttcctgtacggatatttcgttgtttcagcaccatttcgtaaggagactttactttcctcattggattcttttggtacctttgttgcaaatcaaagactaatacatctatttctgaattttctgttctgttatattgatctatctgtcagtccctatgccagtatcacggtcttcattattgtagtttgttgttagtcttgaagtcaagtattaatagtataagtcctccaactttgttcttcttttcaagattgctttgactattccaggtcctttccacataaattatacaatcagcttctcaaattctactttttaaaaaaagacagatgagattttgaattggtattgtgtggagtctattgatcagtttaagaattgacaacactactgtacttttaaatctacgaatatagtatatctctccatttatttagatctttaatttctttcagcagtgttttgtagttttcattggagaaattatgcacattataacatttattctgaagtagttaatatttttgatactattatagatggaattatttttatttcattttccaatgtatgctaatatgtaagtatacaactgaattttattaagcttatattctgtgaccttgataaacaaattaattttattggttttagtctctttttgtagattctctaggattttctatgtaagcaatcatgtcatctgaaaataaagacaaattttacttctttctaatttttatgcctccagtacactgtttaatagaagtggtgagactggactttcttgcattgtttctaatctaagaggaaagtgttccataatttaccattggctgtgatactagttttaggtttttaaggaatttcctctatcagatcatcctcaatcttgtagaggaatttttctcttagtttttttgatatttcttaattttttcttaatttttaaaataaactttctcttaattttttttttatatttctaggctatgtgattcttctatgagtaataacaaatgtctagttgtagcaatcctcctaaaaatttttctatttatttattttttgagatggagtttcactgttgcccatgctggagtgcagtggtgtgatctcagctcactgcagcctccatttcccaggttcaagtgattctcctgcctcagcctnnnnnnnnnnnnnnnnnnnncaagaaaaaaaagtctatacatgctgttcagtacagatacaaatttttttccccaattttttcaatctgcggttggttgaatctacggatgtgaaacctacagatacagaggtctgactgtacttattcattctacaacatgaatgaagaaaacattatgctcaatgaaagagtcagtcacaaaggactgcatatgattccactcacaggcatccctccttttactgtgcttggctttattgtgcctcacagatattgtgaattttacaaattgaacgtttgtggtacccctgtgtcgggctagtctattggtgccatttttttttcaaacagagtgtgcttacttcgtgtttctgtgtcacattttggtaatcctcacagtatttaaatttttttcattaatattaaaagtaatggccaaaacaacaattacttttgcaccaacctaatatgattatctgttctggtgatctgtgatcatagatctttgatgtttctattgtaattgttttggagcacccatgaaagatggtgaacttaatggataaatgtgtgtgttcttttccttttcttttttttttttgagacagaatctctctccgtagcgaagtgcagtggtgtgatctcagctcactgcagcctccacctcccaagttcaagcaattctcctgcctcagcctcccaaatagctgggattacaggtgtccaccaacaccccccggctaatttttgttacttttagtagagacagggttttgccatgttggccaggctggtctgaaactcctaaccatacctcctaaccattggtgatctacccgtcttggcctcccaaagtgctgacattacaggcgtgagccactgcgcctggcctttttttttctttttttaaaattttacttatttttttgttttgagacagagtcactccatcacccaggctggggtgtagtggtgtgatgacagctcactgcagcctcaacctcctgggcttaagtgatcctcccgcctcagcctcctaagtagttgggactacaggcacatgccaccatgcccggctatttttatgtgtttgtttgtttgtttatttattggtggaaatggaatttcatcatgttgcccaggctggtatagaacttctggactcaagcaatccccctcccttggcctcccaaaatgctggaattataggcatgagccaccacacccaaccccaatacatttgttgaaaaaaatgtgcatatataagtgaactcatgtagttcaaacccatattcaagagttaactgtattatcctttttctatagtactgaatttgatttgctaatattttgtgaaggatttttgtgttcttatttatgaaggatattagtctacagttttcttgttttatgatatctttatcaggttttggtattaagggtatggcagcctcataatatgttcccttttctattttctgggagtgtttcctttctttctattttatgagagtttgtatgtgattggtattatttcggtttttgaaaataattttttaaatacttttttttaaaagaattcaccaatgaaaccatctgagtctggagttttaggaaggttttgataatgaattgaatttcctttacagatataaggctaataataagatttttttttttttttccacccggtgccagttttggtttgtttgggctttttttttttttcctggggttttgtctatttcattgaagatgttctaatgttctatttttgtcataatgttggttacaatgtttactttttatccttttaatgcctgtaagcgctgatccctgctgttgttaatttgtgcttcattttcttcatcagtctatctagaatttattcagcttttttcccccatcttttcaaagaaccacttttggtcttgttaattttctctgttgctgattattttcattttcattgatttctactctttagtatttctttctgcttacttggatttactttgctcttctttttatagcttcttaaggtgaaactttgtatcaaagatttcaagtcttcttttctcatatgaacatttaaagttaacacagttccctctaagcatagcttgttatgttgtggttttttaatcatttcagtttttgaacatttttctaagtttctctgtgattttttcattgaccatggattgtttagaagtgtgttctaaataaacacgttgttgtagaatatccagatacttggttttatttctagatatcttattgatttctaatataatttcattatgatcagagaatatgttttatgtgacttcaatcctttgaaatttattgagacctattttatgacacagcatatggtgtcttggtgaacataccttgtacacttgtaaatagtgtgtattctgtagttattggatgtaatgttctacaaatagcacttagatcatagtattgttcacgttatctttgtctttgacttttgtctggttattgaaacatttgctaagagggggttgaaatctccaactatgactgtggaattgtctgtttctccttttaatgtagtcattttttgcttcttggtaattggaatctctgttattagtacatacacatttatttttcagataaagtgttccttttttcacttacaaaatgttactctatctgtagtaatacttctttatttacatttctctgtatctggcattaataaaataattctgtcttatgtttattgcttgaatggtatattcttttctatccttttacttttaacttgtttttctttaaagtaaatgtcttgaaggcaacatatagttgggttatacttttttatttcttctcttctttgtgattggagtgcctagtccttttaatgtaattattgatgtgattggatttaggtctaccattttgctttctgttttttcccctctgttttcccttcttcttttttcctgccttctattcgataattagaagtttcttgaatttaattttcatttattgacaactttttcttttaaacagctctattaagtataaaaaggtatacttgacatacagtaatgtgtacacatttaaagtatacagtttaaagagggttttgtgtgtttgttcatttgttttttgaaacagggtcttgttctctcacccaggctggagtgcagtcacatgatcacagctcactatagccttaacttcctgggctcaagcaatcctctcacctcagcctcctgaatagctgggaccacaggcatgtgccaccatgcctggcaaatttttttttttgtagagacaaggtctcactatgttgcccaggctggcctcaaactaactcctgggctcaagtgatcctcctgcctttgtctcccgaagtgctgggattacaggtataagccatagcacccagaacaatttgatgacatataaaaccatcactactatcaagaaaatgaacatattcatcatctctagaagttttttcatgtcctcttttaatcttttccctcacatctttccctacctagacaaccactgatctgctttctgtcattatagatttttaaaaagtttatataagttgtatatgcacttttgttggcttattttactcagcatacttatttgagattcatcctaatgtttgtttagtaataattcattccattgtattgttgagtatgttgtaaacagcacaatttgtgtaaccattgactcattgatggataatttgggttgtggacagtttttggctaatacatataaagcatttatgtttatgttttaaggagattaaaataagaaaataaatcttaactaccattgcagttaccatttctggtacttttcattcttcgtttgtagatcagagattgccaatccttttatgtatagtaaatattttaggctttgtgggtcatacagtctttgttgcaggtactcaactctgccactgtaaagtgagaacagacatagagccaaggtaaacaaatggttgtggttatgttccaataaaactttatttatgcaggcctccaaagtttgccaaaccctggcttcatatttccatctggtatcatttttcttctatctgaaggactttttttttttcttttttttttttagtaagagacaggttctcattttgtcacccaggctacagtgcagtggcatgatcatggctcactgcagcctcatcctcctgggctcaagcgattcttccatatttgcctccagagtagctgtgactacaggcatgcaccatgctacccagctaattttttttttttttgcttttagtagagatgaggtcttgctaagttacctaggctggctggttttaacctcctgagctcaaatgatcctcctgccttggcctcccagagtgctgggattacaggtgtgagctactgcacctggctctgaaggacttcttttaatttttgtgtctgtgtgtacatggatgtgtgtgcaagtctgctggtcatgggtttttttgtttgtttgtttttatttttgttttttttttttttttgagatggagtctcactttgtcaccaggctggagggcagtggtgcaatcttgactcactgcaatctccgcctcccgggttcaagtgattctcctgcctcagcctcccgagtagctgggactacaggcacccaccaccacacctggctatttttttgtttgttttgtttttgtatttttggtagagacggggtttcaccgtgttggccaggatgatctcaatctcttgacctcatgatccacccgcctcggcctcccaaagtgctgggattgcaggtgtgagtcaccgtgcctggccagtcatgggttctaataacactttttgtctgaagacatctttatctcaccattgttgttgaaagattattttttgctgactagaattctacattgaaagtttttttttctttcatttctctaagtgtattactctactgtcttctttcttgcattttgttttctttggtggttttttttttttttttttttttttttttttttttgagacagagtctcagtgtgtcatccaggctggagtgcagtggcgcaatctcaactcactgtaacctccacttcccggattcaagtgattgtcctgcctcagcctcccatgtagcttggattacaggcaaccgccaccacgcctggctaattttatatttttagtagagatggggttttgccatgttggccaggctagtctcgaactcttgtctcaagcaatccaccccctcagtctcccaaagtgctgggattacaggcatgagccactgcacccggcccttgcattttgtttttaataagaaatctgctgtcatgcttctctcttttttcctgcttgcttttaggattttaccactgtttttgagcacttgaattataatgtaccttgacatagcatgtttcttgtgattggggttcattgagctttttcaatctctgtgtttatagttttggaagattttctgccgtgaattagtcaaatatatatatttttctgactccctactcttctttgggaattccaattacatttatattagattacttgaagttgttccaaaactcattaatgggcttttaatttttttttttttttgaaatggagtcttgctctgttgcccaggcaggagtgcattgatgcagtctcagctcactgcaacctctgcctccggggttcaagtgattctcctttgtttctatatttgttttgttaacatattttggagctttttttatgcgactcagttaaattctttgaaaaaaacttggtcctttcagatcctgctgctttgatttgttaggagggttcgaatcagtgctcagtcattcgatactcctgaggcaagaccttgctgagtattctactcaatgccctgagaagtgttttttcacatttggctatataactgacacttccgggttttgtgtgagcaccaagtgctattctttaatctcttcagataggtaggggtagttcagatagccttggatgctttcctcacattcatgtcctgccctgtacttcactgaacacttgttcagtccctttgcagatctgcagggttttctctttacgtgactttttcccatctggtattctattctgcgaactgcagccatcttgctctttcttgactgtcagctctgtctcatgaacttagggagtctaccaggctcagcctatgttcccccttcttggaccacagcctgaaaactctcttaaggcatgaagcttggtcagttttagggatcactttgttttctgcctctctcagagataattatcctttgttgcttgatatccagtattctgaaaatgattatttattattttgtctggttttggttgttattgtttcaggtaggaggttaaatctgttccatgttactcagtctttagcagaagcaaaagtcatctattgggtattgagctgtatctttttacaaaaattttttaagtggttattctaggaagtataacatatatccataatttttcagtcttcttgagttaatactgtactacttcacttaaaaggtagaatcttcataatcatataccctcaccctattcctgatgccacagttgttgtatgtattatattaacaaaagtaataagcctcagcacacaattttaatatttgtgcttaaaatggttatatatatttgaaagacattaagaggaaaatattgaccttaacatttatccacatatttaccatttgtaatgccctttcctctctgatgatcagatatctatttgatactgttttcttcagcctctacaacaacctataatattatagtataggtctgtctgtgaaaaaattttcttagtttttttcttatctaaaaatgtctttattttacttttattcttgaatgatatttgctactggatattataattctcgattgacaatttttctttcagaacttttttttttttttttttttgagatggagtttcactcttgtcacccaggctggagtgcaatagcacagtcttggctcaccgcaacctgtgcctcctgggttcaagcaattctcctgcctcagcctcctgagtagctgggattacaggcatgagtcaccacgcctggctaattttgtattttagtagagacggagtttctccatgttggtcaagctggtcttgaactcccaacctcagatgatccacctgcctcgccctcccaaactgctgggattataggcgtgagccactgtgtccagcctttctttcagtactttaaagaaggtgtttccctcttctggcctatattttttccctaacaattggtcagtagtcattcgaattattgtttctctgtatgtaaagtatcatttttccatggaaattttaagactttccttttatccttgtctatgaagtacttagttatagttttctttgtcattttcttgcttgcttttgttgagtttcttacgtatataacgttatgtttgagaaatttttggccatttcttaaaatattttttcttcccattctgtccctcgtctcttctggtactccaattacacgtatattgaaccttttaatattgtcccacatgtccctgaggttgtattcattttttttttcaattttttttattcttctgtcttcagattggataatttcagttgatttatcatcctcaattcaccaagactttcttctgtcgtctatattctactgtcaagcctatcacattgaaattttcatttcagatattatgtttattagttctggaatttcaaactggttcattatttttttttgtttgttttactaagatttcctttcttctcattcattatgagcatattcatttatgtcctaagcatagatataatagcttctttattaaaattcttgtttgctacttacaaaatctgcatcattttatggctagaatctgttgattatattttttttccttgagaatgggtcactctttcctatttctttatgtgtgaatggttttgttttgaattctggatgtcgtgttttgttctcaagattttattttgttatttctaaaatttcaattactttttatcagacagtaagttggactcaaaccccaaactctggcctatgatagagaggcatcaaaactcagttcagttatttttgccttagctgggctgctttaagtcagtccaacaaatacattgtgccattgttcagtcagaaatttcagctaagtttatacacagaattcagggctcctccttcctaactctttttcttctctctgatctccctcctcacatcctggcagctatgtttgtcccaaactcttctcattcttcaagccagaaatatctgtggctattctattggaattttacttgccctgcatactgcaaactgggaacttccctcaagataaaagccataaaaaccctaaattcatcccatgctatttattttaaacattgaatgaagatttcggggtcaaatatgctgtaaagaccctcatggcttaaaaattctacaattgtatgaaaattttatagaataatatccatggagaataaaaaatatatacaaagacataaaactaaagatgtgacataattagatatatgcctatccttaggaaaaccaaaaattctggatgtataaattaagccaagggaatttttattatacttggaaaacaaaaaacaattttataaatcttcttcctttcttaagaggtacatattcctttgcctctattcctctttgtggaacctctcttcatgttcattctccttcaggagagagaccatgttacttggtgacattaatctaatcttgtaatactatttgtttgtgaacctgaaaatgttctttcttatgctatagacttgggatttctatctttgtaatccaggcttcaatcttaaatttaaaagccaatgaacttgatatttgtgtgaaatattttatttctttttctaaatctttagataaaacacttttcttcaaagattacctaggcagataagtagatgttatttttaaagtattttcatggctggagaacttctagaagacaaaaatgctggaggctatctgggcgttagtgtgagaattttctgctggagaatcattaatttgttgtctttctacaatttaggcagtcactgaggagaatattgcttctttgcagaagagagtggtagaactagagaatgaaaagggagccttgctccttagttctatagagctggaggagctgaaagctgagaatggtatgtataaaagaaaaccataattctctgtcttcttatcccacaagtgcctctacttttatcactaattatgtataacatgtagaattctctgattccgtgataataaagatttagataatagagctggtaactatcaaagataatacacattaaacaattagagcatagtatcagtgtttacataagtataacattttgcaatatggactatacatgctgcaggatttctttataactcataatcattttggaatggtcatcgtatcctataggaagtatggcttgaacaggaccttaataagatgatttttaaaataggtaaaatgaagaaagaaaggacattctggtaataaatttgtgggatgaggtaacagagatcagtataaaggtttaaaggtagaaactatgttgtgagtgagtggtttatgctcgtgctgtaccctgcttagaatcctgctcctttcctttagtctggatgattgttactcatctttcaggcctcgactagcatattatctttttcaggaatttggtattggtccccaaaagttgggttaaatgatttttttgtgcttccataacatccttgtatacttttaacattgtattaaaatgatctgtttatatgtttgtcttttttactatattataagctcttcaaagtttaaatataagctcttcaagggcaggggccatttttttttccatctttgctttacccaaaactagtataccacctggcaaataatggctactgaataaagttttgttggattgaactgaacttagcattttatcctattggattgtgtgtgaacagttagtgagaatgaagacgtgtctccttccacttatcatatgcttcatgtagactttatggatttagtagcgtgtcgttaatgctttattgatctaattcatctttaactgactactacactttatcatctaggagtgagaatgaatagcaagtaaaggttgtaaaacttttattaaactctagagccagtatttctaacttaaccattttacagttttccacttagatctaaatggaagcttatgcacttgtattagacgattcccactatttctaataagtaaagaacaccacaaattcagctcattatttaacccattcagagcacttctttgagaccttatccatgatgcttattttgcagttttgcaaacagtctgtatcctatccatgtggcttcacatggtttggaggtattatatgggttccattcctttgctctttcctgcagggatcactgaccttaaggttttctgtattggtttttgtgtctggcctcatagattacttttaccttgtatgtcatgttgttttcaactcaccttttgcactgacatttctaccactgtactcctttttcaagtaatcttgtgaaatgtctgaacatatatactgtcttgaattcccttgtctcatctatggtggctttcctatgtgccaggcactattccagttgctgggtatatagctatgaacatattggaggggaagacagactacaaacctgtttatacacataagaaaatttcagagaatgataagtattaggcttaaaataaaacagagtatttcaagtatgccttggagaagaggaacgcagaattggagtagtgagagtaggcctttctgaggactttaaacctgaatgatgaaaaggggacagccatgcaaagaggctaagcagagagcattccaggcagagaaaaaagcagtacaaatgttctcaggtgtgaatgaacttgataagtttgcagaagagaaaacagaccagtgtttttagagcagagtgaacaaaaagggggcaatacaagaagaggaggttggagaattagtagggtcaaagcatgagggttcctgtaggtcacattaagacatttggatacagtgtaaaaaatatatatatttttttcctttggtgtatctgtgttatcttctcagaaagaatataagcttcttgaggatattgatattgatgctcaatatatacacattgtcacagaacttgggttaaaactctgaagacttggattctaatcccagctccctgaactagctgcgtaacctttcgggttgtgtcatttctttgtttccttatatgatcattgaggagataggatagctcccttttagtgctaaaatttgatatctttatgaacattgaagaacattgtaagtgctatattaatgcaaaatatatattacaaacatagtaggattatggataaattatatgtattgtcctagaagttccagattatgccacagaaatagctgctttatgtcctgcatcctggcatccttctcctttcaaaccttccactatttagtatacttcattcaggttcattatcatcacctagtactgttctatcttatatctcatgtaatcatatcctcttgccacttctttaataaggctttcacctctcccaagctattttgtttattttttaaaaaattatttcatacaattcaaatagcttcacatgcaatcctgttttttcacacactccacatatatcttctaaagatatttattttgtgactttcagaaaaactgtcttctcagattactctcctagaggctcagaatagaactggggaggcagacagagaagtcagtgaggtaagtgatgtgttcttaatataaccagaacatgagctagattaagagaaggtagcttcatatgaaaatacgtccataattttctagtgttgccagagaagtacattacctatagagtaagatctattaaagagattcataatggttattatatctcatttattgttacttgtttctgaatattaaaattcattgttctaaagcaacacaaatacagtagctactaatttgggatttgataacacatttttttatactgggttatcatctatctcaacttctttgttcatctcagaaaagtttctcagtgaagagattagataagactggcatagttttactaagattaaataaaaagggatctttggagaatgatccttttaataatctgaaaattactataagaagggtatggttgcttagtatcattctgttgatttaagagtattgttagctgcgttttgtttagttagctgtgtttttctaatcagtaagtcagtgatagaattatacatgcccttgaggagtaatgtggcttcctaacaaaagtatctgcttactttttaaaaaaaatcaattaggagttttattctgaaggaaaaaaagcttcttatgtaaggaatatctagaaaatgaattcccaatttccttaggtcttatgaatagggcttgacttcagtgcaggattggcagagtgcccttggaggtccagctgggagatacaaactgattttaaaaggatttagcagtgttatggtacaaagaaggttttgaccaaaaagtctgaagttttagaagatgaaatacaagtttttagttgggctatttttttaatgttataaaacatttgattacagctttttttttcttttttaaaaatagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggtaaatgagtagtgaatttttcctcctccagaggtaacttcaagcaaagaaagtctctaaactatttctgtttccttttagacaatgggactaattttggcataaatgtccatggaagatatattctctctcacttctgacttttttttggcaaacaacaatcctgctacaactgcatgaacatgaaaagttcgcatcttctcttcccatctttctattgagagatttctgtacttctgttttgttttgtttaagatggagtcttgctcttgtcacccaggctggaatgcaatggcacgattttggctcactgcaacctctgcctcctgggttcaagcaattctcctgcctcagcctcccgagtagctgggattacaggagcctaccaacacgcccagctaattttttgtatttttagtagagagggggtttcaccatgttggccaggctggtctcgaactcctgacctcaggtgatccacccacctcggcctcccaaagtgctgggattacaggcatgagccattgcacctggcctctgtatttcttttcatttccatttcaactactcttgcctggatttttaccacagtactctcaaattaattgtctagtctcgtcttttcttcttcctttagtccacattaattcatactgcatatacctcttagagttattttttctcaaatttcaattttctgtcactttttaatctatagaactaataatgtctctcatcctttgtattccttacttccaataggacccttctgttctaaaacagattttctcactgtctttcatatcaagattatcccttagagaagccaaacgttagcttgtctggagcaaagtagaataaaataggagaaaatgttacttttcagtgttgaaaaccatgtcactaaaataagtgacatattttggagtttatgacttaaatatatgaacccttaagtatgatatacctttaatacatagcactcagtagataaacatgtaggtgcagagaattaatacctcttcagtaaaatatttaacacctgttatgaatgttaattcatttgtaaatctattgagtacatgttatagtatttgttccttgggaaacacagtttttttcttgaaatctgtaactaatgaccttctctctgtttcaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagctagatgcagaactgatccaatatagagaagacctgaaccaagtgataacaataaaggacagccaacaaaagcagcttcttgaagttcaacttcagcaaaataaggagctggaaaataaatatgctaaattagaagaaaagctgaaggaatctgaggaagcaaatgaggatctgcggaggtcctttaatgccctacaagaagagaaacaagatttatctaaagagattgagagtttgaaagtatctatatcccagctaacaagacaagtaacagccttgcaagaagaaggtactttaggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactagtgagtagctagttctttctttctgatctgtttaagagtttttgaacctttctttaaatttatttttatagaaaaggataaacacattcttatacatattatctgggaacgcagggaaagtattatgtatcccacaggttctgtttggtcttagagaagcacagaaacatgatttaaattgctaaacctgccaataccattagaaaaaaaatcagaaatttccttggcacaaaactctccattggttataaaaggactaagaggtggagaactgttttatatattttatatacacaaagacatgtgtaaatgtttccagaatttgtcatagcttaactgaaagaaagtaaaaggatcacttagtgccttcttacagtgaagtataaggatcatttagtgtcttgtttacaatttagcaatagattatctggtagaatttggagcagaaaggactcagttcatctcatgggtaactcaaccctaatttgtcaaaaataaaaaaaagtgacgtaaaaagagttcctttaaataagttgaaatgactttttagtaaagttttatttgcaggctgaaccatttacccacttccttttaatacccaacatttccaatgggagaaaaagctaaagaggcttcctaatgctgacatttgacagcttttagtaggagtcaggagtttaatccaggtctcccaagattcaggggcaaaactggaactgtatgagccaagccaggttgtcaggattctactgctcctaggctcaagcagtcctcctgcctcagccgcccaagtagctgggattacaggcatgagccaccactcttggcttgttaggggattctacttggcaacattactgtcttcactttcatgatagtctgttaactctatcaaggctttgtatttgtaggaaaataggccaaataggaaataaatggagttttgaaaggctaggctttccattttgaaatgtgacccatacccagaatctgaaaattctaattttttttttttttttttaattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggccgaagattttttcttagtacagaacaaaatgaaaagtttcccatgtctacttctttctacacagacatggcaaccatccgatttctcaatcttttccccacctttcccccctttctattccacaaaaccgccattgtcatcatggcccgttctcaatgagctgctgggtacacctcccagacggggtggcggccgggcagaggtgcccctcacctcccggacggggtggctggccgggcggggggctgacccccccacctccctcccggacggggcggctggctgggcggggggctgacccccccacctccctcccggagggggtggctgccgggcggagacgctcctcacttcccagacggggtggttgccaggccaaggggctcctcacttctcagatggggcagttgccaggcggagggtctcctcacttctcagatggggcggctgggcagagatgctcctcacctcccagacggggtcgcggccgggcagaggcgctcctcacatcccagacggggcggcggagcagaggcgctctccacatctcagacgatgggcagccgggcagagacgctcctcacttcctagatgggatggcggccgggcagagacgctcctcactttccagactgggcagccaggcagaggggctcctcacgtcccagacgatgggcggccaggcagagacgctcctcacttcccagacggggtggcggcggggcagaggctgcactcttggcactttgggaggccaaggcaggcggctgggaggtggaggttgtagcaagccgagatcacaccactgcactccagcctgggcaccattgagcactgagtgaaccagactccgtctgcaatcccggcacctcgggaggccgaggttggcggatcactcgcggttaggagctggagaccagcccggccaacacagcgaaaccccgtctccatccaaaaaatacgaaaaccagtcaggcgtggcggcgcgcgcctgcaatcgcaggcactcggcaggctgaggcagaagaatcagggagggaggttgcagtgagccgagatggcagcagtacagtccagctttggctcggcatcagagggagaccgtggaaagagagggagagggagaccatggggagagagagagggagagggagagggagagcgaaaattctaatttttaagatgagctctagtgaaaagattattacccctaactgtagagtgagtttttcctttttattgtaggtaattgtattcattcctatctcacttaatatcccatatttatagacagtctttccccttttgtaatccgaacaaagcctctctgttcagttatggtttttacttccaacatacacatacttgtttatattttttaaataatttgagtttagctgactttgccctgggagcttggccttttgtctgtcttttcagaccgtaaatgcaaaaggttctattcatcaggatggtatgtgcctcaaagctgtaatttatgatatgctggtattgattatcttctaagtcaaaatcttttttcatggagctgttaggatagattctgaattagctaactatgtttaattcagtgaattgctttattattcttatctgttataaacactaggcactaaactttgcacatttttgtctgctggatagttacagccaagccaacttttttattttcgtgtttctgtaattcagagtcatattattctgttcccaaatgctcataactgtgattttattttaaccatcaagatgtatcactcctttattcacagtgtgcctcaagtatttttattttccatcttcaacatcctaagataagctctaacactttacccttaaactgttctaataatgttgcttccaggttatcatctcaccagtattttcagaccatcgccatataagtctttctgaaactctactgtattactgcactactcaaaaatatttaaaagttgtactatctctagaatagacttagtattcaaaccccctttagtctggcatttaagaccctgtttttttgtttgtttgttttttgagatggagtcttgctctctcacccaggctggagtgcagtggtgcaatcttggctcactgcaacctccgcctcccaggttcaagcaattctcctgcctcagcctcccaagtagctgggactacaccatgcctagctaatttttgtatttttagtagagatggggtttcaccatattggccaggctggtcttaaactcctggtctcaagtgatccacctgcctcggctcccaaagtgctggaattacaggcgtgagccaccacacctggccaagaccctgtaatttatccatacctttccagcgttcccttttactgctccctactcatacccttcattcacaccaaactgatctactcagtatgcaataatcacacctggtacttcctacttacccatattatcttcagcagccaaaatgttctcccaattgctttccttttttgagtgtctatttcccactatttaaaggtcattccagagctcagatcctcttcttacatttcgtgattgcctgattgtcttttgcctttgtacttccctagtattttacttatcatttgtcccatattgccttattgtgtgtgtgtgtgtgtatatgtttaatttctgtacactattttttatttccccaattagattgcaaactcctggtaagtgtcatgtcttatacttatttgtacatctttagcatagaactgactaagcagatgacatatctctaggggtgcctgtatttatctatactctcctcattctgaaaatgacttggggtagcatataaagatataaacaatttttcaagataaaataaaagggactgagaaggaggagaaaaagaggataggctagaaaaagatcaaaccaggagtaaggttagtgtcccaaggggaagtcaccatatcctgtactgtgttagaaagagggatccatagtttgctctgaggtttctattagccatcagaaagagggaatgaaaaccgcatgcatgaactgcagtatttatagtctaggagaaaaggagaaagaaaaatcacctactcaagacaagaatagtctttaagtattgaggcctgtaagaaatttcttctgtgttcccataaagagaacactgtgcagttgtgaaacatccattacttctctacagtaaatataataatgtgttttttagggtttttatttagctgtcccttaatgtaagtgcagagcaaaagaattacgtccagttcactaaaactaccactccaaggagctaaaatgcagtcccaggcacacagctttctgatggtccattctaggatacctctagtctagtatctagactagaggagtgagtggattgcataaaggaatatgtttttaccttaaatcaaaacaaaaatatgttttggggtttgggttaaaaataaagttatatgacccatatttaattagtcactaaattctacaatgtttggtgggaaaagctaagagtagcactacctcaaccccatttcttctgaggcaatttgctttcaacccttttagcttattctttcagtatttcctgtgtatgtaaatatcatgcttatattgcatttttggctctttgttgcatcaactattgattttctttacactaacagggtttagctctctgtactctccctgctttcacagtaaaccctgttagtgtatgcacttttttatttatttatttatttatttatttatttagaaacagagtctcgctctgttgccaggctggagtgcagtggcgccatctcagctcactgcaccctccacctcccgggttcaagcgattcttctgcctcagcctcccgagtagctgggactacaggtgcacgccaccttgcccggctaatttttgtatttttagtagagacagggtttcaccatgttggccagggtggtctcaatcttttgacctcgtgatccacctgcctcagcctcccaaagtgttgggattacaggcgtgagccactgcacccggccagtgtgtgcacattttaatacaaaccccttcctcattttcttgatgtaatttaattttaattttggttaaatcaattcagagttacattttttatgactacaaatgctactagagcgttagagacatgttacttttattttcctgagtctttctgtttttcccagattaataagtttttgttattgttgttccttagttttctttgtacttaatgtaatttaacctcagatttactgccatttgtccacatctcctttcaagatgtttattcccatcaatttcatcttcaggaagaaaattctcctggagtacctgatttgctcctatatcaaccagtggccctgtactcctaggataccctttctatcccagaatatttccctttacctttctcctatattagatctcctatttcatctattctatgtattccttttcttggttttgtgccatctttttcctggaataaatcattcagtagatccctaagaaatggtatgtggaaggtaaatttattgaaaatgtctttttatctctcttatctgattgatagttttgctggatatagaattctaggctgaaaataatttcccttcaaaattgtgaagacattggtttattgctttttagcttatatgtggttcacaagtctaaagctattctgattcctgatcctttgtatgtgatctgtttctcacttcccttcccctcaccccaccttccctccctttctcccctattctgaaattttttgatagtataatttggtataggtctttttttcttcatcatgctaactagtcctttgaatctaagaaatcatactagcagctttttggaaatttcattaaattattttttaccattttcctctatcctttttctctgttgtcttatttctgaaatgtttgttatttagatgtaggaccttcttgattgcttctctaattttcttaacttttccctttttttttttttttgctgtaattctggaagattttcttgccttcgtcttttgattccaacatttttttcatttttgccattatattcttaatttctaaggattttttttctgtgtctcatagacagatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttcatttcctttgtgggggaaaggccttttaccagcactcttcaagctcagtaggggaaagacttcaagcactcaggaagcatgcattcactttatttggaacaatacccttacttgtaactgtgcctcaggtgccatagtccacagagacttcttttacctgtccagagaataaaattagttgtctgttggggtaacaaaaagtgtggagctgaagagggtacctataaatgaagttgttttctggccgggcgcagtggctcacgcctgtaatcccagcacttcgggaggccaaggtggagggatcacttgagtccaggagtttgagaccagcctgggcaacatactgagactccgtctctccaaaaaaaaaaaaaaaaaaaaaaaaaaaaattaaaagaaattgcttcttaagcagctttcatctagacctccttatctcagctatcacctccctcccacccccatcaccatcttttccagaggtgcctgatgctgttaattcctgagccttttgaagattctgcagagtaagttccactgattcttggattttcttactaccagctttagattctgctttctcagatctgttaagtcagttaccacttactcatctgcttttcagcttccaaaattaattttattgctgctgattcctctattgtttttcctgttcttgtgttttgtgctttaaaaaatgctattattttagctttagcgatgtctctaagtgggtgaaagaggtatgtgaacaagacccccatctttgcccagatgtcctgatattatttctcccttactaagcttttaatgagtattggagataaagaagttgaaaatatatctgaaatgtaggtaggcagtgttgttaattaaaggcaagtctgtcatcatcactaactttatgtgtgaagtgcattaatttgctcatttacttctcatattcttatgaaaaaggtactataattatcttcatttaatagatgaggaaaattagcctgggcaacagagcaagactccctctcaaaaaaaaaagaagagtatgaggaacatgcattgggtcacacgtccaagaagtagtaggatatctaactccagagcctaagtgtccttaaccactgagcagcactgccttctttataatcagtatccgctaagctacagttaagattgatagccctgtaggaaagttaagaaccctaacaaggacacatgactagttcttgttttaggatgtgaccacccacagtgaagctctaggtctcttaagtctaccccacgtcagaattgtagccctaaagtgaacttaggaccttaggagccaggggaaggagtagaagttgcaggaatagtcacaccctgtagccttgatggcagctccatgggtgatttccaccagcctagctgcatgtatttcactactttagagacttatgttgcagtgatatgtcatcagtggactgttaggtgctggtttcatgttgtggtgtctgactacttagtagggagctaccaatgacttacagttagatgaatgagatgtgacaaataatcattttactttccctttggttaaagctgaaggaattgaagaatctgcagcagcaatacttacagattaatcaagagatcactgagttacatccactgaaggctcaacttcaggagtatcaagataagacaaaagcatttcagattatgcaagaagagctcaggcaggaaaacctctcctggcagcatgagctgcatcagctcaggtactatatataatccctccttttcaactcttttcattttaactttttattttgaaataattgtagatttgggaaaatagtgcagagagcttctatgtacccttcacccagtttcttccagtggtgacatcttacataactgtagcacagtatcaaaaccaggaaactgccattggtacaattcgcggaccacattcagattccaccagttttacatgcactgatttgactatctgtgtgtgtggttctatgcaattttgtgacatgtatatttaagcaccaccaaaaccaaaatacagagctactccatcaccacaaatacgtcctttgtgctactagtttatagtcacattcctcccttccctaccttcctcacatccttaacccctagcaaccactaatctgtgttcaattttgtcattttgagaatgttttctaactggaatcttgcagtatataaccctttgaaattggcttttttcatgtgccataatgcccttgagatccatcagttttgttgtatgtatcaatagttcattcttttcagtataaataatgtttcatattatgaatataccactgtattcacctgttgaaggacatgcatattgtttttaatttttagctattctaataatactactatgaacatttgtgtataagtttttgtgtggacctaagttttcatttctttgggataattgcccaggagtgcaaatgctagctcatacaataagtgaatgttttgttttttaagaaactgcaaaaccactttgcataatggctgaacatctttttaatgtgtgtatttgacatccatatatcctctttgatgaaatatctgttcatgtcttttgtccgttttctaattgggttaattttttactgttaagttttaagcgttctttatatattataggtatgcattctgtgtttgatttgcggtttgcaaatattttttcccaatttgcagtttatcttttcatctccctcaacagggtctttttaattttgatgaaatccaatttattattttctctttatcattcagatttggtattttctatttgattttcaagttctctgcttcctacctccattctgctatggcacccagtgagttagctttttattttggatattgtatttttcagttctaaaatttccattcagttcttctttatatcttctatttctttgctgaagctttctatactttttccagtatgttagtaatcgcttgtttaagcatttctatgacagctgctgtaaaatccttgtcatataattctaatatttgtgtcacctcagtgttataaactgttgatttccttttcttaatcaagttgtggttttcctggttcttggtatgatgagtgatttttagttacattctggacattttggagattataagactttcagtcttatttgaatcttctgtgttagcaggcttcactgacaccacaccggcaggggaaggaagacactaggtggatggtgaactccaggcaccccattcaactttcgttgatacccctaaaaggaagggatgccctgatactgccaggaggaagtggaagtccatgctccccacatggcctccattgatactgtgctggaaggagtggagaggggcacctcattattgccaggtggtggtaaaagtccaggctatccacttagcctccactgacactatggggaatggttaagaggggcatcttgttaccactgggtagtactcaaagtccagaatccccacttgatctcttctgataccacctctgcagggacaaggaagagtgccttattaaccttgttatggtggagggggatgtccaggccccacatgttgcctccactgataccacagtgggagtgggggaggaggggcagtcggagagaggcaccttcttagcactaggtgattgtaagagtccaagctccatacctggccttttctgacactactccagtaaggagggtgaggtgtaccttgttaccaccagccaagaatgtacctagcttatctaccaggtctttgttaatgggagtggtgagatactgtgttttttccatgttgtttgcctggagtatggtggttattatcattaatggctctgtctagctagactgtcccttcctggtcctttggcaagactgagtaaacttggtactcattggtgtttccgggtcatggaattctccagtatccggtttgggatatgcagaatacaaatggtaaaccaaagaacttgccaccatgtcattcctcaagtctggggatccctagctggtttgccaccatctttctaaattttcttatgtttgtttttatttataaggcccaagagttttatctatgcaggttaagtattccttatctgaaatgcttgggattggaagtgttttggattgcggatttttttggattttggaatatttgcattatctaatgagcatttcctttgagtgtcatgtcagtgctcaaaaagttttggattttgaagtatttctgattttctgattagggatgctcagccttagttggaagaataaggagaaatgtgtctattttattttgtctagaaccagaaatcctagctcttttctttttaaggaacagaacaataataatgctatcatggcagaagaaattaagataggagctataattctgattttttttttaattcagtttttctgacaaatttaatcccaagattaaacacttagtgtataaaaacaggtctagttgttgcagcctcatttttgggaggttgttactgtttaacttaagatggttcatgctgccttaataaattcatacttggctgggtgcggtggctcacacctgtaatcctagcactttgggaggccaaggcaggtagatcatgtgaggtcaggagtttgagaccagcctggccatctctaccaaaaatacaaaaattagctgggcatggtggcgtgcgcctgtaatcccagctgcttgggagactgaggcaggagaattgcttgaacccgggaggtggaggttgcagtgagccaacatcatgccactgcactctaacctgggcaacagagtgagaccctgtttcaaaaaaaaaaaaaattcaaaaagctttcaagatttgatattaaaaggagaattaccatgttggacattgctgctgatcaagcagcacctgctttgtttcaccaatgctagaggacaagaggcaaatgaatacagaaaatatgagttggaatctcaatttctatccagcttacaaggggccattagaatgacaactgtcaatatagtataaatatcataacatctctaagagagttcttaatgttcagacacaggagatttcaaaccttaagcaacattgatatagcaaaatgctttttggaatttaatgatttaaactttatggagtaaaattacatctaaaagattttcatatttaacatctttatggacttgattataagtgaacatttatcaagctcattgcatggagttggcagcttccccagataatacaagaacaaattttttgtttaaacaaatgatgatgattgcagagcaagtaaaaagaaaatggcaaaacaactgagttttgctctctagaaatataaatttgtttcttcttttgaaattgaatctcaagagaaaagataaattgctccattttaacctccatttttcttcagggaatagcaccccagctttattctgttagaatcttaatttatcatcagaagtttaggtgcttgctgtgtccttcagatgcacttgaatttagggccctccaaaggtgattggtaccgtatcagagcatcgcttgatgcctctcatcttatctccacatcacctagaactacagaaatattaaagtgttcagctactagtgtaaacctaagaagagctgcaaagctctaaaggcttatttcctgcagcctttcttctttaaatttcctctaatggcaatctaaaaggatatttattttccttatttccttatataattgacccttagggaagagaaaaggagatagagaaaaaaagattcctgttttttcccccacattttctctctttccacctttttcttagcctttctttctttaccttccagatttgagtaactttgaagataagcaaagtgctgaggttacaggtgcgagctaccatgcccagttacaagtatatttttacctgtgattgtgtcatgttttttctaggatggagaagagttcctgggaaatacatgagaggagaatgaaggaacagtaccttatggctatctcagataaagatcagcagctcagtcatctgcagaatcttataagggaattgaggtcttcttcctcccagactcagcctctcaaagtgcaataccaaagacaggtgagtaatttcaatgctgattgttactcagagataaatttttaaacaaatgatgatgattgcagggttttgttttttttttaagacgctacccagaaagcatcagcttcctacaaattaagtgcccatctgccactattaagtgcccataagccaccttatgacttctatggggcggacaggatttctagagggaaggaattaagcatgcgcaatcttaggagagaatctgatcaatgtttgtgtcctggcaggcatccccagagacatcagcttccccagatgggtcacaaaatctggtttatgagacagaacttctcaggacccagctcaatgacagcttaaaggaaattcaccaaaaggagttaagaattcagcaactgaacagcaacgtaagtgtttcttgttagactggaattcagtttcttttttccatgactggaacaagaaggcaagtagaagccaattcagcatagagtcccagctgtagcatatcttagggtacagaagtttcacctttctcagaacctgggtgcttattccaaagcactggacacagggccatttcttgtcctttgcccttggtgagtccttgggaatgattggataaatccagacagtaaaagtaaagaagccaactactttaggaagccttccccctgacctgtatcacttgtagtaatgctgaggctactccctaccccaccctcttaagaattgtcctcctgttgttcactgactattcaaaatattctttagtggcacctgccctagttctgccctcttgagaggaactcagctaagtagtctatgatagaactacaagatatttagagatcaatcagaatcagaagtccagagattagctttgaggagagccaagaatgcccaaaaattgtatgcacaatagtgtgtgtgtgcgtaagcttttcatcacaagaactcatcagttgaccaaggggtctgtgatccaaaaattaaaaagatcactaggctgttttcacagatgaggaaaaaggccctggagtagtaagtaacttgcctgaggtgttaggacgaagtcagtctgaaataaacgtgatcatgcatgtggaaaagcacagtgcctgcatatgtagagggtacttattaaatgtagttaaattcaactaattgacactgaagtatcagagaggagacatttgcagtttttaaagtctgcaggcccaaatgaattagttaaactgtagactctttattggtagatttgtctgggagttttcaaagggactccagagcagctcccatggagttccccttccagcaaatcagctatttccggaagttccaccctttacagctctagcctgtctcttttttccgtcaactaactcccgtctcaggcctgttacatttgctctccaaacattagactctgaatcacattgggcatttgtctgtctaggacagtgttttaaactgaaattcaggaccattaataaatgatgaaatcattttggtgggcaacaactaaaaaaaatttttaatgttttattgaagtaaaacatacagaaaagtaaacaaatcataagtacagcatgatatattttcacaaagtgaagatacccatataatcagcacccagatctagaatcagaacataccagaactccagaagtcccttgtgtcttctgttcactcctacccacttagaactacatataaatggagtcataccttttcttttatattgcttcatttattttgtgagattcatccatgtcgttgcatatagtgtcatttttccactctcatgctgtgtagtattgcattttaggcatataccacaatctctattctgttgaaggacatttgggcttctccagtttggggctattacaaatagtgcagttggtgtttttacaaaaaaaagaaatgaggtaaaaacacgtatgtaatatataataaagaatatgtctgtctttggaaaactttagttttaattgtatatatttatatactgggttctaagtcataaagttgtgttttttaacacctttattgagatatgtaattccacttaaagtgtgagaaacactgcataggtcactgtcattctgagtgagaaacagtttttcctttagaactcaactgtaagaaaggcacctcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatagcgtgaacccgggaagcggagcttgcagtgagccgagattgcgccactgcagtccgcagtccggcctgggcgacagagcgagactccgtctcaaaaaaaaaaaaaaaaaaaaagaaaggcacctcattcctagccttattcagtcattaaaacaataactattatttgtcttccatgagcctggctatatgctagatactgaggatatacatattccttcatgagcttagcctcactctgaatgagtcccagctaaataggagaattgcttcttgggccccagaatgagattgtagtagatgggctgtcagcatagattgttcttctctaagccacttccctaattctttcttcagatgttcaggttttatatttatagttggcccttcatattggtaatttctgcattcacagatttaactaactgtagattgaaaatattcaggaaaacatgaattttaaaaatacagtataacaactatttatatagcatttgtattgtattaggtattataagtaatctagagattatttaaagtatatgggaggccacaggtaacattgtactgaacagggaaaaattgaaggcctttcctctaagatctgaaataagacaaggatgcctactttcaccactgttattcaatatattattagataccctagctagagcaattaggcaaaaacaaaacaaaaaaaaaagcacatccagattggaaaggaagaggtcaaattagccttttttgcagatgatatgaccttatacttagaaaaacctaaagaatccaccaaaaaactgttagaactgataaatgaattcagtaaagttgcaggagacaaaatcaacaggcaaaaatcagtagcatttatatatgccaacagcaaacaatctggaaaagaaatcaagaaagcaatcccagtcagccatggtggctcatgcctgtaatccttgcactttgggaggccaaggtgagtggatcacttgaggccaggagtttgagaccagtcttgccaacatggcgaaatcccttctctactaaaaatacaaaaattagccagccatggtggtgcacgcctgtaatcccagctactcgggtggctgaggcatgtgaatcacttgaacttgggaggcggaggttgcagtgagctgagatcgcacccctgcactccagcctaggtgacagagcgagactgtgtttcaaaaatagatagatagatagatagatagatagatagatagatagatagatagcaatcccatttataatagctacaaagaatttaaaatacttaggaatcaatttaaccaaagaaatgaaagatttataaaacactgtgaaagaaattgaagaggacactaaaaaaaggaaagatatttcgtgctcatggattagaagaattaatatcattaaaatgacagtactacacaaagcaatctacagattaaatgcaatccctatcaaaataccaatgacattcttcacaaaaatgggaaaaaaaatttaatatgtatgtaaccacaaaaactcctaactagccaaagcaatcttgattaaaaagaggaaaactgggtcgagtgtggtggcttacgcctgtaatcccagcactttgggaagccaagatgagtggatcacctgaggtcaggagttcgagaccatcctggccaacatggtgaaaccccgtctctactaaaaatacaaaaattagctgggcgtgatggcgggggcctgtaatcccagctacttgggagactgaggcagagaattgcttgaacccgggaggtggaagttacagtgagccgagatcgcgccactgcactccagcctgggtgacagagcgagactctgtctcaaaaaaaaaaaaaaccaaaaaacaaaaaaacacacaaaacaaagctggaagcatcacactacctgtttaatgagcatgatactggcataaaaacagacacatagaccaccaatgaaacaattagaaacccaggtataaagccaggcatttaggggcaacttgtctttgacaaaggcaccaagaacatatgatggagaaaggacaatctctctaataaatggtgctgggaaaactggatatctatatgcagaaaaataaaactagactcctatctctcatcatacaaaaatcaaatcaaaatggattaaagacttaattctaagatctgaaactatgaaactactagagcaaaacttgtggaaatgcttcaggacatggatctagccaaggctttttttgtgtaagtcctgaagagtacaggcaaccaaggcaaaaatagacaaatgggattacagcaagtaaaaggcttctgttcagcaaaggaagcaatcaacagagtgaagagacaatccacagaatgagagaaaacatttgcaaactacccatctaacaagggattaataaccagaatatataagggactcaaacaattaaatagcaggaaaacaaataactcaacttaaaagtgggcaaaagatctgaatagacgtttctcaaaagaagacatacaaatggccaacagatataaaaaaaaatactcagcatccctaaacatcagagaattgtaaatcaaagctatagtgagatgtcatctcacctttgctgaaatagcttttatcaaaaagacaggtagtaacagattctggcaaggatgcagagaaagggggaactcccatacactgttagcaatgtaagttagtacagccactgtggagaacagtatggaggtatctcaaaaagctaaaaatagaactaccatatgatccagcaacccacgtatctacaagaaagaaaatcaatatatcaaaaagacatctgtactcccatgtttattggagcactgttcataaaaaacaaaacatagaatcaatgtaagtacccgtcaacagatgaatagattaagaatgtggtatatgtacacaagggaatattattcagcttttagaggtatgaaattctgtcatttgtggcaacatagatggaactggaggacattatgttaagtgaaataagccaagaacagaaagacaaatatcacattctcactcgtgtgggagcaaaaaaaaaaaagtgaatctcatgaagatagagagtgcattggtagttactaaaggctgggaaggataaaggagaggagggaatgaagagaagttgattaatgggtgcaaatacatggtttgatagaagaaataagacctagtgttaggtaaatcaataggtgattatagtttaccacaatctattgtatatttcaaaatagctagaagagaagaatttaaatgcttctagcgtaaaggaaagacaaatacttaaggtgatggatattccagatacactgatttgatctttacaaattatatgaatatattacattatagcatgtatcctgaaactatgtatatctattatacatgaattaaaaaattttttaagtatctgggaggttgtgtataagttatatgcaaataccctgccattatatataaggaatttgagcgtcctcgaattttggtatactgggagttgggggtccaggggtggttctgaaaccaataccccatagataacaagggatgactgcatttctaccagctgtttggatgttagtatgtaatgtaagaatgtgctagaaacttaaaaacatgagatggatgattagtgacataatgtagtctaaattgttccctcctattttgtttttacaggtatagatacagtgaaatatagtagcttataagctagaggagaggtcagcaaacttttccttcaggctcagacaatattttaggtttgttgactgtatggtctttgttaacaactactctctttgcagttgtaacacaaacgcagccatagacaatatagaatcaattgggcggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaacttcctcttaggttaagggaagaacatgttgtgccctgtctcagaatccaatagttgtcattgtacccagttaactgtcttcaaattagtatcacttcccaaatatttatatcctttcctaactattcccacctcctcccacaccccccccccccaaaagaaaaccctatgattttcttagctttccttgctagactatcagactggacaccatcagatagtagatagagctctagacttggaatcaagaaccacacttgagtcctggtttgacatctactagccatttgtaaacaaggacagaaatcctttctctacctctctcaaataagatgatactggtgaaagtactttgtaagctaacattgctcttcagaatgacaaacacaaaaaacaaccctacatctgaagagcaattttcagctaacagagcacttttacaagtatgtatggattatcttgttctaattttctatttgcatcaaatgcccttcctcacagttgtctctagaaaactgtcgtctctcctctaaaacattgtttgtttcaactttttttcacaaaaacttacaaaaaagaatcatcaagaaaaaattgaacatgcaactggtatactgggttcctctcatataatgtacatggtcctagagtagataacttggagagacatctccatggttattaatgtacctggaggctaatcacagctaaaacttaaaacttgacagcctgcaagtgagagaattatagttccagagtaccaaattcaaatcaatgggtagaagctacaataggtaaatttttcattcaatataaaaatgaattttcagttttttaaatggtttgggttgctttgtcaggcagtgggcgccctgacactgaacatgttcaagggaagactgaacgatgacctgttagtcatgcagtagaggagagtcctgctttaagggactgaaatgtttctacctgggagaatctatgctctcaacagtttctgacatatacatatacatgttgggatttattctgtttctcccttctaccacatattataattttttattctattctctcagtaacttataactctttatggcattgaggaatctgcctaggaatattattgcacagattttggggtgacagctctctccagccatattgagttctggagattatagtcatttgttagtaccatgaactttgaccctgaggtactgccttctccctcttatgtacccagaatagcctatgtaattagattgcttatggacttctgcttcatggtttttcagttaatgtactgggcaccatttaaaaaaacaaaacagaacaaaacaaaaaaacctttctgctactcctccagaattgttttctgtcttggtcaaaaaaaattatgctttttccaactttgaaggcacacaaagtgctattgttgctgttgctgaaacaaaggtcttccataggaaaattagatcctgaaaactcagaacatttcacctcagcactgcttacagtactgcaggatgatgcttatcctcgcctctgtttcagttctctcagctactggaagagaaaaacaccctttccattcagctctgcgataccagtcagagtcttcgtgagaaccagcagcactatggtgaccttttaaatcactgtgcagtcttggagaagcaggttcaagagctgcaggcggtgagtaaagagaaggtgagagactgggagaagtgtgatgaaatttagtgcaagtggtgaagcactacagagcagtatggaagaagttaatgtaattaggggtcagggaagaaagtgggagagaagaaagagttaattgagatgggaataaggtctgagaaaaattacagtgaagcaattagaagaaaaaagatcagtgagatggtgggagagaaatcaaaacatgagtaggaaacagtgatgactgagacatttggtactctgaaacagagaaagtgttgattttgctttaagttataagaaaattgtaggaaactttggatctgagaacaaaacaggcagcactgttgacagccagggagaggagtacagcattgaagttggaggagactgagaattagtatggagacgtataggatacggaggaggaaaagggggttgggaggggctggacaagcaagggaaggatcaaagtggcttctggaaaagccataagcatccacagcagacttaactttttttttttttttttttttgatacggagtctcgctctgtcgcccaggctggaatgcagtagcacgatctcggctcactgcaacctccacctcctgggttcaagcaattctctgcctcagcctcccgagttgctgggattacaggcgcctgccaccacacccggctaattttttgtatttttagtggagacagggtttcaccatcttggccaggctggtcttgaactcctgatcttgtgatccacccacctcggcctcccaaagtgctgggattacaggcttgagccacggcgcccggcccagacttaacttttaagaggagaaattcaagaatgagaatctgggagaaaaatctaatcaagacaagagttttatgtaggtgagtaatctgctagagcagaagcttctcacttctaaatttggacttgagaattataagcggggatagtcctctgtaaacgagctctcattttgctcaaatacactttcttaagagctttcatcactgaattactaagcttattcttcttccaggggccactaaatatagatgttgctccaggagctccccaggaaaagaatggagttcacagaaagagtgaccctgaggaactaagggaaccgcagcaaaggtaggggagtggctctctaaaccctggagcatacaccagagtccagaaattgggcagtaatctagatttaactggagtcctttatatggatttaatatgtcttgttatcttattagcctcacagaagtgatgtgaggatcaaatagtaacaataataactaacatttgtgtgtgaaaagtttgtaaaacaaaaagagcaacaccaacacacacacaccactaacaactactctatgatagtaaaatgaaagataatcagttcctgaaatttctttaggtattttctgcagcttcatttaatccctctacagctttgcttttaaaatattgtgtttagacaagcttctatggattttcttgctttacaaccttatgaagactttgaatcccttgtattagcaactgttttctgcatctgatgatgctttttgttttcctctcatcctaaagcttttctgaagctcagcagcagctatgcaacaccagacaggaagtgaatgaattaaggaagctgctggaagaagaacgagaccaaagagtggctgctgagaatgctctctctgtggccgaggagcagatcagacggtaaaggctgaaggagatagcctctgttcccttccgatcctttctgatcaaactcatgtacatttcctgccagacttaggatttcttaagatctttttctcatcttgaggtagttgctgcaatgagtttaccaacattgtggtcacccaagagaacactgtacttttggagtataagagagtcagtgttttctaaaacagttgttcttagagaataataatgatatctaccattactgaaagatattttatttcaccctaaccataactatatgaggtaggtgttgggttctctagaggaccaaataagtgacaacctcattttctacctgagatctgaatccatggaaatcttttttaaaagattaaaagattgagagattaaaagactgctttataaatgatgttaaaagaatgtagctttttatttgttggcaaatgcacttcctaaccctgaacttcccctcccagtcacagacaatgttgggccaaggtagacctccttcacagaaaatcctgctcttgccaaacaagagtattggaataacagagtgaactgtgcttcctatgagcagtttgctccaagtgtaatttggaagggcagagctacacatccctagttccttattctcatcaaaagaatcactatgcatgagaggatagagagttgctacaagtattttgctgctggaagtccctttccacggaaaatatcgttaaaagcaggcacttttattatattttgggagaaagccacctatgtatatgatcactttcctcagagaatgacatttctgatattaatgctttcttgtaaagtttatgtggcagaggtgacagccccattgagcaggtcttacttgagatacctttctttccaatccaacatattcacaacttcttaattttcatcacctattcaggccttgatatgcagctttgagggtgggccagctttgcttaatgccttgtgtggtgtcttgccatctctgccgagcattttcaggcctgtgccctcatgactgtttctcttctacttgctattgaattgtttagaccggtgaaacctggccaatggggaggttgatctccctcttgtgtaactaacctgtcccaaaccaactgagactgcatgtgtgggatgatgactcttgagcctgtgggcaagccgtattaattcaagccacaattccctctttagctctgatgcagaatggaagttggggtagctaattaagggctgcctgcctagtccaggtactgccattgtaatgttagaatctcacatgtactctaaagagcaggtggaactcagtggccctccagtttaaaggcagccagtaccatcttcctcatcaatacctacagacttctcatccttcctcagcatagcctacattgacagactgacctccatagtaacagaccatgctgttccagatcaaagctgcttctgaaaagcttatcacatggaggaatagacacagaaggtgtattttttagtcagcctggctctcaggagggaagcaggaaagaaggagctaggctgtgcatgctcagttctctttctagactcacaaattggattaaggtgtttcttctctcccggggaaaagaatgtgtcctgcagagagcccaagaatattaaactaatagatatcctttcagaaggagaaaacacaaagagtagaggcaagagtttcatcctctcttccctattgaaaaagttcatccctataggcaaatgcttgatcaaacgtgctgtgttacatgcagctcctttgtttgtttgacataaccattgagtgagtaatggcagcttcttcattaaatggagaagttccagtattaaataagcaaatcagcaaaaactgagccagaaggcagtggagactgccaattcaatttaattttttttagttcaatttaatttttaaaaccccacagaaatcttctttggatgcttttgcctattagcctttaataaaagaaaaaaatgtaatgagtttctccaagtcaggtgtggtgtggtggaaaaaagaacgtgaggcttgaaagacaaagttgggtattgaattctggctctgccgcttactggctgtgccgccatgggcaagtaatttaacctctgtaagccttagcactttgaagataataagaccaacctcagaacctgaggattaaatgtatgtaaagcacccagcctagagcctgatacatagtgagtaggcagtcaattcctgatagttattgtcacattttgctgctgctgaaggaaacgtatctgctggtaccccccttgcatgggtttgggtttatgggagcagcttttgctgcaagtctcctcctgtgctgcattgtgtggcaggatgactgggaagactgggcctgatcagcctctcatgctatgaaccaatgctatgcctcttttttttctcaactcaggttagagcacagtgaatgggactcttcccggactcctatcattggctcctgtggcactcaggagcaggcactgttaatagatcttacaagcaacagttgtcgaagggtaagaggaagaaggataaagagagggtgttttattatctgacagggctggctatactgggggcaaggagctgaggagaaggaatgtggaagtccagccactgagcagcgaatgagtctaaggctggaagggcgtggaagattagaacctggtggaatttgccaagttgttgactctgaggcaactttcctctcagaatacccctttctacagtggttgggtcagctttgcttaagtgcaagactagtaggagggaaagcaacatagccctatagggtgaaaactctctgactttcacatttttctttcagacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatgaagagtttgtgtgtatgtgtgtgtacgtgtgagtgaatggatatatgcacaggtgtttcggtacctgtgtttgcatgctggggggtggaaggtgggtaagggaagtagggaaaggaggtagccaggaatggttataggggtagaaagctctacatattcaggctttcttctcactggccaatatcagtgacagctgcatgcatttttccagccttagctgctagaccccaggtgatgaatgcagtgaggaaattctatcctaatactgaaccaaataagctgggccttagggcatgaaattgatgcaggtccatgcatggtcctgggagaactcttgtctggcacatagtgaaaacattaggcccctagggatccctctgggtgggaatgggagaagagaagcttaatagcatgtagcaggttagataggcattattatgttttgttttgttttgttgggttttttttgagaccgagtttcactctttcgctcaggctggagtgcagtggcacaatctcaactcactgcaccttccgccttccagtttcaagcgattctcctgcctcagtctcccaaatagctgggattacaggcacctgccaccatgcccggctaatctttgcacttttagtagagatggagtttcactgtgttggccagtctggtctcaaactcctgaccttgtgatccacccgcctcagcctcccaaagtgctgggattagaggtgtgagccaccgtgcccagctattatggatttttatattaagttgctgcttgagagaagatagctcactttctcaaagtacaataagtggtttaattgaaccaagtctgtctggcttcaaggcccattctttttctgtgtgatacacctcactacctcatcagtaatgaacttgtgacatttgctaaggaaagatgggacttcttggtgtcatctctgattaatttctatattttctctagagaactatgtacctggatggtgtgtcacatcatctagtctaaatcgtattttgacactacatgaggattccaagtgatttttctcttgtacaaacgtactcttccttatcataactttggtaccaccatgataaataggtaataaagtagaaggaataaataaagctcccccaggcatagaatccttagatttggaagtgacagaggcttcatattcctaatgcagaaaagtgcctgtatcatgggccagtttcatccagtcctgcttaaactccttggaggatgcaccgttgtgaacaaatcaagaagtccacaatcaagattaggaaaggctaggtcagatacaataacagacaccctcaaattctcagtagccaaaacaaaggactattttttagtgaaagactccaattcccccacatggtggatggggctccacttgtgttctttctcactcagggacccagtctgctggaggagccaatatggagaattgcaggttgccttgggcagtggtgaaagcatggcaaagcttgcagtggtcttacggcctccgccagaaagtggtatctgtcactggccaaaacaagtcacctgagtaagtctgacttcaagagggaagggaggggcagcaagtcttgacacgcagtaaaacaggataccacaaagaccttcttccatcagctgaccagcacctggttctttcagaattcttcctacgctctagagccaaatctttagtttgttagctcagactccacagtgccccaaacaagctaggaaactctccttccatgtcttgccttttccctcatgagttattctcttctggcattcaattggtcgacgtttatttgaacatctatatgaaaactccacttttaagtgctgtgggtaatataggggtgagtttctttttaagtcttatgcttcaaaacccacatataaatcacttttcccataaagcctttcttgatgaatacacccaataccaaatgctctgaattcctttactgtctcaaatgtaactgccaccctatttaggacacaatgctgttctacagcattctctaatgtgttttctggttgaatgtttgtttctctcactggattacaaactcagagtcaaagcagcattttctatgactgctctatgacccccattgtcaaaaccttgcaaaagaccaggcacagaaacatttaatccttttaaaatttaagtgtctaaagcagaaggaactgactcaaatttcaggaagtagctgtgaggatggggtggcaggaaatgacgaaaacctgaatacggaactgaagcagcagctcagtttctcactccgaagtggcagcagccagagagggagtcggtgtggacgcgaggagccgggcgcttagaacagaggcttgcacaggtggaggtgggtactctgagccatgggacagttgggaaacacagagtaagagttgaggaggaacctacctggctcttagtccttggtgatgggcaaggtcaccactagtaggcttttatccttttatggccagaaggcctggttgtgagtggttgtagcaaatcagcatctggagatagaaacaaaagggaggggcttaaacccaaggcaagtgtttcaggagccatctagcaccaacatcaagcaaagtgttgcctggtttctgctgacaatctacaacccactctaaggcctgtctcccctaggtactgagctgggaggaggaccacaggagacgaaaacagtgtctgcccttgaagagcatatggtctcagggaaacaaacccacacaggaaatgtaacagatcaggaagtagtcactgatgtacactagcactgagtaccaagtgctgatggagcccaagagaaggcatgattgttctgctggggctagtttctgtgttcgtagatcacagaatctcagaatgtcagaaatcaaggagaccacagatgagctacgttaaccccttcattattttccactgggaaaatcagagataattgctgatttgccaaattattaaagttagtatttcttaatcgcctggtctgatacctggcaaatgagtacctactctgttgatgcccttgtgatggtccctcagaggcttagtcacagagctggggtgacagccagggcttctgactcccagtctgtgtactttgatgcaggaggtcagcatcgcaacaaggcctcaccagattactctctggttctcacctctagatagcacttcttacctttctggtttctggtcaataggtcaaggatattagataaattgtctctatttcagaaactctttatttcaaaaatgggtgaatgggagagtcaggctgaggcctcagaggagccacaggaaggaggatgggaccatcagtcctcattgcttccttattgctcatgactatttcagaaacttctccattccagttttctgtgtgacagtccttttgttgttgcacagcagcccaggagccaggggatgagaagcagaggggtagtaaggatgcaggtagtaaggatgttttgctgtctccaaccgcatcagggaaagccaagctgctttcagccatgactcccggctgactcagtcaatatctctccggtgtccccttagcatctctttaactgatttacccagacttcccctgggctggtttttaagaggttgctcaatggagaagatggagctttcaagtggaaatagaaaactggagaatctgaaggcctaggtggagacaggagaacccgaggagtggttgtaaagggactctttggagacaatggagagcatggggaaggtctccaatgggatgaggtgtctgaggagggaaggattgccagctagcaagtgctgccagggtcaagaagtctcagtggtgaccacagcagatgagcattgtctgttgttacttcttcacaccaaatccacagatgcagagcaactgtgccgctcttccttctgcacagtccggaaggccgtctagaacactgggaatgccccagcagaataagtttggcacccttccaagctagggttctctaaatatttctgcaacatttatttagttgataaaaactgagtacctcttaatgttcaaaatcagatttattacatattattcttttttcttttctacggtaaattgtcaacttgaaaacatgctattttttgactttagcaattaattgaaccatttttaaaaaattgagtaataactgacttattcccagcaaataatgctctcccaatgcattgttccatgtggaaatttcagccgactgtcgctgctgaccttacacagctgtgaggtgaccagactcagggtggaggtgggacagcacttggaccagaggctggaaaaattctcagtgtagttcagcaggttgtaaagagggatgtagatgttcactttgtgagaagcagaaccaatttgtatttcaacagcaacaaaggaatcatatatagaaacctgagtgaaataaggccataattctagggatattatagcaccgctcattgccaaccacctccagccactgcctggctggcctcgggacacaagtgaacaattccagcaattttgactcgtgggttacctagtgttacccacacccatgatgacttctctctagccccaggtgggcccagcccacatcaattcgtcttgattaaagtcccatctctcatcttgtaactgagcagaaaagccttcctacaactcccatttgctttgcttcattttctattttcttctaagaaaaaaaaaatggcaggaaatattgggctgctatattttgacttcagcattcctattttccctcctcttgatccttttttgtccctaattattcccatctccggtcactctcagatgtggaagtctgtagtgggccatgatgtgtctgtttccgtggagacccagggtgatgattgggacacagatcctgactttgtggtgagtttggaagtagctttgcttggacagtgcagagggtggggtgaggagggcatctgggccactctgtgatctttgaggatgcttggaaaagggccttctaggactgagacagccctcatactgggactaattggtaggacaattggctgtcacctgtggggcatgcacgatacctggtatcagggatgaaaagagacaggtgtgggtgagtttgacagtgtgattgacaggccatggcaggctatactgaaggtgagaagcaggtgaacctgggtctcccctggcccatgatccaggattcaagctgggcatgtgtaattgggggattaaaaagctgtaggagaccagatggggtaggcatgaagtaggcagaggaggaacggaggtttcagagctcactagtttaattctttgtgttttcttgtttgttttttgagacagagtctcactctgtcacccaggctggagtacggtggtgcaatctcagctcactgcaacctctgcctcccaggttcaagcgattctcctacctcagcctcccaagtagtccctgcagttgggactacaggtgcatgccaccacacctggctaatttttgtatttttttggtagagatggggtttcaccatgttggccaagctagtcttgagctcctgacctaaagagatccacccgcctcggcctcctaaaatgctaggattacaggcataagccaccacgcctggcctcaccagtttaattcttacatggggtcaggatgggataaatatagaggggatgtgaataaagacccagactgaagaaggcagtggacacaggggacatggagggcatgtgtcagttgggtggcccttctcaatgtggcacatttcttgccgtcatgtattactgcgtgctgtcgtttgcagaatgacatctctgaaaaggagcaacgatggggagccaagaccatcgaggggtctggacgcacagaacacatcaagtaggtgccgaaaggactggagaaaaggaagggggttatgggaagagcccaaagaaaactcggagacttgggggaaggtgagggaggaaaaggatagggtagttcatgtctatgtattattgtgtttgttttttttctagagtctgttcctgtgtgtacctgtgtgtcattgcatatttccattttatgtctctcctcttaccctcctcaaccctattatctatcttttatacctaacaactctgctatttccccaagtgggtctattggattaactgcctcccttcctttagtaaggcatgagagattcatagaggaagtggcccaaatactaaggtcctctctatctatctacctggcaatcatctatctcctatctatctcttcagataaatgtaaatatgtatttagaattcagggtgacttccttcagatgaactaagaacaattcagtaaaatgtcaaggtgaagaactcagaataaatgctataaaaagaggccacttcagctcccataactggcccaaataacttttaaaatacagatttgtacttagctatttgacagaagttggaagccatgaatggtaatatgaagaaatgtaacacttggaaaacctgttgataaaaactattttggcaacgatgttcagggatctttaagattatagccccatatgcattttaccagaaacaaacaaacaaacaaacaaaaccctccgataccagaagataaaaggaacttacagacatatccaggggtttctgtgggatatgtcatacattcaggctgagagatccccttctctcttccacggatgattcaggatcatctaaccaggaccatctgctttggatagtatcagaatgtcaaacattagtagcaaggtagacacaataaatagtgtaacaagcaaaaattcaacaactacacacaaaatggcaagattaatacagttttaagctccatttttaactccccctaccgcaccctaaaagcagtgtttttacctctagattttaaaaagtgtcagtggatgaccacattgcacaagcaacatactgtgaaagcctggcacaagtttctacaactggatgacaataccacattgtttaatcagaaataaatggtttcggccgggcgtggtggctcacgcttgtaatcccaaaactttggaaggccgagcgaggaagatcacttgaggtcaggagttcaagaccagcatgggcaacatgatgaaaccctgtgtctactaaaaatacaaaaattagatgggcgtggtggcgggcacctgtaatcccagctactcaggaggccgaagcacgagagtctcttgaacccaggaggcacaggttgcagtgagctgagatcgcaccactgcactccagccagggtgatagagcgagactcagtctcaataaataaataaataaataaataaataaataaataaataaatggtttcaattaagtagctataatgaatattattcttaaaccatgccattctggaaaaagattgaaacaatggaacagggtcattcaggaagcttctgtgatacccctctatagactcatagatcaaaaaaaaaaaaaaaaaaaaaaccacaagacccttttccttttctgaataaaggccactcaacgctggtattctgggaattgtccagatgaggatgcacacttcatgcctttggtggtattgtagccaatgaggtttatccgaggtgtgattattgctaattgaaaacttcccaacactccgccatgacgacttgcaatatagtaggcattggcaaaaaaaaaaaaaaaaaaaaaaaagagcaagcaaccctcataaaaaaatgaaataacttaaaaaaaaatagccaccctgaagatgtatagttacaggtcaatgggatagccaatgtctaatgcagtacttagcacttctgagcagctcagtgatgttagttttgtttcctgttaatataggttagtttaatcagatttcctttctaaaatctaacaaacatgtaaacagacaacagcccttttttctcctaagtggtgtctacctggactgttggattgcacaactcctatacacagatcactctgacgggtgctgcctggagtggtacaacatggtgaccctgcacatttccttgttaacctaactgaatctatcagatagaataaacgatggagatattgacaaaaaaatctcgctcatctcccatttacccaggttatcaaggagtgaaagcctggtatctgctggtaacaggccaggtggctttagacaagtcccttttcctctctgattctcattttgcccatctggatcaaaaagacctctagaggactttccagtagtaagtctccactatttggggattccctctcgttagtgtgggctaagtcagtctttaacatctgatgggaatcaccatggtccttggaaaggagagggaaattggagaggagaacagtagctgtagatgctaacactgacagatcccaaaatgaaaaaacaaaaaacaaacaaacaaaacaaaacagtagctgtagagctgagacgactaaaagcaggaaaaggaagtggttgcagttcttactaatcttactaccttccccacaccgtgatgtctctttttaggtctgtcttgaataaatttagtttggatagtaatttggtaattcagtgaataattcaaatggtcctatgcatcccttatccattctgtaaaggaactgcctggttttcaagaactatcacccttctctccaccttcttttctccactcttgcccattcattctcaagactcaagggtgtcttttcccttgacctgtttgtttattttcaaatctgtcacagactgatacttttgtaaaataaaatacaattaagtttctggaaaaataaatggttaaaaataacatagacaatacaaacacagtttttatttttaaattcaacagatataaaatcacgatgttgtcaggcatgctagtctgtgcctatagacccagctactcaggaggctgaggcaggaggatcacttgagtccagtagttctgggctatagtgctctatgctgattgggtctccacgctgaattctgaatcaatatagtgacctcccacctcccaggagcaggggaccataggttgcctaagaaggggtgaacttgcccaggtcagaaatggagcaggtcaaaactccagtgctgatcagtagtgggattgtgtctgtgagtagccactgcactccagcctgggcaacagtgagaccccatttctaaaaaagaaaaagaaaaagaataaaatcactatgtcaaattgctataaaagtttctaaacacatattctcaatttttattcttatttccctgtgaaacagaaacagttcagcttgtggaccacacactgagtggcactgctctggaataatctttcagcacttcctggaaccagtctggcctttagattaaatctttactgagctataaccataggatgtctgcctcagtggccctgtcctcttctcgtgccctgacattttatagcaagtggaaataaagaatggtgtaatgccaagagtatagaaatagaattctggagctctagggactgattccagctctgctgtaaaaaggcttatgatgctgaggagagtaataatattttaccatcctatcttgatttccagcgctgactggagattatagtaccatccctgtttacctcacaggggtactgggaagagccatggctataacttaagaataatgactaacatttattaagctattatatgtcttgcaaaacacagagtactttttaaaaacaatcctatatcatagatgacgttggcatcctgatttcacagaaaagtgaatggatatattaatgtttagcaatttgtccgaggatacagagatacaggttgagcatccctaatccaaaaattcaaaatctaaaatgttccaaaatctgaaatttttgaaagcccacatgataccacaagtagaaaattccacacctgactacatgtgatgggtctcagtcaaaatacaggtgcacaacagttttttcagcgtccccaagggaaaaataaagttaccttcatttatttagttcttctttaataccttccttaatatagtgtatatgacacataaatgaatttcctgtttacacatgggtctcgtccccaagatatctcattatgtatatgcaaatattccaaaacctgaaaaaatcctgaatccaaaacacttctggtcccaagcgtttgggatgagggatagtcaacctgtagtaatttgaattcggctcagtctgactccatgggctgaaatcttaaccaatatattgtttttgtctaataaacataatatcgtcatgtccgtaattcttttgttgaaatgaaatgcaaattcccatgaactaagctattgccaattccctaaggctgcttgctattctgtttacagtgacaaagtacttgataagttggccttaataatactacaatcacttcataaacaaacctctttatgagtgcccaaagtctctttcatttaaggttttcttcactttattatttttcaaaaattaactttgttttttttgagacggagtttcgctctgtcatccaggctggagtgcagtggtacgatctcggctcactgaaacctccgcctctgcctcccagcttcaagtgattctcctacctcagcttcccgagtagctgggattacaggcatgtgccaccttgcccagctaatttgtgtatttttagtagagacggggtttaaccatgttggccagactggtcttgaactcctgacctcaagtgatccgcctgcctcggcctcctacagtgctgggattacaggtgtaagccaccattgcccaggcaaaaattaaatttattgatacctaatcattataagcaaatagttcaatgagttttgactatatatatataatataaccaccaatgcaatcaagatatagaatatatctattaccatgaaaatttccctgcacctctttgcagtcaatacaccccatactgatctttttgtcactatagattagttttgtctggcatagaatttcatgcaaacagaataatatagaatgtattgttttgtgttgtcttctttcagcataatgttttccagatttatccatggtgttgtgtatataagtcttttgttcttttatattgtcatgtagtgtcccattgtatggatatgtcacagttttattattcattatcctgtcaatagccatttggattattgacaatttggatctattacaaatgaaactgtcatgggcatttgggtacaaatctttttgttgacatatccttatttctcttggaaaattgccaggagtagaattgctgagtcatataataagtgtatgttaaacattttgagagactctcaaactcttttccaaagggaatttaccctctttcattcctaccagtaatgtgtgggtttcagatgctccacatttttgtcaacatttgttattgttagtatttttaaatttagctgggtgcagtggctcatgcctgtaatcccagcactttaggaggccaaggcaggaggatgacttgagcccaggagttcaagaccatctggacaatgtggagagattcagagtctacaaaaaaattaaaaattggctggctgtggtctgagctattcaggaggctgaggcaggagaagcacttgagcccagggggttgaggctgcagtgagccatgtttgccccactgcactccagcctgggtgacagactgagatcctctctaaaagacaaacaaaacaaaacaacaacaacaacaacaaaaccaacttaaccactcttttaagttaatttgaatttctctgatgaccagttttattgagtatattttcatttgccattcatatatcttcatatatcttctttatgaagtatctgttcacatctttttctcacttttaaagtgagttgtttgtctttttattaagttgctgaaagttctttatatattctggatgtaagtcttttgtgaaatatgtgttttacaagtgtattctcccagaacataacttgctttttcactttattgattgattgattgattatttattgattgattgctctgttgcccaggctggagtgcagtgacatgatctcagctcactgcaacctctgcctcctgggttcaagcgattctgctgcttcagcctcctgagtagctgggactcaggcgcccaccaccaagcccagctaatttttgtatttttggtagagacggggtttcaccatagtggctaggctggtcttgagctcctgaccttgtgatccacccgccttgacctcccaaagtgctgagattacaggcgtgagccaccacacctggccactttttcattttattaatggcatctttttaagagcaaaagatcttaatcctgatgatgtctaatttattgaaaaaaaatttatggggctaatgctttatgtgtctaagaaatatttacctaccccaaagttgtgaagactttctttgatgttttgtcctaaaggactgacagttttagcttttacatttaagtctatgacccatttcaagtagacttttctgtgcagtgtgaggtcaagattgaggttcatttttctccatgtgattatttagttgttcaacaatattaaaagagtattctgttcccattgacttacctggcatctttgaccacatacatgtgggtctatttctggactctattctgttctgttgatctattttctaccctgacagcataccatactgcactgattattgtagctttataagtcaagaaattatgtagtcctcaactttgctctccttaaaaaaaaaaaaagaaacaaaagattttactattccaggactttacattttcacataaattttataattcactagtcaattcctacaagaatgcctgttcagattttgattgggattgcattgaatctatagatcattttagggagaactgacatcttaatgatattgagttttccaatccatgaacatgggatatctctccatttatttagatcttctttaatattttcagaaatattttttagtgtttaggtcttgcacatactttgttaagtttatcctaaaatgtttcatgttatttcatgtatttatatttaacttccagtttccaaatgtttatggccagtatgtaaaaatacaattgattttgatataatgaccttgtatcctgtgacctagccaaatgcacaatgctttagtagctttttttgtgtgaattctttaggattttctacatacatgatcaggtcatctgtgaataaaaaccttatattctgagtcactcacatttgtgcttttagttttgtaataaaaaacaaacacagattgaggaatgagtcatctttgaggtgctacattttgcttggttcacataaactgcattgctttatcaatacaaagtcttttaaaacttaaattggatatctgagagttaatatgtcaaaagtttcttaggcacaacacagcatattgaattggaattttttgttttcctctctatctcttctagctgtcctctatctccatacataaaacatttttgtgtcctcagagcctaacagtacctcacacttaaaagttgtttagttaatagttataaaatgaaggaatgatgtgattaagacctgtttaggccaggcgtggtggctcacgcctgtaatcccagcactttgggaggccaaggcaagaggatcacttgaggtcaggagtttgagaccagcctggccaacatggtgaaaccctgtctctactaaaaatacaaaatctagcggggcatgacatgcatgcctgtaatcccagctactctggaggctgaggcaagagaatcacttgaacccgggaggcggagattacagtgagctgagatcataccactgcactccagcctgggcgacagagcaagattctgtctcaataataataataataataaagacctgtttagaatgacttccactataacctaaagaagtctgttttctttgggcctcaacaatttcattcaaattatatcattggtatgatcccctgactagtttttctgttatcctttagatgaatatttctgagtatcattttctaatcccttttaaaaacttgttttaactataatatagttataacccatttaacaattattatattcattaaaaaattgcagattttttccatttgaaagtaaattttggccccattttcttgatctttcatctgaatacttcagttggaagatattgggcaggcatttacatgtccttggtactagtagcttatgacacagtgttggtgttgaactgacaacacaagatctctgctttcaacgctgccagagagtttagaggaggcatgggaacagggggttcttccagcacttggcttaatttcatctggttcatagccagctttctaaaattaactgcggctaaagctgagaaggctttttaaaaagacctttggtagaattatccactaaaggccaccagatggatctattcttccttaaaagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaggtaagttgaaagggaaagatttgctttaaaaaaatacaagccgggtgcggtggctcacgcctgtaatcccagcactttggaaggccaaggtgggtggatcatgaggttaggagatcgagaccatcctggctaacacggtgaaaccccatctctactaaaaatacaaaaaattagccgtgtgtcgtggtgggtgcctgtagtcccagctactcaggaggctgaggcaggagaatggcgtgaacctgggaggcagagcttgcagtgagccgagatcatgccactgcactccagcctgggagacagagcgagactctgtctcaaaaaaaaaaaaaataaataaaataaataagtaatacattaaaaaattgatatatatacttatatattttgtaaatatgtataattatatacttatatataattatatacctctataataagagccaactatatataagtatatataattgactctataataaataattggctctataataattggctataaaataattggctctataagagccaattatatgtaagtatataattatataagtatatatttattatatatacttatatattttatatatgttataaatataatataatgattatattttatatattatatataagtgtatatatattataagtatatataatataatatatacttataatatataatatataataagtatatatattaatatatattatatatattaatatatgtaataaatatatattaatatatataatatatacttatatacttatatataacagatactatatataagtatatataatatataatatatctatattatatattatatatcatatataatatataatctacattattaatacattatattacatattattactatgtaatatattacatagtaatatattacatagtaataatatgtaatataatgtaatatattatatactataattaatatataatatatattatattatataagtatataaaatataatacataaaatataatatatattatatatttttatttataaatatatataaaatatatataaatatataaaatatataaaaatataaataatatatttaatattatattattatatattaattataagatatattatatattatatatacttatatatagtatctgttatatataagtatatattatatataagtatataattaatatattatatattaatacaagtatataattaatatattatatattaatacattatatattatatacttatataattatttataaatatatttataaatatatattattaatatatgttacataattataagtaaatgtaaatatataaatttatattatatatattttaatatattataattatatgatataacatatttatattataaatatatagtttattcataaatatatagtatataatatttaagtatatttaaaaattttgctaaaacacccagatacttttgttctagatcaaaatatatattttttaactcattcattggttcatgagttaaaactcattcaaaagtacagtagtcatttggtctaaaatataatgtccacatattatttgtatcaaatttttctgatctcaacacataagatatacatggcagaaaataagagccaagatattagaactgctggcctgttgtagccccaaccacattgtaactcctagaccaagaagacagggagcacaagtggagaaggaaaaaatatgttttaaaattatttgctgcatttaaatgtttatgtattatgtctatgttgcaacttctctttattattttatttactgtgtatttagtgattttttttgtatacatgtcctacattacatggtgtataaagctcagagttcacttctgaactttgatggccatacaggagcaaagatctagaacaaaatcattggctctcctagtgaaatattccatcccggctatggcgtccggtcagtccccttggtctctcctccacactaccccacactacactctgttctgctgcacaatgctcttgtttcagctctttttgtttctggtttaaacactgctctgtctaccttgtctctatcccctggttcccagcccatcctatgggagtgttcagaatgaaggattcctaatggtattagagaagaacagggatgagcaggtctccagaaaaagtcatcttgctctcccatcgcgtattccttggcaccactgtcagaggctatagatctgacccagaatggaatttcttacatgcctacatcccactccatatctgtatttatttttttaaggtcatttttatcttttcactcactccatccttgatttttctcagagtgcagtgggccatgagtatgttgccgaggtggagaagcactcttctcagacggatgctgccaaaggctttgggggcaagtacggagttgagagggacagggcagacaaggtaagtgaccactctctctcccaaccacccacctccagtcctgtgaaaattgcccacgatcacccctggatggaggcacatgcttctttgttgaaagacaggacagtggatgctgtgaggacctgacaccgtcacagggatacctccctcagcaagttccttggtgccaatgttggaagccacatgctgagctgaaagacagtgattcaaataggagaagactctcaaactgtgtgtttgaatgaataattcctcaagccactggtttttattatactcatatgcatgaagatagaacagagaatcatctaagctcttcttttggcttaacatcaaaaccttataaatactcatgccgtttaggaaaacagattcatcagtttaaatattattgccatagcagcagataatcaagttaaacaactaattagggttactatttacagaatttagcatcaatctatgaagtccagatatctttaaagactcctttgtacaaaacaaaacaaaatgttgttttaaagagaaaaaaaagtaccgtatgattacagcatcatatcgttgacaggagagtaagattgataactcatcgatgtttttagttccacgccttattaggtcggattctttgaactcattttttatggtgcagaatggtgtctcctgccctgcagctgcacacagagagaggacagctccttcacagttagctgagattttttctttgtttttaccaacagttgttaattaggtggacatgcatccttaaagctaaggattggaagctaaggcagctaagttctagaaaattaattgtttgcatcatggggggtaaaaccatgaaaaacaaaatcaggaaagtttaaaacatactgcaaagctaagggaagatgtagaaggcaatagtgaaatatggagcatgcagtgttctagaatcaggatggaattccctgttccatcttggcaccactcttgcctgcctttgcttaatcaccgattcttacatcttttgctcacaagccacaaatggaatcacccagtcagtgtgtcatgtaaatcaagaaacaatacatgttaattagttcttaatatgcaaaaacccagacttgcttagatacccatagttcctgagccagatggagaacaaagctccaaaactctgcggtaatgttgggtatctgggcaacatatccagtcccagagccagctaggatccagactctcctggttgcagttatcccaccaaaatccacatatttgtgtttccattattgagtaatgaaagagaagaggcacagcattatcaactgggaatagggtaatgtctcttcatgagcagagtgctttatactttacaaggcacttttctaggtatcacatttcacttttgtgaggattcgttaggaagaaaagcgctaagttagtgaatgaaactaagtagacactttaccttgtcccatttagttctcatgacatcccagatgaagagggatcatttctctcattttacagtcgaggtagataaggcaggcatgcctctcctgattttatattgaaagagactggggcttagtaatataaaggaacgtgcttaaacttcaacaactataaataggggatgtagggtttgaacctaaaactgtctgtgtccagggcctatgttcattgctctgtagtatcctgtgtccataccagcctgtttctacattaaacacctatactcagcctgaagcccctacaaactacctctggggctggctgggagtaaggggaggttaggaagaggaaaacctgtcagctctgactctaaccaattctgtctcctcttctctgtagtcagcagtcggctttgattataaaggagaagtggagaagcacacatctcagaaaggcaaggacactgtacttcactcagcctcagcaatctgaccggcaggctcttctgctaagactttatcttccagcagttgtcatcagctttttaacttccatgacccagcgcaccactattttatttactttttgttcatttgtttgtttttgagacagggtcttgcactgtcacccaggcgggagtgcagtgacacaatcatgggtcactgcagcttcgacttcctgggctcaagcgatcctcccacctcagcgttctgagtagctgtgactacaagtgtgcaccaccatgcctggctaattttttattctttgtagagatggagtctcactatgttgcccaggcagtgtcaaaccttttggctcaagtgattctcccctctcaccctctcaaagtgctgggattacaggcatgagccaccacacccaccgctattttacatacttttttatttttttgagagggagtctcgctctgtcacccaggctagagtgcagtggcactatattggctcaccgcaagctctgtgtcctgggttcacgccattttcctgcctcagcctcccaagtagctgggactacaggcgactgccagcacgcctggctaattttttttttttttttgtatttttagtagagacggggtttcactgtgttagccaggatggtgtcgatctcctgacctcgtgatccacccgactcggcctcccaaagtgctgggattataggtgtgagccaccgtgcccggccctattttatatgctttttaaacccagtgtgcacttgcttctctttttctccgtgatcgctttctataatattgatcaagttttttttttttttttttttgcgacggagtctggctctgtcgcccaggctggagtgcagtggctggatctcggctcactgcaagttccgccttccgggttcacgccattctcctgcctcagcctcccgagtagctgggactacaggcacccgccactacgccgggctaatttttgtatttttagtggagacggggtttcaccatgttagccaggatggtctcgattttctgacctcgtgatctgcctgcctcggcttcccaaagtgctgggattacaggcttgagtcaccgcgcctggccatattgatcaagtttttgaatccctcttttttctctaatgggttgaaaataaggtattctattcctttattttagaaggttattcctaaattttaacatgcatctttgacttaaatttaaaattaatcacaatctcttcctgagtgtattggaaacatagaatattttaactacattctttttaaccaaccatattgttgttgttcagtatattggttccatcttattccatcttattattgattccatcttataaaccccacaaaaatgaatcattattattacttagtaaatgcttatttaaattgaccaaggtatttacctatttcctagctcaacattgcttattgtatttcattgtttcacctttgtgtcttctatttccttcttgctaaaatattccattgataattctttcaatgagtctatgaaagaactttcagtctttgaaaaatgtctttatgttgcatcattcttcatttttattttcccttcatcactttgaagatcttatttcatcgtctctgacatctctcttgtgtcagactatcattcctgagtaggtaacatgtcttatatctccgggttttttttaattaaagattttcttttggtctctgatattcttcactattattagggtgtgtctgaatgttagatctacttttattatcctatatgggacttactgccctttttcaacctcagatgtgactttcattataggaagttctcaggcattttctcttggaataatacctcttctctcttctctttatgtccttgtgccgcattctgggttattcctttagctctaggttaagttcactaattcttcctttagctgtattcagtgattctcaaagatgtccatggcattgtgaagtatctgtgaaatagccacgcttcaagtcattgccatagtgttcgataccatgccgtgccttgccatgccttgcaatccggtccgttcatctgcccctgccctcccctcccctcccctccccttcccttgccttccctctctttttttagataaagtcttattatgttgcccaggctggcctcaaactcctgggctgaagtgatccttctgccttggcctcccaaagtgctgggattacaggcatgagccaccactcttggcttgtagggggattctactgggcaacatcacggtcttcactttcatgatagtctgttaactctatcaaggctatgtatttgtaggataataggccaaataggaaataaatggagtttgaaagggtaggctttccattttgaaatgtgacccatacccagaatctgaaaattctaattttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacaacgagcatgctgccttcaagcatctgtttaacaaannnnnnnnnnnnnnnnnnnncctcccctccccttcccttgccttccctctctttttttagataaagtcttattatgttgcccaggctggcctcaaactcctgggctgaagtgatccttctgccttggcctcccaaagtgctgggattacaggcatgagccaccacatcagatattttcatttctggagtttcttttggttctattgcatatctgctgattcattttccataagacattatggtttcattatggttccctgtgccacttctttaagctgtttaattattttaaacatgtactttgcagtttctttcatattttatattatttgcagttcttggctgtgccatttcttctgactaatctgcgttcctcatggttatttatttccttgatggtttgtaatcttgtttataaacttattttagtgaaggagagggatatttgttttatgagaatttcatgtgccctgggtttagtaagtacctcatccagggaaatattgcctctacttctggctcaactctagaggtcttaatagtaacggacattttttttcctttattattattttttcccatggagttcaagtctttctggtttttaagttggttatggtatgttgtgcttttcaaggaatttgttcattttgtctgtgttgtcaggtttattggcataaattcatttataatattctcttctttttaacttctgtaagatttctagtgatatgaaatgcctattttcatttctgatcttacttacttgtgttttttctctttttaattattcttactagaagtttatcaattttattactctttccaaagaacaagcttttggctttgctaattttctctattatttacttgttttaaaaaatgtattggtttctgctcttatctttattatgtttttcttctacttagtattaatttagtttgttcttttcctagcctcttaaggtagaaacttagataattgattttaagccttcctttactatatgggcacttgaaaagctatacatttccctctgaacactaccttcatttgctacaaacatttgctacattcaacaaatatttgaatgtgtgtgttttaattttcattcatcacaaacccgtggtcccagctattcaggggactaatgtgggaggatcacttgagcccaggaggttgaggctgcagcaagccatgattgtgccactacattttggcctgggcaacagagtgagaccctgtctcaaaaaacaacaacaacaacaacaacaacaacaacaaaaaataaaatcattcagttaaaaatattttcttatttcccttgtaatttcttctttgacacatgtattatttaaaagctgttattgattttctgagcatcagggaaattttctagataattttattggtattgacttctactttaattctattgtgatcagaatatgatctctgatatttcagtcttttgaaatgtactgagacttactgtcttagagacttatggactggcacatggtctatttggtcaatgttctatatgcatgaaaaaagtatattctgtagtttggggtatagtgttgtataagagtcaattaggtttattagttgataatgtttggatcttctataattttactgattcgtttttgcctaaaatacctattaattaatgaaagaatggtgttaaatgttcaactactattacagatttgtctatttctctttctacttctgtcagcttttgcattatttgtgtgtgtgtgtgtgtgtgtgtgtgtgtgtgcgtgtgtgtgtgtgttggagtcttgcgatgtttctcaggctggtctcgaactcccgggctcaagtcaccctcctgcctcagccttctgagtagctgggactacaggcattcaccacacctggttttttacatttttcttttatttgagagcttcatgaattttggttctgtgaataggtttatgccagcatacatactcctgatgtaaggtattgttcttttatcattggagcatgtctttcttgtctcttagaatgcactttgtcttgagatcactttatctcatattcatgccatctttcttatgcttactctttccaaaatgtatattttcctggatcagtatttagttaatttctcagcttagaattcctgcatcacataagtggaaaaaaaatgtgtatttgcattctacactcagatgtaggcttggagtttccaagtctcataagcaaattttccccctatcaaatattgaacaggttacaagcccccttcatgattttcctgagtaaatgagtagaatttttctagcactctcttataggagtggacagagcttcgtttctggctttcttccctcctcccccattcttaaatggaaattagaatcacagagcctcgatcctaatccctattcattacatttggaatttaaaatctgaccaggtgtggtagttcacacctgtaattgcagcattttgggaggctgaggtgggtgggtcctttgagcccaggagtttaaggctagcctgggcaacacagtgagatcctatcactacagatttttttttaaattagcaagtcatggtggcacctgcctgtggtcccagttactcaggaggattgcttgaccccaggagttcaaggttacagtgagccatgattgtactctgcactatagcttgagcaaaagagcaagactctacctctaaaaacaaaaaatcccccaaaaatgcccttgggttttctgtggtgtcagttcataattatcttcacacatacagctttgattcatctctttgtctctggtttctggagccaggattttttcccttcctttctgctgagcttcactttttttttttttgagatggagtctcgctctgtcacccaggctggagtgcaatggtgcaatcttggctcactgcaacctccaccccccatgttcaagtgactctcctgtctcagcctccccagtagctggggctacagacgcacatcaccatgcctggataatttttgtattttttagtagagacagggtttccccattttggccaggctggtctcaaattcctgacctcaggtgatccacctgcctcggcccctgaagtgctgggattacaggcatgagcaccgtgctcggcctgagcttcactctttaaaacacaattgttatgttttatctgacatttctatgtgcttatatgggagtaggggaaaggcatacatttcatgtatctgcctttttttttctgcaatctcctcactctctatactttccccttcttgaagaagaagggagaaaatgggaatgttcttctcatcttggcatggaaatgagagaagagagggaaaaagtaagcaatattcaattaaaagactacttaagacatggcttctctttaattcccctgtattcaagccctgctcttttcccaggcccctaacactctgtacccattcctgctgacctctcttctccagcgcttccctgtgtgctggagcctaagggtgggctctcatgactgctccttcgaccacagattactctcgtggctttgacggccggtacggggtggagaaggataaatgggacaaagcagctctgggatatgactacaagggagagacggagaaacacgagtcccagagaggtgagttggggttggaagggggaaggtcacagatagcacagggatctccttccttcctttctggaagctcacccgggtgccccagaatacagaggggcagatgtgcagagcagggggtgccagggcagtaagcacatgtgtggggacaggtggtggtagtgaggggagagaggagagatggagaggaaaacagaaggattaagagcagggcctaggagggaggtgagagagaagggggcgttgaggaaggaatgaggacagacaagctgggtgatggtcagaagatggtttgccatgagtcttagagggatctctgctgtcctcacagaggataaagaggtttactgcttccctggaacccatacggatggctgaagtgctctctgtattttttcctatttcttttacatttttccttatctgttgctttctgctttccatgtttccctacttccatctttgtcttctccattcgctcccagattttttccccatctgtttccctctcttcccatccatgcctccctctatcctctgattctcacatttcctcctacatttgttttccacattcctgtttttcttcccactgattcttctcaccacccattcccagcattttgatctcctataactcagaactttctgtcctgcagattatgccaagggctttggtggccagtatggaatccagaaggaccgagtggataaggtaaagcaccggaacaccaatgtcttaagaagagttccctaagtttaggaaagtgtgcagagaagagcgtgaagaaggctgggagagggaggggacggtggtgctgggcacacagagcctgtcctgctggcgtcctgcagtccccactgactgccctcagcatctaaggggcatgtcttccaaagcctgagctttgaggacagtgggagaggcatacagagagacaggtaaaccgccgggaaaggtcgtattggactggaaattgtattgatttcttggcattgcttaacccaatcttaagtctcttcccaccccatgccactgtcctccctacactagttcctcctcatgcatgggccagggggccctgctacattctaggcaactgggcttggagatgtgagattctaaggtcactgagctgctgaaagggggagctgaactcagcacttaagaacttctttaccccctctctaccacaaaacaacattggaacatgctgtccagctgttgagcatccaatggttagggatacctcttatagtggcccccaacccccaatactacctccaggtcaccactacccttgcccctctcccgcaacacacatgctgttctcctgcctgcagagcgctgtcggcttcaatgaaatggaggccccgaccacagcttataagaagacgacgcccatagaagccggtgaggcttagtgattcactctccatgcacctcacttccttctccctcattctttttcttccccagactatatcctccatgcctttaactacctagattagctgagttagacctgatccctatcctcatattcccagattctgtctttcctagaaaaaccaggtaaggcggagctcacatctgtaatcccagcactttggaggctaaagtgggaggactgcttgagctcaggaatttaagaacagcttggacaacatggggaaacctcatctctataaaaaatacaaaaattagccaggcatggaggtgcacacctataatcccagctacttgggaggctgaggcaggagaatcacttgaacccaggaggcggaagtcggagtgagctgagatcatgccactcaactccagcctgggtgacagagtgagacgaaagaaagagagagagaggagagagaggagagagagagagagagagagagagagagagagagagaaaagggagagaagagagagagagagagaaagaaagaaaagaaagaaagagagaaagtcaagtggatagacagagtgacgtcggggaaggaatcggaggcagagaacacagtgtggcttgggacaggggtggggtggcatgggaacattggtgaggaaccacttgggaagaacacacagggacaggagtttcggatgaggttgaggatgagtggtggcttgaagaaggcatacagatttatggaatatggacaggggaggatgctttttggaagcccaaagtttacaatttagaaaggacacaagtcagctgggcatggtggctcacacctgtaatcccagcactttgggatgctgaagtaggataatcacttgaacccaggagttcaagatgaggctgggcaacacagcaagatcccctctctacaaaaaatacaaaaattagctgggtgtggtggtgcacatctgtggtcccaactactccagaggctgaggtaggaggattgcttgagcctgggaggttgaggctgcagtgtcccatgactgcaccactgcactctagcctgggctgagaccctgtctcaagaaaaaaaaaagacacgagtcttaggtcgtatagcctggctttataaaaatccaggcttcagggctatgccatcctcctattatcccttgttcctctatcgatacctctttaccatcctgtcccacaaatccctcctcccggatatttaactgattccccttcttccttcaagtgccatgcccttccccactctccaatccaagacaaccctaatttttcttgcctgtgtctgcagcttctagtggtacccgtgggctgaaggcgaaatttgagtccatggctgaggagaagaggaagcgagaggaagaggagaaggcacagcaggtggccaggaggcaacaggagcgaaaggctgtgacaaagaggagccctgaggctccacagccagtgatagctatggaagagccagcagtaccggccccactgcccaagaaaatctcctcagaggtgagcgcctggccctctgggatccacatccaggatctcttgcccagacaggagcctaaggggtccaaaccattggcagaaaataaggcaaagtcctcccctgggttaggcaaggtctgttgtctctgtctttagaagacttcagtctgactgtaattggacctcctatcagaatgttagaaaaaaccctcaagatttacatagtacaacagaaagcaagtcaccagccagcacagccaattattgctgtaggaactatgaggaaggggccgtcacttcaggctggagcccatcttgagggatgagttccatttgaattggcagagagtgggagagggtgttcctggtaaatgtaacagtgaagacatgcatggtgtggtggctcatgcctgtaatcctagcacttgaggtggccaaggtgagaggatcacttgaagccaggagttctagaccaacctgggcaacatagtaagaacctatcgctataaaaacaattaaaaaattagctgggcatggtggtgtgtgcctatagtcccagctacttgggaggcttagagaggaggattgtttgagcccaagagtttgaggctacagtgagctatgatctcactgtgctccagccagggcagcagagtgagaccctgtctcaaaaaatgcataaaataaaataaaaagaatgaagatgggccgagcgtggtggctcatgcctgtaatcccagcactttgggaggtcaaggcagacagatcacgaggtcaggaagtcaggagttcaagaccagcctgaccaacatagtgaaaccctgtctctattaaaaatacaaaaattagccaggcatagtggcgtgtgcctgtaatcccagctactcagggggctgaggcaggagaatcgcttgaacctgggaggcggaggttgcaatgagctgagatcgcaccactgcactccagcctgggctacagagcgagagtctatctcaaaaaaaaaaaaggagtgaagatggaggcttgcttacttgagagatgcttcattttccacaggcctggcctccagttgggactcctccatcatcagagtctgagcctgtgagaaccagcagggaacacccagtgcccttgctgcccattaggcagactctcccggaggtaagcaaacccccaaagattctctgcccccaccccatcttctcgagtcttaggaatgtgggctgtgcagggtggccaaccatcctggtttgccttgcactgttctggtgttagcactgaagaccttgccttctgggaaactcctctgtcctgggcaaactaggatagatgattatcctagctgtggtagctcaacaatgtgctcttgcttcaatgttttcttggtctcccaaagaatctgacttgttttctacttccctcccctcacaccttttacattctcttcccattgtctctggaatgtgttttgggtgggtgggtgtgggaggagattgaagaatgaagatggatgaaaggctgtgttccccaggagaggctgttagatggaggcaagggtagaggggagaagaggcagggtggtgaagggcgggggatcttatcagtcctccattgattcctcctggaaagtggaagtcacagtgctccacactgtctcttctcaggacaatgaggagcccccagctctgccccctaggactctggaaggcctccaggtggaggaagagccagtgtacgaagcagagcctgagcctgagcccgagcctgagcccgagcctgagaatgactatgaggacgttgaggagatggacaggcatgagcaggaggatgaaccagagggggactatgaggaggtgctcgagcctgaagattcttctttttcttctgctctggctggtgagtgatgggaggagaagcaggagaatttgctcatgtccaggggagggtaagaggaagaagaatttctctattgccccagtaggatctttctctgtttgccttcttcatgttgatgatcccatgtttgtgtttctcattatgcaggatcatcaggctgcccggctggggctggggctggggctgtggctctggggatctcagctgtggctctatatgattaccaaggaggtaggttgggagtggcccgaggagcctggtacatggaggcccctgatataagacagggggacatgtgaaaagagattcatgtctgaccattctaatatcccctcaactttctccccagagggaagtgatgagctttcctttgatccggacgacgtaatcactgacattgagatggtggacgagggctggtggcggggacgttgccatggccactttggactcttccctgcaaattatgtcaagcttctggagtgactagagctcactgtctactgcaactgtgatttcccatgtccaaagtggctctgcctccaccccctccctattcctgctgcaaatgtctaaccagatgaggttctggacaaacttccctctcctgcttcattaagggcttggggcagagacagcatggggaaggaggtccccttccccaagagtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctgttcagtcctaaaattcgaaataaagtgagactatggttcacctgtatgctgaggtaaatagtactttttgtgtggccctcatggcctcaaatcttaaggctccaacctttcctcttccaggcatatccaggaaactttctcttaccactgccaattcccctgtaccctagatgtcaaagactaggccttttccttaggctgaactttttttttttttgagaaggagttttgctctgtcacccaggctggggtgccgcagtgtgatctcagctcactgcagcctccacttcctgggttcaagagattctcctgccttagcctcccgagtacctgcaactacaggcgtgcaccaccatgcccggctaatttttgtatttttagtagagatggggtttccccatgttggccaggctgatcttgaactcctgacctcagatgatcgccccccgcttagcctcccaaagtgctgggatgacaggcataagccactgcacctggcctccttaggctgcattttaaacccagtccaaaacagatcagcctgagcaatggctgggcatggtattgtgggcctatagcaccagctactcagtagtctgaggtgagagaatcacctgagcctgggaagtcaaagtaaaggcttcagtgagctgtgatcacaccactgcactccagcctgggcgacagagtgagaagctgtctcaaaaaaaaaaaaaaaaaagaagaaagaaagaaaagatggagaaggcactgggatcaaggaggagctagaatggttgctaagacccacagttagttgctccagggcttcatagagttggtgagctgcccagcagggtgtccaagggagagaattcagccatgggttcatagtttctgtttctggttgggccagtaaagcccctttgtcattcctctgttctgcttatcactagagacagaaactaaaaaccatggcttcaggctgctaaaagcctaaaacaaaacaaaacagaacaacaacacaataaggcaggttggacaagtttggtctcaggcttgtgctctggtctttcttcatgatacacacttggtttcagcgacaacttctatgcctgtgaatcacacatctgtctctagacctaacttataagattcacccaattagcctttcagagtgcaaagcagcttttatttcctcttctagagatgttgaggtttctagtatacagaggtcagtcaccacagatatactcaatctcattcttcatttcagtttgatttgacatcacacataaatcagacttttatagtgattttcgtgacgtatcttcaagttccaccttgcttttcactttttcctttgttgtgagatagaaacttcttttccagacccttatgctactaaggcagtaaggtcctctctggcccagttctacagacctcagcctccatattcggctgatctctactctggactgcctttcttggtgatgatactcaccaagggctctgcccatagacatcctccctccctgtgtacacagtccgtctttgctcccctcagctgtttctaaatctgaagccacttctagctgtcttgcctctgtcaggtaacactcgctgttcatgctgttcactccagcttcctctcacaaatcatttctgtctaatccatagtctctctgaaaggctttggtaccgctgccctctcactatgaagtgtgcttgtcttattgaagctcgtgcttcagtacggctctgaaggcagcaactggagggggagagtgcggctggaagtgcacaacccacaaagcagttgtgggcagtgccactctcctgaaccaaggcttccccagctcacccagtttgggaagggaaagccttctgccctcttcctttctctatgtagcaccttatttctcctccatctgtcgatagcccctgattttcatctccattggtctatagtttccctttctatttctattaaaatcacaaacccagagtggactttaggagcttttatcctccatgtaggaaggactagattcaaaacacgtcgaactaccacctggacaactctcttccttccttcccactgcagtgttagcttctttccagttactcatcttcacagaataaaaccttaggtcacaccctagtcatatttttagaaaatggtgccttatatacaaatatgaaatacaaaccaaaggatgggattaggaaaaatagagtgacattaccaaatagtaccgagtggcacattacgatgaaaagatgagcatgtttctggtctgggacttgctctactgccttctagactcttttcagaggtttcacctacttcatctacaccagctctgagccatgtttagagagaacccaggaaataaaagcacccagattgactagattgtttcttttgttggctaaattctttatcctctgcttccctacaatgcctgtccttttcttttccgatttcccacttgcttgaggactgctaggactgctgggaaaatgacaccaattacagtgagaggaatataaacacaaggctaataactcaacgctcctggcttcaggtataaccaaagagagctgaaaggatacattcttgggggtggctgaaggacatgaagccataccaaacgaatcatttccttctggttcccaacttaaaatcaccacatgtctaaaacctatttcataaataaagagctgcattaaatcataactattgtggatagctatgtgcgataagattttgctgtactaaaaaataagcatatcctaacttattgtcactagtatgacatcctttagggattttcaacggggagccattttgctccccaatatttagcaatgtctggtgacatttttgattgttgccactgtgggggtgctactgacatttaatggataggccaaggatgctgccaagtatcctgtagtacacagaacagtcccttgcaacaaagaattatccagttcaggcagggcgcagtggctcacacctgtaaacccagcactttggaaggccaaggcgggcgagtcacctgaggtcgggagtttgagaccagcctgaacaacatggagaaagcccgtctctactaaaaatacaaaattagccaggcgagtaatcccagctactcgggaggctgaggcaggagaatcgcttgaacccaggaggcggaggttgcggtgagccgagatcatgtcattgcgctccagcctgggcaacaagagtgaactccatcccctccccacctagaaaaaaaaaaaaagaattatccatttaaaaatgtcaatagttccaaggctaagaagccctgctttaggggatgccagtttctactgtgtctttttttcttttacttttgttcttatgaatattcactgtttgttaccaaaaacagcagtatcatccatttttgtcagactgaaagcatgaccagaaatatggatgggtaggagcaatttcagggagccgttatgttcacatgtcttcctctccaagaccccaatggggtacccaagtgctgtctaggagctggtgactggcgccataggaactgcagtgggccttgtctggactttgccaaaggtgtgatctccctgggctgccctgtgcattctggcatgacgctgaggttggcattagtgtattgaggtcatttcagatagcacagggtggcccagggccatggctatgttctgcctaactcagaacataattttcagaagaaaaaaatcttgacccttaagtcattattaaaatgttacaaagtaagttggtgactttttgtcctaatgttctccataaatatggtgtctcctttggactcccgatttatcaaggctttcctgctgtatgttgccaagattctagcaacagactctgtgatcccatttctgcccctcatgttttggcctgtggtgtcttcaaggctgccatgctcagccaggggctctcctatgtcaggctgtgttaggactaccctggcctagaggcagtagaataaccaaaatgagccctggacttgaccgtcaaaacagacccagctccagagcctccagctttgttcccttcaccctgcgttccctggggagtcccatcctgcatttcctgtcccataaatttgaaagtgctttgtgaactaaaaagcccatgtaaaagcacaggcctgtactggttatggaatttcgtgctctctcatcacttaagaaattgggcccatcttccaaatggcctcaaattacttattttcttctcagaccaatctattttagaaagaaagaaaaaagaaaagaaaagaaaagaaaaaaggaaacaagtcatcaatgtggcactatggtacaagacatggcttaggaaattcttaggcctcgtgttgaggtttcgaaggacattgcgtgttccaatacagcccgataagcaaataggcagtttacagaagggagtcctcaaaaccacacactctgtcctacttcaggaactccgagaagaaatccaagaagggtgcatcgagtggcatctgaatttttaggagacgtatcttcctcgtggtctgattctaaaggtggagactaagctctctcgggcctgctcacggggctgacacatgctagtcaaaagaatcgggtcagttttgtgctctacaatgttgaaaggacaggacttcaggtgctcagacatggaggtgacttcattaaactcccagctcttgattttggagaagaggctgctgaactgccagatctgttgagaaagatagaagttcaaaggtgaatataggggtgttaccctctggctggctttatttgggcactataaggaaatatcctcctgttcttcatattcttagactccagagtgtttagtggctcctgcagacatttggtagcccctcctccagcatccaattcctagttccccctgccaaccaataatcttcccaaccagccctgtagttgtgagaatcactaacaccaatcagcatattgacacacactctcccttgctcctccaccagcaagtgattaattttaaagtagatgcacagttcaaatcagaacaattagtaccagtgcaactcttattccagaacttttgttggagataccaaaaagcagattctctttttctttctctacttgaactgcaaagctgaagtcctaggaggtgccagcaatcaccagagaccaccgagtgagcactatcttacaatgtagccattattgaggaagtagaggtaaaaaatagaaagaagagatgtcatttgggggcattttttgagctgttagatcaagccttacctgaagccattacctttagactttttagttacataggccaataaattccctttattgtttatgccactttaggttgattttctgttgcttgaaattaaagtattgtaactcataagagtctcactagagtgggaaccccataggagaattctatgagttctgaaatatcttctggtctttccacctgggatgtgatggcaaagtcaccgttttcaagtctggttatgtgagtaggcatagcctaatactctttcaacctgactacttcacctacagtttcttgtccttgttgctatgtaggaaaagtggtttttttgagatcttagaactgtttccctttttactttaaaaatccattctaatgtgagtatcctttagccccaactaaattttctttatttctttctgcaaggaaattagctcgtcccaaataatatctgagagtggtcagtcatcattgaattggggaaaaacttgagccaaaaaataatttatagtatctaaattaaattatttacatcggattttaggcgtttttaaacaatacgattcctgaaggcagtgtgttagtcttcattcatgtttcttcctaatacgtgcttggttggcaatcagtgtttatttaacacttgaatgcaggcacatatacaagagagagagtcttgtaattactttttgaggaagactgctcaggaataaataatggaaaacatacaaaatgttttagacatgatcaatacaaatagatgcaaacaactctaactccccagtgccaatttgcaaataccacatattaggaagaaattcaacagtgagattatagaattattgacctaaatgggcatcacaaattcatggttcatagtaccaacaggtttaccatgagaaaggatgctacaggcactgggatatgatgaattaggtgcctcacttcagtatggtacaagctggtagaaattataatacagttaaacaaacatgacctactggggaaaaggaacaaggtatttctgaagggaaaggttctttgatttatacagcagagtgttttttgaacaattaaattagcacttgaaccggggaaatcagtgggccaaattcatttagaatttcaaaatgcctttatcaaagcaaaaactgttttaaaaaattagttgacttgggactgaggagatttgttggcctcctgtatcaatcagagtcacagctgggaacaggcggcactctcagaccgggtaatttgaagagatttttttttaaaggaatgatttacagacacgagagcagggtataggaaagccacgagatacagtgtagtatccagggtgagtagctacctagagagttatgccctgggcctgaaggagaagaaggaaggtcgttggatcccacagtgagtaattttgtgtagagagccgcctgataaaggcaccttcagtggagggacagcacctgctcaaagtgtcacaaaggggaggaaccatgcaggggggaagccaggagaatagatacttcaacgtcattcttcccttcctcccatctcctgctgacacgctccatttacgttagccccactggaagatggagggtaagggagccagctgaggcaatctgtccaggcagcctcctgggggacagacagggtggagaaggatggagaatgggtcttgagagcaaacagaagatattcagcacacatacacagatgaacaggcactaccctccggattgctatttatgtatttataggtctgtcttttctactaaactgacctccttgagtcagtcttattctcagcaactgttcccatgcctagtaccctgcttggcacataaaaagctctttaaggccgggcgcagtggctcatacctataatcccagcactttaggaggctgaggcgggtggatcacctgaggttgggagttcgagaccagcctgaccaataaggagaaaccccgtctctactaaaaatacaaaattagcctggcgtgttggtgcatgtctgtaatcccagctactcgggaggctgaggcaggagaattgcttgaacctgggaggcagaggttgcggtgagctgagattgcaccattgcactccagcctgggcaacaagagcaaaactccatctcagaaaaaaaaaaaaaaaaaaggccaggtgcagtggctcacgcctgtaatcccagcactttgggaggccgaggcgggtggatcacctgaggttgggagtttgagaccagcctgaccaacatggagaaaccccgtctctactaaaaatacaaaattagctgggtgtgacagtgcacgcctgtaatcccagctacttgggaggctgaggcaggagaatcacttgaacctggaacgtggaggttgtggtgagccaagatcatgccattgcactccagcctgggcaatgagaatgaaactccttctcaaaaaaaaaaaaaaaaaggcctttaaaaatatttgttaaggccaggtacagtggctcacacctgtaatttcagcacttttggaagctgatatgggaggatcacttgaggtcaggagttcaaaaccagcctgcacaacacagtaagaccccatctcaatttaaaaattagtcagaagtggtgatgcacatctgtagtcccagctacttggaagactgaggcaagaggatcacttgagcccagaagttcaaggctgtgattgcaccactgcacttttgcctgggcaacagagagagaacctgtctataaaaaatgaaacaaaaaattgctgaatgagtcaatcaataaatgagtgtttacttacctctctgtggactctccaggaggtgcctccatgggaatacctctttttcttccattgcaaaaggaccattcctctctcttgtaacaaagtggcacagatattcctcatcagcacagacacctgggagagctgggccaggctgacgctgtccaagaacccagcaatgtacttcaaaatctccaggggcaggctggttaaagaattctggctttttcctccatgacccaaaagatggttgttcttccttccctcgctcagctctggagcaacctccggcttaatggcaaaggtcttgagctcctggctatagattacttttgccttttgccctgggggacggaaatggttttgaacaaatgtacatcccaagtaggcgagggggcatcgatgctggaaccagccattgagacatgactgaatgtctgtgtggacattcttgaagtgcagggggaactcatccctcctgaagaatttgttgcaagtgaaagtgaaggcagagctgcttttgttgtgtctcctggtcacacactcgctgtggagctccacgtggagtccccctggggtggcagcggttaggtcagccagcactgtcccagaggaaaactgttctggctcaaagttgtatgtttgtgtggcaaaatccatgaacagtccatcaatgcttctggattcagagatgacgtggcctttgagttctctttccaaagcacactggagggtggtcttgatgagatctgatttgggcaggtcctccacagtgatccccaaatctgaagtatccactgccttgtgttcacttggcttacaactcaacatggcatctccaagtcgagctcgctttccacagtagctcacaggaactttgaaggtgtaaacagtcttaacttcctgagcctccagcttgccataaacaaagtctctctccttgggtgtacaagcaggcatctgaccaaagtgtatcagcatccgcccattgtgcactagatacatgttatagtcctttgcatccacagctgttttcagtctttccagaacaccatcctgccaaggggcaagccctgtggtttccatggctgtacgaacgtcctgctgcttctgattttcctgtggttctttctttttgggagcgccctctccttctaccatgttatggccactggaaatctgttctttctcggagtcattcttgttcttgctctcacagctcgctgatgaatttgttaaagcagaggctgcgtgctctttgctgaaaatattttcccactggccaaacttgaccaggtccatcccttctttggttttggctagcacctcccgttcttcttgacttagctctgccatctccccattagttgctgacagaccatgtggtaccaaaccgatatccactccacccactgctcctcccatttcctccacactggtttcaccattcatagttggttcctcctcagtagcctctctagtttctgggaaaagttccaccattttcaaggatctgaagaggaccttctgatcctgcagggccagggctgtgtccaaacactcctcactgggggtctctttcatgatgttttcatgaagggtggtttcagagtccacatttggccagcggttccactccatggagcagcagaccacgctggcggggcacacctgcaggtgcttggccagtttgtggcgggacatggacagagggcagccatattcggagttgaggcacggaacctgctctaaagggcagaggagctggtgctctgcctctttgcacatgtggaaggtggcaccacagagcaggtggcagcttattaccaggcaggaggtgttgggttccacaggaatgtggcagtggcggttgaagcatccctcacaatgcctgtggtgccctggcggggatctgcgggctttcccctggacacaccaaggacagggggaagaaaacaaatgaatactgaggagaagctctatgcatgtctatgactgtgttttaattgacatatttcctgtttatacctgctttttgtagaaaccttgaaatatatggaatatcacaatcccacaatccagaaataacaactataagtactttttagaattttccaatagtttattatatatatgtagtagatgtgtttagaataggaaaaaaagaattgaatataatggactacactgttgacaattgttatttttgagttgtggattacaggttatttatatcatacggataatactatgaatacaacttttcatcctgctttttatcttgctattagaacatgaaactagattgttttattagttattctttacaaactttcttcataatggcagtgtaacattccggaatatgggtgtgctatcatttaatcaactaccaccagagtgcgggctgggaggacagcagccatgtctggttttgctcgcatttatgtccctagcatctagcatgggacctggacctttgtgggtattcaatgcttgctgaatgaaggaattgctagccatttagattattgctggctttttgactattttatttaaattttcacttaaactctttgctcaaaaatccttctcaactgttttccccttactctgtgtcaatttcttccaagttctgttcagcatctctagtttggaaaaaagttgataaatatcatcaaaccataagagcaagtctgctagctgcttgggctacaggataaatgaaggaagacctggacctctcaatggtgaagcttcaataagctcctggtgcttaccatggcgccccaatttcttcttgcttcttagctctacgggaaaatatgaatataaataattagtaagaaaagcagttaggttacctatattaatagaggctaaagagacttcacacactatctcatttaattccttccaccatcctggaggtgtctttatctccatgtttgagtcaaggaaacagaagcttgaaggtaagtaacttgtccaaggtcacacagctgctaagtgatggaatcagctttgtaatccaggccatgctggcccatgttattttcactgacccccgctgccctctgatagggcatattaccaatcatgggatgttaacttctgcttcctataactttctccattgtctgctgacaattatcctggcatcctaaacactctgctacccacaatctggcctaggttaccttctaatcttctcttccactggggcttcctgtccacttagaggttagtctgagatctaactttgtctggggcagtgtataggtgtctgtgaaatatctgtaacatgccatttcccctggtatattcagctgtgctagagcaggggtcaaaaccccaaaggtcccagaagttgactgaatggagactctggcaagtgaaagagaaaatgccctgtcttcagggaaatgaaatttctcagccctggttaattgatgccatgtgggaatgtgttgccagacctggtttttccagagacagtggggatgcggacttttgtgagctgtgatatggtttagtggttagaaggcagactgcacaggtttccaccctggagctacaagtcagtggctgtgagactttgggaaatttacttcacttcttcgctcatcagtttccccatcagtagagagaggataataatagtacctatcccataatgctgctgtaaggagtaaatgacctaaatatacatgaaactcttagaacagtgcttgtttcacaggcagtgatctatacatgtttgctattataaagtagtattttatatttcatcacaatgcaaaatattttactacataatatatcgaaataaaaatactctgaattttaaatgttaacaactaacttaatttaaaacaacactatttgagccaaggaaaaatgtgaatgctggccagataggatctgtaggttgccagtttgcaatatctggtctacagaatttgtaacataatttcagcacagtgttagtctgtgatggagtggggaggttagcatccaaatgtcagaagatccataagtttaaaatttggccaggcgcaatggctcacacctgtaatctcagcactttgtgaggctgaggtaggttgattgcttgagcccaggagttcaagaccagtctgagaaacatagcgataccctgtatctactaaaaaaaaaaacagttaaaaaattagcggggcatggtggtgcacgcctatggtcccagctacttgagagtgacactgacgtgggaggatcgcttgagcctgagaggtcaaggctgcagtgagctgtaatgacaccactgcactccagcctgggtgagagagtaagaccctgtctcaaaaacaaacaaacaaacaaaaaaccattttactttactttagaatttgccaattcattgtgggtaaaatttcccccaacttaaaaaaaaaaaaaagacatttcaaatatacagaaaaggtgaaggaatacatacaatgaacaccaaaatatactttatctagattcaacaattgctaacattttaccatttttgtgtcctttctttctctcctctctgtctctctctcaatctctccctgccctccaaccacacacgcacacacacacatacacacacacacacagttttggctgagccacttgaaaataagttgccagccaggcgcggtggctcaagcctataaccccaacactttgggaggcccaagcgggtggatcacctgacatcaggagttcaaggccagcctagtcaacatggtgaaaccccatctctactaaaattaaaaaaaaaaaaaaaattaaccgggcactgtggcatatgcctgtaatctcagctactcgggaggctgaggcaggagaattgttttaacccaggaagcagaggttgcagtgaatcgagatcacgccactgcgctccagcctgggtgacagagtgaaactccatctcaaaaaaaaaaaaaaaaaaacaagaaggaaagaaaataagctgctgatataagacgctttatccctaagtacttcagcttgtacttcctaagaataaagacttataataatattgtctcacctaagaaaactaaaaatacttttctaatatcatgtaaaatgcctatagtcacatttctccagttgtctccaaaatgtctagtatagttatttttaaatttttaatatttttatttattaaacatttttattgatatataatagttgtacatattttgggggtatatgcaatattttgatgcctgtatacaatatggaatgatcgaattagggtaattgggatatccatcacctcaaacacttttctttatgttgggaacattataattcttctcttttagcttttttttgacagagccttgctctgttgcccagcctggagtgcagtggcacatcacagctcactgaaacctccacctcctgggttcaagcgattcttctgcctcagcttcccaagtagctgggattacaatcaggcgctaccacacctggctaatttttgtgtttttagcagagacagggtttcaccatgttggccaggctagtcttgaactcctgacctcaagtgatccgcctgcctcggcctccaaaagtgctgagattacaggtgtgagccactatgcctggcctcttttagttattttgagatatacaataaattattgttcattataatttttctactgtattatcaaatactagaacttatttcttctaactttattttttaaaaaattttgttgttgttttttgtgacagagtctcacactgttgcccaggctggagtgcaatggcgcaatcttggctcactgcaacctccgcctcccaggttcaagcgattctcctgcctcagcctcccgagtagctaggattacaggtgcccaccaccatgcccagctaattttttgtatttttagtagagacggggtttcaccacgttgtccaggatggtctcgatctcttaacctcgtgatccgcccgcctcagcctcccaaagtgctgggattacaggtgtgagccactgtgcccggcccaaaattttttaattgatacatagtatttgtgcatatttatggtgtgcatgtgatattttcttatatgcatacagaatctgtaatcatcaagtcaggatatttaggtcatcatctcaagtatttatcatttctgtgtgttgggaacgtttcaaggcctctcttttagctgttttgaaatacacaatacattgttgctagctatagtcaccctactctgctatcaaacactaaaacttgttttctctgtctgttcatatccattcaccaacctctcttcttccctctcctactatcccctacacccttcccagcctctggtaactatcattcactctctacctccatgtgatcaacttttttagttctcacatatgagtgagaacatgcaatacgtgtctttctatgtctggctttaagacctctcatttttgaacaaggatccttttaatgtcaatttgttccattcgattgccaagtctttttagcctctttaatctggaacagtcccccacattttctttttcaggagagacagccttaaaccacaaggaaattatagtctggttcattcatttattagttcctccactcattcacccactcaacaaacatttgttgattacctactactacttgccagtaagtgagcataaggatcacctggacggcttgttagagtcttaaacactattgttcattagagtcagctgtgatgcttgctaaacctatagatctgcactggtcaatatgaaagtcacaagccacatgtggctatttaaatttaatcaaaatgcaataaaatgaataattcagtttctcagtcacgttagccacatttcaagtgctcaatcgccatttgtggctagtagctcctctttaggacaacacagaatagaacattcccatcttcacaaaaagttccactgctacagatgctggctgtacccctggacctgagggaatgatggactcctggaatttacatgcttaacacactccccatctgattcttacgcacattaataaatgagaacccttgttctggaccccactggggctactgagtgtgaaagaggaatcacggcagagtgctctatactcctaatagccctagtcagggggcaggtgagaaatcgcaagcaggagcatcaaacagggtcagggcccagcagaagataaacaaaggtgttaaagccagagaaggagaggaacagagcagggtggctgagagggttggactgtgctatgatctgaatgtttgtatcgacccccaaattcatatgtggaagtctaattcccagtgtgagggtgtctggctgtggggccttagagaagtgattatgttaaaggaagctctgcttaccaggcctctggtttaataagacatgaccagagtgactccatcttaaagtgaatagcaaggcactcacaagacacctgtaaggttaatacttatggtctgaagatagccacatcccaagctgaccaccacttataattacagaatatttatggccagacaaaacttctcccaccaagcctgcagagtgcccagatgtcctgagagtgcagccctttttacttaaagataatgttaatgagcaagctgaggttaaaagattgatggtgttcgataacactgacagctgctacctttagtgagcacatctgcccatttcaagtttaatttagctccttatagtttcctaatagtttctttctttcttcttcttctttttttttttttttttttttaagacacagtctcactctgttgctctgttgcccaggctggattgcagtggcactatcttggctcactgcaacctccacctcccgggttcaaatgattctcccacctcaacctcccagtagctgggattaaaggcgcgcaccaccatgcctggctaatttaatgtttttagaagagacggggttttgccatgttgtccaggcttgttccaaactcctgacctcaaggaatctgcctgcctcgggtttcttataagtagagacactaacaaaagagggagcgttcctccttctgctgcggacgccctagtctgtaacagagtagtttccaacaaatgtgctacttttttttttttttttttttttgagatgctctctctgttgcccaggctggagtgcagtggcacgatcttggcttactgcaacctccgtctcccagattcaagcgattctcctgtctcagcctcccgagtagctgggactacaggcacatgccaccacacccagcaaactttttgtgggggtttcatcatgttagccaggatagtctcgatctcctgacctcgtgatccaccagcctcggcctcccgaagtgctgggattacaggtgaaagcctccgcacctggcaaatgtgcttctttcacttgcctcaaatcctttcctgtgagaatccaagaacccactcttggtgtctgggtcgtgaccctcttttcctgcaacatccttctggtgtccttgtatggatggacaataagaagagactcccactcggaaggaaaacagtctgcgcagcatcagttggctgactttgggtaagtggggctcattttagagtcattaagctattccaggggacaaggatgcttgtccactgctacttgagtttgaggcccagggcccaaggagttagaagccccagggtttatttggaaaacggatttggccctatgagatgtttgccactaactccttgggagtaatccaccttgtgctttctgttgctggcctgagcgtcctgcttcttgtctcctgtcggcttgctgcctttgtttcacagaacccctgaggctgccacgggaaggatggcccaaacagtttagcattttctttttctttttttttttgagacagagtctcactctgttgcccaggctggggtgca

SEQ ID NO: 12379 - DNA, 22611 bp, Human
acacagaacacaattcagagtttgttaagacattaacacactttgatatctattccaaaaatacttttgttaccacaggttcattgctgtcatttagacaaaattaatgtactgtgatattttcctactcttaagatgatgttgcccagcctagtactgtcagaaattcagttctgatgtctgtgtgtgcaagatattaatgtggtccctgtaagaaataccagagttggtcatgatttactaaggagatgtaatattttctttgacctgttaggaatataacttgtgtcttgatttgttgcacatcatattttttgcaacattaatgaatttaaataaattaattggaacgttcgtctttgtctttttatcacatttttctttcattatgctactaaatttttgctttgaattatcctataaacctcttaaataatttcagacctttacacttgtttccctttctatagtctaagtgcttctattctttggggattagagagttcagcctgctttattttaacatcaaaacaataatgaaactttgtgtttcatagttgagatttttttttaattaatggggaatccaaggatgaaaccatgagtggcttaaaatgaaaacatggcttttttttttttttttttttgagacagtttcgctcttgttgcccaggctggagtgcaatggcgccatcttggctcaccgcaacctccgcctcccaggttcaagcaattctcctgcctccgcctcccgagtagctgggattacaggcatgcaccaacacgcccagcgaaattttttttgtattttagtagagacggggtttctccacgttgaggctggtctcgaattcctgacctcaggtgattcgctcacctcggcctcccaaagtgctgggattacaggcatgagccaccgcccctggccgaaaacatggcttaaataagaagaacttgtttagttcatagacctgctcagaggttccagctgataccacttggtgttttttgtggttttgttgttgttgttttgcacatactctttaatcactattcagctattttgtaggataaactgctctacacatgactgctgggtttaagccagttagtgtaccatgcaccctgacacctaaaacaatttgtgattttgcaaacttgaaatttatagtgaagtatttatcttgcatattagatgcaaattttaaatataacttcttccaaattaaagttcttcatgaactggtcacaaactaaaaactttgcctgcagccctgtttcgaggggtaaagaagataccctgcttaccctgctataatttttttttttttttttttttttgagacggagtttcgctcttgtttcccaggctggagtgcaatggcgcgatctcagctgactgcaacctccgcctcccaggtacaagccattctcctgtctcagcctcccaagtagctcgaattacaggcatgcgccaccacgcctgcctaattttttgtatttagtagagacaggatttcaccatattatgctggtcgcgaactcctgacctccggtgatcgacccgcctcagcctcccaaagtgctgggattaaggcgtgcgccaccgcgcccggcccctgctataatcttttcagaattcgtctgcaaggtcttcaacactgttaccctgaacacacttccggcatgaaatatgaatgccctacatttcttaaattgtgcatctaacaatggagaagattagtctctaaaaattataattcccttaggaacgatttagtaaacctggtgaattactcgagcagagcgcctgtccaccactttaaggcttcaagctccagcccgacgcccctccttccctctccacgcccttccctgacaaggcttgagtggcgggcgagagcagggctgggcggggcctcccggccctcgggcggggtgtcacttccaggttccgcgagcacttccgggtcgtcagctcagttctgcggtttctgcggcggctggagaggtggtcggagaagtaggaacctcctgccgggctcgtggcggcttctgtccgctccgcggagggaagcgccttccccacaggtagtgggttagggagggcagggttagggagggaagcagggccgcgctccctgccgcccccccggagtcggagtgcgttggtggggtagtctctgagggcccttcgctcctgggatctgcccgttaccgaccgttgccggcaaggccccgcggccggcaccggagaagggcggcgaggcggcggggatggtcgcgtcccgtggcgggaggctcgtcgttcacggggcgcccacagaacccacctaggggaggtcctcagcccaccaccgtattttcagccaggtgaatgtcttaaagcatccactagcgccctgtgagttttgccgaatttcggagagcattttttaaatgtctcattcctgtgctttgtagcttgttgtttgaagtctgccttccaactttcttcgtgcgaactccgacaaaaggaacgaattttaaacttggtggtttaatcaaaaaatgctaggacgagttacttccgaatttgacttctaattttctgaactgcaaaacaagaagggaacaataaatttctgtggctgataccacatctaaaagattagaacacttaacaaggaatttttaaagaatgtaagaacattgaaatcagcacttttaacaaacgtttaacgcagggctattttctagataaactcaaaaatttgtcaaatgggacacgatgcacgattctgtattcctactctgtggagtttttatctacctattgggacttcttgccctttttaaccccctctcccctcccacacgcatattatacttactgatatttgccttcgtttactgaacagatttttttttggctcctattgtgtgccaggtactgttctagacgcctattttacttaagtgaacaaaataaaaagctttgccctcatggagcttacattctattagaggatgcagaaaataaaatatataatggtgttagaaagtgatggtgccatcaaaaaaaaaaagagaaatataaaggagtacgggaaagttccagagtggaggtgggaactggtattttaaagatgacggtggtcagtttgagcctcatttagtaggtgttatttgagcaaagacttgaaggaattaagaaaatttgctaagtaaatatcaggaagagcattcaggcagataggaaagccaatacaaatgcttttaggcctgtcatgtttgaggaatagcaaggaagccagtgtatctggagagggatgagcaagagttttgggggtggagggacaagaagataaagtcaaagagatcatggtagccggatcattgtaaaggctgatagaagccatgggagattttgaatagaggagaggtatgttgtaactgaagttttagaagatcaccctggctgtgagttgtgattagagtgtaggggtgagtgtagaagcagggaaatcatttaggagatttttgcagtaatccagatgacgagagtggcccaggtcagggtgataaccgtagggatggtgagaagtggttggattctgaatgcattttgaaggtaggccttacagtatttgctaggaattggatatggagagtgagatagagggagtggaggatgaaatcaaaggttttgcccaagctcgtagaagtatggagttctttaagccacgatgcaaaagataacaaatagagatgttgagtaggcagctagattcaggagtgagaagttctatgctatatgaatttggggatcatcagcagtggtacttaaaccatgagaataaatgttatccgtaaggaatgggtgtagacggaaagcagcagaggcctaaggactgtgtcctgtgatattaagagtttagcgaaaacgggatcaaccagcaaacagtattaagaaggatgaacttgtgagttaggacaatccgaaaagggcagtgtcccagaagccaaggtaagatcctgtacgaaagaggagggagtaatcagctgtgtccaatattctgagtgaggctagagaattagctttagcattgccattgatgaccttcaccaacctgtttccttagagtgctagaggcaaaaattagcttaagagaaaataggaaaaaaggaattgggagacagtgaatacagacaaaactaagggattttgctgcaaaggggaactgagaaataggatgtagctggcaggggatttgggttgaggggtttttgttttgttttactttttaaggtgggagaagtagccacctatgtgtttgctaatggaaatgatccgcagagagggaaaatttgatggtgagggagagaagtaacaactgaattgtcagaacaatatccttgagtgaattagaagacaatgcctgatacaaaggtagaaggattggatttagataaaaataggtatagagttcaactatagtgacagggagggagagtatatgggtacaggttgggcatcccaaattcaaaatgctccaaaatccaaaactttgagcaccaacatgacactgaaaggaaatgctctttggagcatttcagagcttgaatttggggtactcaatcactaagtatatacgatgcagatattctaaaatccaaaagacttcaggtcccaagcatttcagataaggaatgttcaacctgtatagctattggtaggtagctggatgtggctgtgagtctggaagttattgctgcagtttcctcagtgaagtggaatactttgtgtcatactcagatacatttctaatatattagcactttaacatactaccaagtatttcactcaacagatacttaatagatactacatacgttgttctagttggtaaatatgtaaatgaacagaagtccctgtcttcagtgtgtcatctattttagtagatggagacagaataagcatatatatgttagcttcagttattggtatgaatgaaaataaagcagtgtgaggaagaaggaaggtaattctttcttataggttgattatagaaggcctttctgatggagtaatgtttgacccagagatctgaaccaaatgagagagtgaactatgcaggtatttggaaagaatactgtcagcaaaaagaagagccaccacaaaggccctcaagcaggatcatgcttcccctgtcaaagaacagcaggggaccagtatgaccagagcagagtgagagggtgagtgggcgaagatagggaagtaggcactggggggcccaaatcacataggccttccaagccatggactctgtggttttcactgagatgggatgctgccattggtggttttgaatagaccagtgatgtgatttgccttatgttttaaagtcttagtgtggctactatgagggtggggttgggataggcaagactggaaataaggagaccatgagttatcacattaactttagtgacagatgatggtgacttagggtaatagcattgaagatggtagaagctgtcagattctggctatagttagaaggacgagctgaaaggttggctgatggattggatgccaggtaagaaaaagagaagttactcttgactcaggtttttgagctgttacaggaagactatgtttactgttaccgaggtgggtaagactgaggacagagcatatttgcaagagtagcatcagaaacatggtttttgacaaattgaatttgagctacctacttgatatttttatccagtgtcaagcaggcagttttatatatgggtacaaagggagaattgagggctggagatacaaatttgagagtcatcaccagatagtagatggtatttaaagccgtaagtctggatgaggtaactaagagagtaaagtatgtggaaaatagaggacccaagaaaacttagggcagttcaacagttacaagtcagggagctgaggaggaaccagcaaaagaaaataaaaaatacaatggtatccagtgacatgagaactgagaatgctgtctcaaagccaaagaaatgtttcaagaaggcagaaatgatctgttgaatccagtgctagcaaggtgtgaaatgtaaggactgatggctggccattatttttgctgagttttatctgatgattgctcctcaaatgtattttcccccatccatctccagactgaaagggccatgaggtcaagatcttacacctgacgtgtagtggaagctcagtaaatatttattgactgtgtactgctgccacccttttcgagcccccatccctcatctgtttctaaatcacgcactgaagcccagctgtctgacctttcctgcctaaaattcttcagtgactcccgactgcttgcacctatcctgccaaacaactccatctatgctgtctctttcagcttcatctcctgccactccctattcgtacttatgccctgataatgtagaacagtttatgtttttccccacaaacatttcatccttccatggctttacttattctattctgtcagcctctggaatgacttccctcctctgcttggctaaagtctagcttaaagaacctggaagcttttctgagccagctcacttctacaggcagcctccatggtatgctttgtatctttatcccagttcttatctttttgtatgtttgttacattctctagagtataaatttttaggattgggagcatgcctttaatcatcatcttctctctggaacctgtcacagtgccattctcttggtaggcactctgtaaatactgaatttagagagaacaggaaaataaaggggcagacatgcaaacatgagctgaagattttaccagtgacttgacagcaggtagaaaggacagtacatggaaaattctagactaagtcagaaggcagacatttgaaggaaatggtaaagacattttaataaatataacagctatactgcataaaggagtataaatgcccatgtcaaaatcatggggaaaaaaactggaaaatcatttgtagcaattccttgtaattctaaaatgattatctagtaatgtgcaaccactaagcgttctcctagttctatattagaatatttgaggtagatgatattatatacataatttatgatgttacagtatgatcttttttaacaattttatattaaatttttaggacatcaatgcaagcttgaataagaaaaacaaattcttcctcctaagccatggcatatcagttatacagaaatactactttgggaaacagtcttcaggagagcctagatgagctcatacaggtgggagactgaattaaaaatcaaacatttttatcttgatgggtttacagtaattcttgtcatatcacttaggcaaagagatatgaggtaaaatatcttggactgtttgacccagcaagtcagtaacactgattaaattacctcaaattcttgtttattacactgtcctgacaacaggacacaaaacatgattgaatgatatcattaaatatagctaaatctgggtacatgcagtgtttcatgcctctaatcccagcactttaggaggacaaggtggaaggatcgcttgaggccagaagtttgagaccagcttaggcaacatagcaccacccatctccacaaaaaataaaaaaattagttcggtgtgggcgcatgcctatagtcccagttactcaggaggctgaggtgagaggatggcttgaacccaggagtttgaggcttaagtgcactatgatggtaccactgtactccagccttggtgacagagcaacatcctgcctctaaataaataaagttaaatcttcaaaaatttttgttcaacataaaaattgagattgttggtttcccccttctcaaatttagggaagaaagtcatatactttttagctttaagatagttttgtgcaatttaagtcttctgagatttacaagtctgaatttatatttcaattttaagagaattaacccttctgtataattctcccaaataaaaacatattaagtatttccagctgggcaccatggctcatgactgtaatcccagcactttgggaggccgaggcaggcggatcacccaaggtcaagagttagagaccagcctgaccaacatggagaaaccctgtctctactaaaaatataaaattagctgggtgtggtggcacacatctgtaatcccagctacttgggaggctgaggcaggagaatcgcttgaatgcgggaggcagaggttgtggtgagctaagattgcgccattgcactccagcctggggaacaagagcgaaactccgtctcacaaaaaaggaaaaaaaaaaaaaacatattaagtatttccatttgttggtatattttatgagattcaataaaatttaataggttttttgtttgttaatataggccctgtgtatttaaaagaaacacctctttgtctatcttctcctttccagccactgtaagggaaaattgacaaagttttgttctggctttgtaacatcactgcatgttttctcttcaagattgtttgtgtcaagatagtacaaaagatgtcttcaagcttggtgcttcatcatcagttatggcaaaggagataaaggaattctagtttagaggctttggttaacctcagttaaattttagatgataatttgtatatttttatttactttgtctttaatgttcttccttaacgggatttatgacctttaccttttctcagtctcaacagatcaccccccaacttgcccttcaagttctacttcagtttgataaggctataaatgcagcactggctcagagggtcaggaacagagtcaatttcagggtaaggatattttcctgaatctagaagcctgtaccaatggttgttaaaacactgatttttttttaggacccctacatatttattaatcataagaggaagaggtggcttagtcaatttttggaacttgttttatagtaactaaattatacttttcaatcaactataaactaagttgatccacttaatgtgagatacagagatgtttttagatttttatttcattgtttcacaaatcagcctttgtatgtttggctaccttccctgaagagttactgagattccaaacacctgaaatattatctgcaggattaaaggtaagtggcggagtaatccccaaggttctgttatggttttcaaagtctggcctttccccgttccagggaagtagagttatttctagaaacttcatgttgcctccctccgactcttaggtaacttggctgataaaaacctgatctctaatggtagataacagtctattctggtagcttggtctcacttcagtcacttatactttgaacagtagtcatccaaagctgaataaaattatctctctcaatttcctgataacttcagattaagtgcccattgaaagagtcatggtgcaacagaaataattttaccacattatggtattgatggagtcatataatatatgatgatgtttgcttattatttatctaactttatgtttatattgtattataaggcataacctgtagaaatatagtcaaaagaaggttaaaatatggttacaaccaaaatttgatcattagttaacatctgcctacttcatttggtacttaaacattcagtaaacaatttgagtgtctgttaacataccaggcatgctctagatacacagagatgaaaagataacataccaggcatgttctagatactcagagatgaacaagatagacaaagccccatttgacttaaattttagtgaaggataaaatctccatgtattttatattaatataaataagtctcatatatcagtttcatgtgccaaaaaattatctggagtaaaatatgccttcaagactgtataatttgaccagtggatccatgaatttttaacagtaatgattctgccaaaattagtttgtgtttttttatatacccatatgcagaagtctgcccagatgatccatgttaatacataaattttgctctaataagaaatttggtggactacttatcagaggcaagatagttcacaaggcctaactagtcatcttctaggtgcattattgtaggtttctagtttggatttctttagctagagttaaagtaatttgacatttacatttatcttgcatagtgttttgtgagtttgtctattttcgaaaagctataaataattgctctcagccttgatcagaacttttccattcttgctttttattttcctgctgctactattctaactcacgctttttatcaccctactcctgggttacagccaacttgatcaattttaaatccagaatgtttgcaaataacattctgtttagcttagtgtagcatatggccaagacaaaagataatgtgttagaaatacctaattttcagagccattttgctagatcaaatttaggtatatattttttatgtataatttgctgacctagcaatgagtaagcatcctttacaagaatagaataatcctatatagcatgttaaattgttttttagttttttttgtttgtttttgtttttgttttttgagacagagtcttgctctgtcgcccaggctggagtgcagtggcgagatcttggctcactgcaagctccgcctcccgggttcacgccattctcctgcctcagccccccgagtagctgggactacaggtgcccgccaccacgcctggctaattttttgtatttttagtagagagggggtttcaccgtatttgccaggatggtctctatctcctgacctcgtgatctgcccacctcgacctcccaaagtgctgggattacaggcttgagccactgcgcccggcctgttttttgttttaaatccttttatgggttcaatataagtgaaattatttagtagagtgttataggagaaaatcctcttaagtatgagagctaaggttttaatcatttatatgttttaatttattagtaaaaaactcatatgtaccatggagcttgaacttaattaatttttagggagaaaattcagattgaagtagtatttgtaactaggctaggcttttatttatttatttattctttttttttttttttttttgagacgaagtctgttacccaggctggaatgcagtggcgcaatctcggctcactgcaacctctgcctcctgggttcaagcgattcttctgtctcagcctcctgaatagctgggattacaggcacacgccacaacgcccagctaatttttgtatttttagtaagagatgggatttcactatgttggccaggctggtctcgaactcctgacctcatgatccgcccgcctcggcctcccaaagtgctggaattacaggcgtgaggtaccgcacccggccataactaggcttttaaagagccattgtatggttttgggagaacatatgcccatagataaaagtaatggttactttatagtgttgagcctcgaacagtaattaacaagcgttaaaagatttaatgccacaccccccaaaaataagatttagtgatcaagaaaaatagcccttctaacaaaactgaaagtttccttttccctgttttttgatgtttctgtaacaaacatttattatataacttttaagatgttcttttaggctgggtacagtggctcatgcctgtaatcccagcactttgggaggtcaaggtgggcagatcacttgaggtcaggaatttgagaccagactggccaacacagtgaaacctcatctttactaaaatgagctgggcatggtggtgcatgcctgtagtcccagctacttggaaggctgaggcgggagaatcgcttgaatccaggaggcggaggttgcagtgagccaagatcgcgccactgcactctagcttgggccacagagtgagactgtatcttaaaaaaaatacaaaaacatgttgccccattgtggatacatgtaaaaccaaaaatgtatttattaaaagtgcattgaagatacaatttggccaaatgattaagtgttaaaagtaatatttgaccaaagccaaatatcttatagaagaaactttttgaatttaaagaataaatctaaaattacactttgaaaagtataattatctggcactgcagctcaagcctgtaatcccagcaccttgggaggccaaggtgggaggatcacttgagggcaggagttcaagagcagtctgcgaaatatagtgaaaccctgtccctacaaacaaacaaaacaaacaaagtagctgggtgtgatggtgtgtgcccatagtcccagctgctggggaggctgaggtgagagggcagcttgagcccaggaggttgtggctgcagtgagccatgatcatgccattgcatttcagcctgggtgacacagctagacactgcttcagaaaactatatgtatgtaaatatgtatacacgcatataaattatatatatgaaagacatgtatatattatgtttgtaattctatcattatagagtatatgtatatatagtatatacatatatataaacatcgtttttatactatacttaagatactaaatggattctgactttcaaatcagtgaaaaagcaagatatttaaataagtaaaaattatatacagaaaagcttatttcatgttagagattctaattcaaattattctaaaaagattatattatttcttacgtttacctttttaaaaacatttgttggctcagaagttacgtagctaatgtgcactttgatgatgttaattgtcaattttcatttacagttggaaggcatttaatatactttaatatctttcagtcaagttttgtagcattttatttttgtggtaaaataaatgaagcatatacatttatactgcaactaatggaatttcagcatatgatatttaagatttttcactccaatctacatctaaaatgctttatatttgaaagtgaatactcacatactggctcataaatcccaaggacttgctttgtttaaattatttacataacattatccaatgaaagtaatttactgcaagctaagctatgaggacacaaaggcataagaatgatatgactttgggaactttggggaaagggtgggagggtggcgagggataaaagactacacattttttaaaagagaaagtaaggcaaggtacagtggttcatgcctgtaatcccagcactttgggaggccaaggcaggcagaccacttgaggtcaggagttcaagaccagcctgaccaatatggtaaaacccgtgtctactaaaaatacaaaaattagctgggtgtggtggcgcattcctgtagtcccagctatttgggaagccaaggcaggagaatcacttgaacccaggtggtggaggttgcagtgagccaagatcacaccactgtgctccatcctgggcaacacagcaagactctgtctcaaaacaaaaaaagtaatatacacacttttttttttttttttaagcggagccttactctgtcactcaagctggagtgcaatggtgtgatctcgcctcactgtgacccccgcctcctgggttcaagcgattctccagcctcagcctcccgagtagctgggattacaggcacccaccatcatgcccgtctaatttttatatttacgtagagacggggtttcactatgttggccaggctggtcttgaactcctcacctcagtgaccctcccacctcagcatcccgaagtgctgggattacaggtgtgagccaccacacccggccagtaatatacacactcttaagatcgtggattacacacaacttcaggatgctggaaatgaacgttgagtttggcatctagctgtttagctttccagaggttcagactgtagcaaacgaggagatctaatttttaaatatattttataggcttacaattttgtgtctttttcccttaacgtcatgggtgactttcagtatatttatcactccactgaaattgctgttgccgagttacttttgctaaatctaatgcatcatttgtagtgctattgatgattgtttttttgaacccctatttcccttgaaaccatactgtgtgagcttttctcgtattccctggcctgttgctctcagactcctctgtagttctgtctctgcttatcatttaattgttggtatttcttagggttacagcgtgcgtccgctgtccttggtctcatccaaccctctggctttggttaaactgaatatcatgatcacatgctttctcctatactccaattacttattggacatcatgacttagatatacctgaaattcaacaagttccaaatttaactttactccccaaccagctttttctgtgaatgcattgacattcaagtcagaaacttgggagttaccgtggatttctctgtcccccaaccccaccatatttatagttgtccattcctaccggtcctactttaaaagtctctccatttctattgatccctttactatactattactgtagtaaagccactttcacctctctgattcacccagctaacagacatcagcttcatagttggtcttacttcctttagtcatactcctgtctaacccattatgtcatcaccaaaaatgcaaatctgatcagactcttatgcttaagatccttcactgacttcccagtaccgttaggatggggcaaaggttttccaaggttctcctttatcttaggacctcctgacacgttctgttttctggaatcaaccaccccattccaagtgtttgtcttcctttccattatccctcctctccattgactcttacttattctttaggactcaacttaaacttcactttttgagagaagctctctgccttgtgtcctccatactcttgagtgcctttgctgtactctcattgtacccagtaacttactctttcatagcactgttatactacgtatttacctgttttaatgatctccctgctaaactcagctcaccagtggcagggagctgtgcttaccattgtatcctcagaggccagcatagtctagcacacagtaattactcatttattatattcattcattcatagctatcagtttccttagtcattctcacttgatagactatttagaatgaatcccatttttgctattacaataatattgcaaggagcattttcatgcttggtggtttctgagttgaagattttaggcatttaagtgttgcctactaaatttcctgtgtgactatatgtgtgcatgtgtatatctcaggttttaattgtattctgttggtgtctatgcacgactttcatcacattctttttaaaaatttccggctgggcacagtggctcacacatgtaatcccagcactttgggaggccgaggtgggcagatcacctgaggtcagaagtttaagacgagcctggccaacatggcaaaaccccgcctctactaaaaatacaaaaataagtctgacatggtggcagacgcctgtaatcccagctacttgggaggctgaggcaggagaatcacttgaacctgggagacagaggttgcagttggtcaagatcacagcactgcactccagcctgggcaacagagtgagactctatctcaaaaaaataaaaataggctgggtgctatggctcacgcctgtaattccaaaactttgggaggccaaggtgggcagatcacctgaggtcaggagtttgagaccagcctggacaacatggtgaaaccccatctctactaaaaatataaaaattagacaggcatggtggcctacgccctgtagtcccagctactctggaggctgagacaggagaatagctagaacccaggaagtggaggttgcagtgagctgagattacacccctgccctccagcctgggccacagagtgagactccatctccaaaaaaaaaaaaaaaaaaagtaaaaatttccttttgatgctcaagtatatatatattcctactttaaacaatttttttttcttaattataagaatgtgtcctgggcatggtggctcacgcctgtaatctcagcactttgggaggctgaggcgggaggattgcttgaggccaaaagtttgactagcccggccaacataacaagaccctgtctctatttctttttaaatattaaaataggctggtgcagtgattcatgcctgtaatcccagcactttgggaggccacggcgggcagatcatctgaggtcaggagtttgagaccagcctggctaacgtggtgaaaccctgtctctactaaaaatacaaaagttagctaggcgtggtggcatacacctgcaatcccagctactcaggaggctgaggcaggagaatagcttgaacttgggtggcggaggttgcagtgatccgagatctcaccactgcactgcagcctgggcaacagagtgagactctgtctcaaaaaaaaaaaaaaaaaaaaaaaattatataggccaggcgcagtggttcacactggtaatcccagcactttgggaggctgaggtgggtggatcacctgaggtcagagttcgagaccatcctggccaacatggtgaaacaccatctctgctaaaaataaaaaaactagctgggcgtggtggcaggcacctgtagtcccagctacttgggaggctgaggtaggagaatctcttgaacctgggaggtggaggttgcagtgagccaagatcgcaccactgcactccagcgtggcaacagagcaagactccatctcaaaaaaataaaatgaaaacgtataaaaaattataagttgcacaagacaatgaatgttgtagtcttagtgaccgatgcagtaatgcatctgagccaagtcacaggattaaaatttagtgtttctaagaaatccctgcttttgtacatttggagaattaacatacacaataaaatatgtaacttttaacaaatatttccataatttgaatgaactttcataacttagccacatgagggcaatagaaatacaaacgcaagtttttattttttcttcatatttcaggtaagtaatttgcaatgcagactaaaaatacagtctgccaactaaaatatttttgaaatcttcccttagcaaatttgtctggtggttgtttttttaatagctaggattaaagttaaggaaaatcttaagctaagcattaaacttattatgttcttggtagctaagatctcttaaattgctttggagaaaaatgtgaggggaaaaaacgtttcacggtatttctaaatgttttgttttaaagggctctctaaatacgtacagattctgcgataatgtgtggacttttgtactgaatgatgttgaattcagagaggtgacagaacttattaaagtggataaagtgaaaattgtagcctgtgatggtaaaagtaagtgcttgccttatttctgtgaaagctacttgaaaccttgtttttatgagcctttagaagatctgcatccatatgaaaagcctaacgggtaaaatggccctatgatcaattcccagataagcccaggcttttatctccactaaattctgattacatatctcaaacagtgctcttactttgtgacttaataacatatagactgcttacacaggttggatttgtgtgggtaaaataagcaaattaataagcatttgttccctatttccattacaaattttaagtgtttatcaggcttttcagacaccttttactttaaggagtaatttttacaatcctatggtttctatgttgctggagacccatatatttaaagagttattttaaacaggattttaattagccataagaactttggagtcatgatggtaaatattcatctaatctgttaaatatgacatgtgcaagtgaacttttcacaccagacctaggaacttcttcaggtccttaaatgtttcaaaaactatacacctaatttctgtttcatgattagtttatttcctttttgctaattatattattttaaatatacttcataatctgaaccatttgtgttaagagcagctattccagaaagtaaatagaaaagactgctgctctttgacacagggagttttgaaaagcaagagaaagatatgtagaaagtaaccccctccatttccctgtttgagtcggatttgttttatatattttgcatttccaaagaaatagctaatcaatcaatcactgaaaaaatgtagagaatacaaaaaagcacatggaagaaaaacgttctctgtaacactacctgatggtgttataacttttttttgcaaaaatgtatgtatatgtagacattagtaaatgtatttttgagtttactactcttaatcttaagccttaaaaaaaaaaaaaagagtcttgctgtattgcccaggctggtctcaaactcctgggctcaggtgaccttcccacctccttctcccagagtgctgggattacaggcgtgagcccctgcacttaagcctgatttttagtagctatataaaattacaccttaagccctttttaaagaaatagtctcttccagatatcagaaagtctctgaacctagcagcgttattgttggggacttgttatagttcagaaggttacctaggaataatcattctaagaactttgggcatagttaactttttattatagtcattagatacatctttgtcattatttttaaattcctgtgaaggtggtgctgtttcctgaatcacaagataacatttctatatttgaaattgtgtacaatttttttcatatttaaggtaacagcatcctcgtaacccttgttatatttatttttattagtctgtagaattcagggattaatttataatacctagatctctatcaaaatgaattaatgacatacaccagtactgcttagaacttttttttagcacggacatgttctgttgcattttccaatagccactcatggctgttgtacttgaaatgtgggtatgggcagctgaggaacttaactcaatgttttaattttattaatttgaatttagccacatatggctagccagtggttaccatattggacagaacagatgtagactagtagagtgtcagtttcagtcatttgaaccatacatttgaaccatagctgagaaccagaaaatcagtaaataaagcctctgaacagaataaatactggtgtataatatcaaagaatccatgtaaagatacgtattttactgataggagctcctgtctggtagtccttagagtgtgtttctctttactatacaagattgttttccaaacttcagtggatgagaagtagcagattggccttgtttattgcagtagtttttgaggattttccctcacacttcagcacggtgtagtaattgatctttagtgagaagattgttgactcaaggaaagcttaaattgtattccatttactttgtatctgcagaaaagaatgcagtgttagaagtttgggacagtaggccaggtgcagtggctcacgcctgtaatcccagcactttgggaggccaagttgggtagatcacttgaggccaggagtttgagagcagcctggccaacatggtgaaactccatctctactaaaaatacaaaaattagccaggcatggtggtacccgcctgtaatcccagctgctgcggaggctgaggcaggacaattgcttaaacccgagaggtggagattgcagtgagctgggattgcgctactgcactccagcctgggcaacacagtgtgactctgtctttaaaaaaaaattgccaggcacggtggctcacacctgtaatgccagcactttgggatgccgaggcgggcagatcacgaggtcaggagatcgagaccatcctggctaacatggtgaaaccccgtctctaaagtacaaaaaattagctgggcgaggtggcgggcacctgtagtcccagctactcgggaggctgaggcaggagaatggcgtgaacccccggggggcagagcctgcagtgagccaagatcacgccactgcactccagcctgggcaacagctagactccatctcaaaaaaaaaaaaaaaaaatttgggacagtaaaggacctgggggaagaaaggttatgtaacaattatgtgaaccaaatgtagttcaacttagttttactctagtatgaatatgaggagctaagcatgtttgtatctctgcttaaaaggaaacttactgaagttcaacatatttacagtgtcacctttcctcctgttcttccccaccctgcaagccaccaccactattagtcctgtgttctcatttttgatagtcttaaaatagttaattgtaaaattaaattgctccttgaatttactttactttactttctcttttgtttcctagatactggctccaatactacagaatgaatagaaaaaatatgacttttttacaccatcttctgttattcattgcttttgaagagaagcatagaagagactttttatttattctagaattgcagaaatgactacactgtgctataccagagaattccagtagaaagaaacttgtaactctgtagcctcttacatcacctttattatacagcatgaaaaaccataacttttttttaaggacaaaagttgttgccttcctaagaaccttctttaataaactcattttaaaactctgagtaataactggtgaagctattaaggtagcaatatgaagatattagataatgcattttcccatttcctttgcaaggaacatgatgccctttcagaatgcttatttcaataaagtcatgttttgtcagttgtaactttacctgatgaaagcatcagcaggggcaaaaccaaactctggatggaattttttaagaaaatcccttgctttttaaaatacaaaaccaaagttaatcattggtataaaaaaacccaagtacaacttgattaggaaaagttagacaatcatagcaaaaacaaaaccaaaaaactttccttcttagaccaggtaacatgaggaagggggaaaaaaacccaaacaaaatagtccccccacatgacaggtgtcttcagcttgccatattgatccaaagttcatacattttatcatgtacaagatacattagacttacaataaagtctaattattagacttttatgtcagtggattgtgcttgcagaaatacagaagtaacatactgaccctaggtgaggagtttcttacatggttaactggattgacccaattggagtaaaagatttttgctgttacctcgatgctcctgcagttgttacctcagcatgccactgtagtccttgactctcacattaaaactaactttggctaggtactggtggctcacacctgtaagtaatcccagtactttaggaggctgagactggaggattacttgagtccaggagttggagaccagcctggccaatatagactgtccctacaaagaaaataaaattgtttcatcttccaattcattctatgcatgtatttccatgttcccttcctaacctccactactacctattacatagtcaaatgcataccaggcaaatgcagaggtatgtatggtgtatttatggtggctaagctaaatatgaaaactggttttaatggatgaaatgtaaaaactctaggtgtattccatactggttacctaaatgagtactctagcatctattataactgactcaacttcagtcagcctgaaatacctgtcccatcacagaaatggtctcccactaaataatgctgagcaaagctctaggtacatgaaaaaacaatcaaggacagaatataaacctttttgagaacagaggcagtaatacatgtttcctcccaaaagagggcaggataatcattcaggtatgtttattttgtattacagctaacatttgaatagtattttcacaaatgcttactaaactcaagtatgccaggcgcacagactagaaaactgctattggagtagaatatgcacttcaacccggacttttccctttttgagatggagtcttgttctgtcacccaggctggagtgcagtggcacgatcttggctcactgcaacctccgcctcccaggttcaagagattctcctgtctcagcctcccgagtagctgggattacaggcacatgccaccatgactgactggtttattgtattttagtagagacgggttttcaccgtgttgcccaggctggtctagaactcctgagctcaggtaatccacccgcctcggcctcccaaagtgctgggattacaggcatgagccaccgcgcccagcccaaacttcaaacatagctctgtactgtgaagtgctctgtacctagagctttgtcagcattatttagtgggagaccatttctgtgatgggacaggtatttcaggctgactgaagttgagtcagttataatagatgctagagtactcatttaggtaaccagtatggaatacacctagagtttttacatttcatccattaaaaccagttttcatatttagcttagccaccataaatacaccatacatacctctgcatttgcctgggcggaggtgcagaagtcaaagcctggcatttcctcctgtcacttctaatgatcgcatacacatcacatgactgacacttgcactgtggcgtgtcttccaatattaccatagtgttactca

SEQ ID NO: 12380 - DNA, 7785 bp, Human
agctaccgtggatctccttcccttctcttgggggccggggggaaagaaaaggatttaagcaaaggctccctcgccctgtgagggcgagcggcaaaggcccggctgagccccccatgcccctcccctccccgtgtaaaaagcctccttgtgcaattgtcttttttttcctttgaacgtgcttctttgtaatgaccaaggtaccgatttctgctaagttctcccaacaacatgaaactgcctattcacgccgtaattctttctgtctcccttctctctctctctctcgctcgctcgctctcgctctcgctctctctcgctgcgtcctcatttcccctcccaatcctctctcccctctgcaaccccccagctcgctggctttctctctggcttctctcttttcctcctccacccaccccctttggtttgacaattttgtcttaagtgtttctcaaaagaggttactttagttagcatgcgcgctgtgggcaattgttacaagtgttcttaggtttactgtgaagagaatgtattctgtatccgtgaattgctttatgggggggagggagggctaattatatattttgttgttcctctatactttgttctgttgtctgcgcctgaaaagggcggaagagttacaataaagtttacaagcgagaacccgagactggcccggccagcgctcctcatttgctcccgggtgccttgcagagccggtggggagcctgtcaccgggctcctgcgcctgctgaggctaggctgcagagaggagggggcgggggctggaggcaggtggtgcgagtccctcggcccaggggcgctgggggtgagggaggcggctgagcctgattggaggagagaaaaacgagggaggggagccaagagaaaccccctcctctcgcgttccgaggctgcccggccagggaggccagggcgcccaggccacgctggagacctgcggctgggctggtggctgtgtcccccgccacctccctctttgttttgctgtgtgtcctcccaagatgtgtgtcgggaggtggggtggggggcaggcataaaggtggagtgcaggcctgctgagcatactttttttccctcggactgttgttgttgggggagcaggaggagaagggagaccgctcttccctgcctctccctctcagggacttggccaccttcgctctgttctgaggccatggctctctgccttccttccttcgctgcctctgcttctctggtagtcacgctccactgaggcatccgcctccgggaaccgggagagcagcgcgcccgggccaacctccacccttcctttctctccccaccctcccaaccccctttttcttttactttcaaacctttttttttctttttctttctttctttctttcttttttttttttttgccaccagaaacggcagcgtccaaggcccgtgggctggatcctgtgccctaggagcacctaggaagacttgctccatctccgcccgcatatctggggcaccaagagagacagagtcgtgagccaggctcgcctcattcctcgtcttgggagaaccggaccaacttccccaaaaggccttgccgtgcagaattggcctggtttaataaagaacagacctgccccaagcacccacccacccagttgcgtgcattcaatccctgcgtttgtctctcgctcggtaacgggctgaagaggatgggtggagggtgacacggatcgccccgaggttatttattttcccttccactcaatctcttcctccccaaatctcgcctgcaagcggcctccagcccgcgggagtcggcagcggcccttgagcccccagccccaatccacagggctcggctttcccattcattattgatcatattttataaatccaacgccacacaattttttccacattaccgggagccgtggggagacggcccggccattggcggaggggacgtcacgtgggcggggtcacgtggtccggagaggaaaaagggggtcctttttggtgtaaatctggactctaattctgtaatatatcaaggaatctcgtaaaaccgacactaaaacgtccctgcctacaaatcatccggccaaattatgagttcattgtattatgcgaatgctttattttctaaatatccagcctcaagttcggttttcgctaccggagccttcccagaacaaacttcttgtgcgtttgcttccaacccccagcgcccgggctatggagcgggttcgggcgcttccttcgccgcctcgatgcagggcttgtaccccggcggggggggcatggcgggccagagcgcggccggcgtctacgcggccggctatgggctcgagccgagttccttcaacatgcactgcgcgccctttgagcagaacctctccggggtgtgtcccggcgactccgccaaggcggcgggcgccaaggagcagagggactcggacttggcggccgagagtaacttccggatctacccctggatgcgaagctcaggtaacgccgcgcaccgagctgtcctgagccccaggggccggggcacattaccctgaaggcgcctccttcccggctgggcgcccctttccgcgtccagagtgctcccagccggaggtcggccctggaaggctgcacccactgggccgcgacccagcaggccatccccgcccccatatttgctcggtgctctcaggctcgctctgcttcccggcggatctctcttcgccggcaccacggcgctgcgagcccccagcccgcccccacccttcctctcggccttttagctttaaatatttatcagcagcgccggcacgggctggagacgaggccgtttgtcttgcggaggaaggccggtgtttgcagagaatagccattagggtctcccccttctccccccttcccagctaaggatctcagccctgggtgtgtccccctgccccagctcggataaggtatgggggagggggccatagcgctaagcaattctcccctcccccttcctctccagccaaccccgctcccccattattcccatcaggacaattagaggtgggctctagaggcctggcgggaggagaaaaggacccagccagggacacagagctagagaggcaggtggagggagggggctgaggccaaaggagatgatcctcctgatcccagtgaacctgggtgggggagtggaacaggagaactagaaaggggcagaggcttcatgggagtgcagctggcttcctgaggtgctcttcctagggctcctaggaacccctaaagaactggccaagtttggaggtgtcattccagataagtgacccttttcttgggggaggggctaggactctctggagccaattcaaaaattagagagtgcagttcacctagccagctgctgcagaaccccaagaggctgaggttccatggggtccctgccgagtctgacccagacatccttttctgcactgttccaaagcagacgaacttaggggctagccccaaagtccagaagacccaagactcatggtcagaggcacccaacccagcgatggtcaggggccagaagcagcccagctctcataccatcagtattagtggttataggtcccattacctgctccatagtttaactgcctttccagttgatttatcaaagccccattttttctgctcatcagcatttcagcttggcttttatctgacttgaaactagggcccctagcccctcctcccttgtctccttcccaggagggctgacatcagcacctctttaaagtctcctcaggttctggtcctaatgcagaagttcccctctacccttcagtccccaccacccagatactccatgttccatcctatcccaggctgctgtctctccttttcccctgtgcattcctggaggcccaaggattgctttagagagctgggctgtctaggcaagcaggcaagcaggacagcctggccctggctgaagcttagccactcactggaaaagaatcatcagagggtcactgctgtcagaccaactctttgctccaaggaaatctgcaaattcttaccttctcattccacaacatgctggggatgagttggggggactgggcctttgaggcccctttgtctccttttcttcttgggaaacgttcttaagctaggcctggcgccccactccagggtcacttgcatggtttctcttggtctctactggaaagaccatcagatcagcattcagaaaagggggtttagggtccttgaccccagagagtgaaaggaggattaacctcccctcatcccacttgcaccccttaggtgcagagcctttaagagccagcagattactttcctgggttcagaagctccaggctaaaaaagacttcttggatgaaaaatgggaatgtttgctttgagaagcctgtagaaagttcagcaattaggggagtttgcagctggagtaagggctggggtatgaaaagccagaatttggtttagtgggaaaatgggcttctttgcccatcgcccattgacttcaaatcacatacacggtataagagggaggtggccactctcttggcgtttcctttttttttttttttttttttttttgagacggagtctcactttgtcgcccagactggagtgcagtggcgcaatctcggctcactgcaagctctgcctcccgggttcacgccattcttctgcctcagcctcctgagtagttgggactacaggcgcccgccaccacgcccagctaatttttttgtatttttagtagagacggggtttcactgtgttagccaggttggtctcgatctcctgacctcgtgatccgcccgcctcggtctcccaaagtgctgggattacaggtttgagcccaccgcgcccggccggcgttttctttactcactgattttcctctgaatactgtgtgcaggaactgaccgcaaacgaggccgccagacctacacccgctaccagaccctggagctggagaaagaatttcactacaatcgctacctgacgcggcggcggcgcatcgagatcgcgcacacgctctgcctcacggaaagacagatcaagatttggtttcagaaccggcgcatgaagtggaaaaaggagaacaagaccgcgggcccggggaccaccggccaagacagggctgaagcagaggaggaagaggaagagtgagggatggagaaagggcagaggaagagacatgagaaagggagaggaagagaagcccagctctgggaactgaatcaggaaactcaaatcgaatagggaagtaaaaaaacaaaacaaaaaacaaaaaaaacaaaaaaaaaaccctatttaaatgaaaggagtttaaaaacattttttaaggagggagaaaggagaaattttggtttttcaacactgaaaaaatactacctataggaaagtctgtcaggtttggtttttttgtacaatatgaaaaggatattatctacctgttctgtagctttctggaatttacctccccttttctatgttgctattgtaaggtctttgtaaaatcttgcagttttgtaagccctctttaatgctgtctttgtggactgtgggtctggactaaccctgtggttgcctgccctcctgagcctccgccttcccagcagcggcaccaaggggccttagggagccccaaaacctaccactcgcgtgttccccaagcgcctggctgctgcttcttgcttcccgtcccccagccccatgctcccttttacattctgtgtgtatctaaaggatggaaaaataaaacgcaattaaaaataaacagatgccctattttctgtgtcttcctaaagctgggaaggggttcagggttagagatgagtgggcatcccagagctccttggctctgacttctgatgcagcttcatttctgtgctgagtttgttctttttcttggtgcctcctgctctggggggctgccaagtagtgaaccccgatattgcactcatgcattccctttacacccttttacacccattgacatacatgatgcacacagtcacatgtgtttacaggctgacatcaaacatacacactgtcacagtcacaaagagacactcatacccatatgttaacaaacatacaggcattcacgtaataccagcttcacgcccagaacataggcattcatgttcacacacgctcacaagtaaacacacattcacactcacagacacattgataccaacgtacattcacacattggcttataaacacagattcacatttgcccccaagtaaacgcactcagaagcccacatgcttagtcacacaagctcacaaaacaacaaaacaaaaacctcacagtttcacaaacccgcgtcctcattcaggcctggaaaccaagctgcgggatctggatctgggctgcagcccaggcacaaagacggagctgaaatccaagctgctaggccccacatgaaggaagagcggaaggaaagggaaaatgaacacccaaattcactctggcttcttgggtggcgttgcgtagaggccaggcctgggagtagaggcctctcagtcggcgcagagcagcctccaactagggcgctcacggcttcctgctcgcacggcaaacattttcgccaagagctattcctatattttatttcgatttattttactttctttgtcttaatttatctcgttctaaattgatacagacgacccaaataaaactttaaaatagggggtggggaagggaatgagtccgggagcaagatcctaagaggtgcgagtttaccaggccggtgtggccgcatcccggccgctctcggagcctgaccacgccacgcccggggcttcctccgagcctctcttcccgctctctgcgccgccgccggcagcctggaaccttctccgctgcacagagagagaggggggaaaatgttgggggaggttatttcgtttccagaattcgggcattggtaggtcaacttgaaatacggggttatttcaggggacctgaaaaacctgggctgaatttttattttattttttgcttccaaacatccgctgattgcaggaccaaaacttggaggatggtgtctatgcggctagacccgctgaattgatttttagcatttattcgattataaactctggattgtttaaatttaaacagactttggatagaaagagggaagagggttggttttaggataatctgttgaatttgaatttgtatgtaaaatgcttttaaacctgcagtttcccccattaatgaccacgtaacgccctggagagcgcatggagctgtcataggaaacctggacttgcctgcatttgggcgggagaagccaggatccggctttaccctcccccagtttctgggttccggaggcgagaatcaggttgtcagactatctgccttggcccccatccaggccacttttcctcctggggcaaaaactaagccctagggaatctaaggcccccacgcctgcaatgctgcaagcctcacaggtgggggtcctgctgtctacagggctaggaatgagggggccagttcagagggggagaggggacactgaagctttcattttgcccttatgcaggtggcaactctagacaccgtttcctgctcctgcctcaccccaaaattgtctcagaacagtccctatgcagaggatttggggtagacctttactagaagagggagcagagctcctgtggagagtggggaggttcggaaaagaacccccttcccagctgtaccgttatggtttttgcactctgatttcctgcccccccaaatct

SEQ ID NO: 12381 - DNA, 11089 bp, Human
atcactcttgtatgtagaaccagctgaccccccgacacacacacaccaacacacacacatatacacatccaatggtacctgtttggtcaacattgtccaggtgctgggctgaatttataggggcatgtttctggcatttcctctttcttttctcatcttcagcagagtcactgccaacaagagcctgtttgtggcatttcttcttcctttctacttcttcctcagagtcactgcaaggtgggccctgtttttgacatttcttcttccctttcttccctacttcagcagaggcactggcaaatgatgcctttttggggcatttcttcttcctttcctcctcctcctcctcagagtcacttatacataggctggggggatgctgggaaagagatgctgcctctagggcccgtaatgtggccaagagctggcggcgcttggagccctggaggaaaacaggggatgacagtgggcctaaagagaatggatgaggcctggagaacaagaagggagagatgtggacctgattcagactggcagaagcatctgaattcttcccagtcaagcctgccagaacccagaagaacttttatgtcaccaccccaacttctgggaagctggagagcagagaaaccacctatcccactttcttcaatgtgtaaatgagctaatggaggtttccccaaaggaaaatgcaaaggccacaagcaacaagaccaaggccagagaccaggaattccaacccttcaccttgagcttttgcctagagctgatacatttctgtaagaggtaaggaggcttctgaacacaggagacacatgatcacacacgtatattaaatatttaacatgtctctagctgcagtgtagaaaacaaactgaaggggagaaattgcagacagagaggccagcggcttggacaatggtaatggggctaggggatgaaaaaggaggaaacaaagcaggccgattccatgttggaggcagactgaagggtaagaaaagcctgaggaagcagggccctcacatctgcagaggctcaaaggagaagatgtattgtcgggaaggctgattctgtgttgcagtcctaccaggtaatcctaggccaggcacttaccctgattctaagtttcccacaccctcctttgaacaatgatactgacaactcttactgtctccaatccatcctccacactgtaaccgacgaccctttcaaaatacaaatctgaagaaataattccattgcttaaaacctttcattggcttctattctcaatatacgcaaaacttctacctcttgaacttgaacagcatatatgcccctttcatttactatgtatttcaaccacaaggaccacttgtgtttgtgactctgacagaacatgctctcttgtcccagggcccttgtacgtactttttcctgtctgaagaaccctcttcgcttcaccaacttctactcaacaactctctctgacccaacgtcagtttcttttggaagttctcggatcttcagatcaggactcgcccttaacggtgccacaggtgtccctccccgcaatacacacagcgctgggatccaccaatgtccgcttcgcggcctgaaacagctcccattgctcccgcgagtcactcaccttgttttgcgaggaggccgcaggcggaggtcgtgagattacgggcccaaggcccgcggctactggggccgcctcggcccactcaggctcttcgaacatgagggtcgggagggcagggtcgccgagtccccgctcttctccacgtgcacagcgctcctctggaagtcggagcgctcagacctgccagaaccgacccggaaaccaaagcgtgacagccaggggttgctagagcggccggcgcggcgcagcgaaccatcgagtttaaccaggcgcggctagaagggcagggaggcggtgggaggggagggacggaggcccgcgctgcccaagagcgccacgggcggggcggggccggcggcgggctgcgggcgcggccggacgggagttccccggagaaggatcctgcagcccgagtcccggtgagtgcgagaggacccgcgccccctgtcacccctcacttctcctgagtcccaagtaaggaacggagccaaccctggggaggacccccggtcccctctcccagagtatacggagcctgaacctccccacttcccccaactctgttcgcggatagggtctagttgcctgctctcggacatccgttcagcagacactacctcttcgtcaccccctgcccaccctgacccgcctttacctcgcgtctagaggacacagccagggatcatcccgcagccccgaactccttcacagacccccactagccggggacgcagctcaggccccctacccccaacacaaacacttctctcctgtagaggataaagcttggggttcatcctccttccctggatcactccacagtcctcaggcttccccaatccaggggactcggcgccgggacgctgctatggacgacattttcactcagtgccgggagggcaacgcagtcgccgttcgcctgtggctggacaacacggagaacgacctcaaccaggggtgagctgaaacggttggtggatgagaggaaggctagagatctcctggctacgtggagtggagtgctcatgtctggtggtggcggctgcctttgctagccagtgtaatgagtgctaagcatagcctgtggggggcagagggttttcacagaggacgcagtttgagctgaatcttgactgcagaataagagtttcacaggcagaggctacagagagctttccagcctcagtagactgcatggccaaaggctagggggcaaggcacagagcagagagaacaggaaattgtctggagttccatatggctggaggatagatgatctctgtgggtcggagcattgggtacaagaggaaaagaacaggacataagactgtagaggtctccaaggatcagccagatcatgcaagcatatttaggctataagaaggtctttattttaaaagcaaggttttaaagctgtatagtgacataatgagattgtccatttttcagtatcgtcttggatgctttgtgaagagcaggtggaaaggaggcaattgcctagttcatcgtagaagtaatgatgtcttggactagaattagggtgagtgaaaaagagaagtgatcaaattccagaagtctttaggacgaagaattgtggaacttggtgtggggagtgagtaagggcaaagatgaggaccagggttctggcttgggaacttggttgtttttactgagatggagaaaactggaggatgaggcattttattttggacatgttaaagttaaggtgacaatacagcaaggtggaaatgttgagtgtgttgttggttatgcagatttgcaattcaggggaggaatctgacttggagacacagatttgagagctatcagcatatagatagcatatatatatcatatatatagatgatacttgaagacgtggttgtgaaggagaacgtctcaggagagtggaaggcaagaggtcaggggacaggaagcctgcacgacagaaaaggagcaaccgcaagttgaaaaagaaataggaaaatgtgtgagtaaagcttacagaagagaatgttttaatgaaggggaggtagtcaacggcagtacaggctactgagagatcaaagaacattaatattttaaagtagccattgaatttacagttgggttttttttttttaagttaaggggtacatgtgcaggtttgttggatgggtaaactcaggtcatggaggtttgttgtgcagatcatttcatcacccaggtattaagccgtggcacccattagttatttttcctgatccctccctcttcctacccgccccactctggtaggccccagtgtctgttgctcccctcagtgtgcagttaggatgtatttgaccatctgtgagtgttgtttcagaataatgggtgaagaaatcagactacattgggttccttaatttaaggcactatgatgaacaccttctgtgctgggtgctagagtccagaatctgacataatctctgctctcgatacagcagatttgtggcagattgaaaagtaggccgggcgcggtggctcacgcctgtaatcccagcactttgggaggccgaggctggtggatcacgaggtcaggagttcgagaccagcctgaccaacatggtgaaaccctgtctctactaaaaatacaaaaattagccaggcgtggtggcgtgcgcctgtaatcccagctactcggaggctgaggcaggagaactgcttgaacccgggaagcagaggctgcagtgagccaagatcatgccactgccctccagcctgggccacagagcaagactctgtcttaaaaaagaaaaagaaaacaaaagttgagaggtgagcaaatagtgaaagtgaatgtacaccagttctacaaggttggctgagataggaaggcaagaagagcagtagtgatggtgactcagagtggcaaattcaaattctttattttttaaaattggtggagtttagtttttaggtttgacaggtcaggatcacctgtcatcttagtctagacttcactggttcccattaggttctacactatttctctttaatactttgcaaagtcatttgttccatttttcatataattctcaaagggtaccctgataaagacagtaagcactgttactgttttgttggtgaggaaatagaggcttaggcagttgcccagtgggcctagcatctaggaagactctgagtctaggaagactctaggaagatgctgccagaaggaaaaggggtggaattaatgaaactggaaggttgtggtgctggtttgaggagtaaagtatgggggccaaagttggctatatgctggatatgaagagggggttaattccttgcaggtcttcttgagatagaagtccaggccctgaggtggcacgcagcctgatagtgaacagaacccttgtgcccatacttttgccccccgagtttggcctgccctagcgccacaggcagtactggaagctgataagtcagggcacaaattaaaggtctaggaggcaagaccaactgataaacagggggcgtaatgcttcctggggataatcccatctcaaggaaaagcttttggctatttctgtgttagcagatgcgagcaagttgtggaggaaaatgattaacttaaaggccacaccccccaaccccttcagctgtacgggcatctggatggccagacccctgatcagctccaggccttgcctagagtcgcacacaggaagtgaccacaacactaaggcatccggaggctgctggcccagaccacggaccgccccctgctccgccccttgaatctgcagccccgaactggagggaatttccttttatggccccaggctgtcaggcaggcccagctccaaaccaattgttttgttttgtttgtatactttactttataaaatacatatttcttggaaaagaaaaaaatcaggtatagttttaatcccaaaacagccattctcattttcttctgttttctatgcacaggattgctaagtaggggaatcctgctttgcatggtggtttgttatctacctcatcagtagtcaaaagcatttctccttttcaacataaacccttccaaaacatcatttaaattccattccatttttagatgttagtttcagtaccagagccaaatagtaagtttgttccctcttctataagttgtggcctgccttctccaagacacccttctcccccactaacatgcactgaacagctgctgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatggtgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtactcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctcatcataatggccttttcattccaggacctggtggcaaatggggcccttgtcagcatctgtaacaagtatggagagatgcctgtggacaaagccaaggcacccctgagagagcttctccgaggtccatctccccatcccctagcttgtgtcctctcgtcccttcccacctgtcttctccctctgtaccacagcttaggttgtttttcttccctagagcgggcagagaagatgggccagaatctcaaccgtattccatacaaggacacattctggaaggggaccacccgcactcggccccgtgagtcaccactgtgggaagaagggttgtaaaaggaaataatcctggcctcttggggctgggttagggtgaagctgggtacctgacctgcccacactcttaggaaatggaaccctgaacaaacactctggcattgacttcaaacagcttaacttcctgacgaagctcaacgagaatcactctggagaggtgacccctgcccttcttgcccttccctcactaaacccccataaattacttgctttgtacctgttttaagtttttcctccagttagtgggcaaggaagtggcagcaacatttcaagcctcctaacccctacctgtcctgcagctatggaagggccgctggcagggcaatgacattgtcgtgaaggtgctgaaggttcgagactggagtacaaggaagagcagggacttcaatgaagagtgtccccggctcaggtagtgcaaggcgtaacctggaagctgctagttccaaggaaccctgaatagcactgaaagagatcttttgtactgggtctcaaccactccctccctcttctaggattttctcgcatccaaatgtgctcccagtgctaggtgcctgccagtctccacctgctcctcatcctactctcatcacacactggatgccgtatggatccctctacaatgtactacatgaaggcaccagtgagtagggatgttgaatttccttggggaggaaatggcagagagggagcctctctgaactatttgacttttgcctcctctcagatttcgtcgtggaccagagccaggctgtgaagtttgctttggacatggcaaggggcatggccttcctacacacactagagcccctcatcccacgacatgcactcaatagccgtagtgtaatggtgaggccacaagctcactcctggcccaggccccaaaagccctttgcctatctatgacttacctccttctatctgttttctcttcctcagattgatgaggacatgactgcccgaattagcatggctgatgtcaagttctctttccaatgtcctggtcgcatgtatgcacctgcctgggtagcccccgaaggtgagtgaagtcatcatgtcgggaggtaaaaaaggaccacctcagaagtagtggaagggggcagagacaggacaggcaagggggccagaacagacaagccctatctctccagctctgcagaagaagcctgaagacacaaacagacgctcagcagacatgtggagttttgcagtgcttctgtgggaactggtgacacgggaggtaccctttgctgacctctccaatatggagattggaatgaaggtgagagcacaacagcatacatttgtgttgcgggagtggttggtgatggtgaaaataactgtagtgggccttggctcctcacatatttgttcggatatacagtaatcctgtcccaagggccagtggcttctctctacatgacagactcaaattgtgaggctgctttttttcttgtattcgcaggtggcattggaaggccttcggcctaccatcccaccaggtatttcccctcatgtgtgtaagctcatgaagatctgcatgaatgaagaccctgcaaagcgacccaaatttgacatgattgtgcctatccttgagaagatgcaggacaagtaggactggaaggtccttgcctgaactccagaggtgtcgggacatggttgggggaatgcacctccccaaagcagcaggcctctggttgcctcccccgcctccagtcatggtactaccccagccatggggtccatccccttcccccatccctaccactgtggccccaagaggggcgggctcagagctttgtcacttgccacatggtgtctcccaacatgggagggatcagccccgcctgtcacaataaagtttattatgaaaacaggctggtgtggggacatggggacagataagtacatttaggttgggtggctcaggtgaagtagtgcggcttcttcacattgatgccatactcgctgagggcaggggtcaagtcctccatggttagagtgtacttgcggtcctgagggaagagggaagagcaccaactgagcacaggaatcccggacttcaatcccagatgggtgaccctgagtaagtcttacacctcccctacgattcagtttccccaaaggggtggcaggataagcctccactgttgtggaaggtaattactgattcattaagcctcccctcacaccttgctcttgctccgggagctgccggaggccgtgcccttcattttgcagtgctgtagggcatcattggcaatatctgagatgaatttctgggcagctaaggagatgagccgaattctagagagaaaaaacttagatgagaaggagatggacaacatactgcacaagcacccaaaactaacctgccctgggtttactcacatgcgtgggtctgaggcctcaaagccagcacggttcaggtagtaaccagtcactgcatctgggatctgagaaatcaattaagagaactgtcagcagagcgggaggagggtgagggaaatggataggcctgattatcaggaagctcacagtttgggtgagcagagggcaaacacagaagagcgactaggggagcaaatggaagagaacgctgaaaagcacgatgtggctgaaagttttgacagcaggctaggtggccttgttcgggcggaagcccaccgtaggcgtgtaatcttccagctgcatcaagaagtccaccaaaggcgtgctggacaccacgggcttcacgtctccgttggccgcgctcggcagtacgtaaaccccgttagatatggccccctccgggggcgccgcgccacccgccgacaccggagctggaggagaaccagcaaaatgagacacagaggtgggaggcgcagggccccagctaggtctgtctataccctctgccctcacccgccgctggacccagcccaagacgcttccctcgccctcacccgtcccggccctcacccgccccacgccgctcagctggctccccggcccgcgccgccaagggtcccgtgcccccagcagctgctccagccccaggtccccccgctgtccccgcggggctggccttgttctccgcggcggtgctggagggcagcgcggcgggagccgagaccgggggcgcggggcccggggccgaggcggcggaggccggcgccgcctcggggtccgcgccggagccgctgcagctcatcgggccggtgggagaggcggcgaacagagccgcttccgcttccgctcgcgccgcgcacaccccggggtgacgtcacgcgcccacgactcgccccgcctgtctctgttagtgctctccagcccgctccccgcctcctcccatagtggatctgcgggttagaggaaataggctgcagggcggagaccgagccttggcgaactgcgctgccgtagccattccgccctagcctctgccgtgctccgcggcgattccgtccagaccggaaccagcgtgcgtctggctctcctccgccgctctgggacacctcattctgtctgacgctcaagacctggcttcgacgtttatggccctatgtccctcgactacgggttgcctgcctgtctgcatcgtttcaagttcccttattcagccttttaaggattcatagtggatttggaaagccccctctcttctccgccagctgccccgagaggtgggggcagcagtggggcggcacacagtgctgctgtaggaggaggaggagtttcagcctgagtcaacaacatatgcaaaaatcacaacgaatgagaggcgtgaggttttcggtgtagcagacatttaattcttatttgccaactcctgagctaggacctgggaacacaaagttaaataggacacgattctagtcctctaggcac

SEQ ID NO: 12382 - DNA, 38772 bp, Human
ggccaagtgctgattccaccatttcttagctgtgtgagtctgggcagcccagtcatccatctgagcctcggttttgtcatctgcaaaatggagacataattcttacttacccatcctaggaaagttgtgaggctcagagaattgtgtgtgccacagctaagccctgggcaaagcagaaagatgagtctggttgacagctatgaccccatccactctactggtctacaacactctgaccgcttgttccagaagagggcacatcttttcatatgtacacccctccccatcttttacagctgctcctgctcccaggatgtgtatctgactggagtttctggattaaaggccagtcgtggcttcattccacatccctgggtgcccttcggctcctcctaggagcatctcctgcacccaccccccagggccccacctccaggctgcagagctaagacctaggggcccctcctcagggaaccctcgccgtctttggaagcagccagcagagacgctgctgttaaggtccatgcctgtttctgcccccatcctgctgctctgggccatgggaataaccagtggggaaggagttctggcccctgggtgttaggaatgtcgtcctccaagaaattgcattaaccctctgagagaccagcagggcgcagccatgaggaagactgggcatcaagatggcacttgggctggctgccctgtgatgtgcaccagcccggagacccacgtgcctgcttgccaaagaggctcctttggggaatgaggagcccctgattcctatttccctaccccaaattcctcggaagcctccgcctctgggggatgagaaagggaagcaggtgggtggaggtgaagggggcagggagcaggtgggaggagacccgaagaaacttcaaggaccttatttaagagccttgccattgctgtgaagaaaaatgacttgaaacctctctagagaagagtgtggctaattggcatgtatgttggaggttaaagagcggaaggaagaatctgattgtttttttaagttactgagaaagtgagaatgtcactctgggcagagagaaattctttttttctagagtgtgcctttctttgtactgcagaccacagtgggccgctgagacttgcaaaaaagatttcttttaatccaccttcctttttcgcaggcagcagtagaagggcctttaaatcaaatgcaatcaccaagcttgtctcttgctcttattcctcacttcactccctggaatttggcatttgatggattctggatctgacttaaggctttttctaaatccaagacttggggaattttgttaacagtgcaataaaaataacttcatagtgttacaggaggcacattaaagacggtgtgtgtgtatgtgtgtgtgtgctgctctctttccttaaaaaaaaaatacagacaatgtttctttaaaagtctccatctgcaaatcccattagatgtgcatataaggtttctgatgattaatagttgcctgctagggttttggttggaggggatcttgtgtgtgtgggttaacccctccctctcctctctcacatttcacttcagaaatttgtcactctctccccaccgcaggatttaaaagtgtgtcccagcagccctggtccagccctctgcaggcatttgctctgggctccaggacgaactcctcgtcagctggtgcgtctgggttgggacagtgaaaatgtttagtgtcattggcgacaaatacacatacaggggatcccagtaggtaggctggtgcattggaggggcaggagcaagcccgacataggtgtgtgcacacacataggagtagctggccacatgtgtgtgtactttaaggagagactttagttttgggtttttttttttttttggttcctggggtaaattttctgttgaacatttttccctcctatttagttttttttcttttgcatttttaaaaatttgaacataaaaagtataaagaatcaaatctttgaaaggaccgaggcgtgcagcggacagcagatggatcccgcggccagcagctgcatgaggagcctccagcccccagcccctgtctggggctgccttcgaaacccccactcggaaggcaatggggcctcagggctaccccactacccgcccaccccgttctccttccaccagaaaccagacttcctggcgacagcgacggcagcgtaccctgacttctcagcctcctgcctggcagccaccccacacagcctgccccaggaggagcacatcttcactgagcagcaccccgctttcccacagtcccccaactggcacttccctgtctcagacgcccggcgcaggcccaactcaggcccggcagggggttccaaggaaatggggaccagcagcctgggcctggtggacaccacaggaggcccaggcgatgactacggggtgcttgggagcactgccaatgagacagagaagaaatcatccaggcggagaaaggagagttcaggtaggtggctcaggagcagctgatcattcctttactgtgtgaccctggggaagttactcaccctctctgtgcctaggtgctctgagcatgaatttctgtctagtccatccaaatgcaggagactggaccagttacctttggggtttcttccactgagagttctaggattctctggtgatggggaccatgtctgtgtcccagcactcctgggccccagaaagggtgtccagcaagagaatgaaacaggatcagccaggatttggaggacacgtgaaatggatcctctgggtgcagactggcgagggctggtgaggggctttcctgaatcaggctgccattgagtcatcctcctccccaccatgctttggccagccccaagtggtcctagagccacagggctcgcttaccagggaagttcagctgaggttaaggctctgagagctaagactgaagctgggaccctgggtggccacccaaagccaagaccctatgtgtccaggagcctagaggcagagaagcaggcctgcggctgggatgggagaatcaaggggtgagggggagatggagggctgaggtttggggcagactgcccaccagatatcaccctgcggagctgggccatgtccaggccaaggggacagacaactcagcatgctgagatctggctgaccccccaggaaggcagccccgcaaggagctgcaagggatgggcagcctctgagagagtcagggaggcaggcagccaagggagtccgtgctggagtcccagaggctggaggatgagattggcctatttgttaagattccagctaaagcccttctcttccccagggtggggacctgctgcttcctcacctccccaccaggccctccctggttgctcactatacctgtccaccttttgtctggttccttgtcccggcctcgttcagaacaaagcagtgaccaagcctcctgcccgtgctgccctgttttcctcctgacagccgccctcaggggcacgcctgtctgtcggagcctgtagaggaccttcccatggggctaaccagggcaggacagaaaagaaggacaccaaccaacaggtgggaatgctttgtgctttgctttataagcacagctttcccgagtttctgctcttagccaagcccaggaatgctctgagatgaataaaggggtctcacccaagaaagctcaaactgagaggaagaagaggcctgcagaggtgtgtcagcagtgggatgtgccctgatggggaggcttaaggtgccatgggatactgacgtcagctcttttgagtcccacgggtttgggagatggggacagcaggttttattagtaccttgattctctcaatctgcaaaatgaaagactgaaagttggtgagaacacagaaagaatggggtcaaactagagtgagcagctcatctccatttgcccaggacttttccagttttagcactgaaaatcctgtcgtaggaaaccccacagtcccaggcaaacagaagaattggtcaccctagaagtgagctcaaaccccaggcttcaggcccccggtatcacccccttcagtagatttcaaatgcagtcctcattttgaaatgatgtttggtctgtctgcttgaagaagccccttcttcaatgggagataggaactctagcagccctcatggctgctaaatagaagggccctttaaaccgccagccagttagatccccatcccgaaaattaactcatcctgcccctggtaggaaatgtgctaaggatgagaagcaactctcagcgacttggctctgaacctggttgaagagctttccccttggtggcggcacgcagcactgtggctccttcctctctgccactttccagagaactgacagccaagggcattgggaagggatagcaaagccaagagcctgctgggctcaggcagaatcttccagcattccgagtctcagcaaaacccaaatgcaccagctctctttttggcgagtggccgatggccctgcaatgcagagagaccattcacactaagcagctggccacccaggagtacagggacaccctcggctgaacggcctgcatgcttcagggtcagactttggtggagggaggttcccatccgcaggggccctgggcttccctaagggtcccctcaggagcaccagcagcagatgaggcagggcccagtgagctgactctcactcatccccctgtgattccagacaaactcactgttcagcatggaaatctttattgccgcaatgcttgcatcctcctttggaatttaactgaaggggaggaaggaggcaagaaagatcagctttgtaagagcccaaagaagggggaaagtgacgcaaggctcatgacctactccaggaatctggaattcagctcagaaaaggcaaacccacagagagccccccacccaaccctgccaatcctgagtctataattggatcccctctccaaaattgtgatattttgttcattatcaattttttgcattacttttgatttttacaaatattgccttaaaatattcttttttttttttttttgagatggagtctcactctaacgcccatgctggagtgcagtggcatagtttcaattcactgcaacctctgccccttgggttcaagcaattctcctgtctcagcctcctgagtagctgggattataggcgcacgccccctctcccggctaatttttgtatttttagtagagtcggggttttaccatgttggtcaggatggtctcaaactcctgacctcgtgatcagcccacctcggcctcccaaagtgctggcatgcgccaccgtgcccggccttccttaaaatattattgatcttgactacagaggggttgggcatgcccttgcatttgggcctccccaagtccaggctgagtggtccctggaaggttaaccagcattgatcagaaacgcgttttccatagttcttcccagccagacagacaggctgcagtgtcagcacggcaacttttggctgcatgactttggaaaagttcataacttcttccagcctttgtttccctggctgtaaaatgggcatatagcagtagccccttccatagagagtctctctgtgaaggttagatgcagtgatccatgagattaactctgtgcctggcacatagtaagagttcaataaatagcagctgtaaatggtattaggcccatatttcctgaaccagccttcagaatataaggtctgacaaatatttctatatttatggggatggtggaattgaatatttcaattatgctgtctcagaaattcctgagtctagagaacttctggcaatcattttgttccagttgtcatcaggagcatggagctcagagacctgccggagaggttatggggtgagttgggcctggcaaatgcaccccatattgagtggctgagaagcctccagaaatggaaagtttattgtaagaggaatgttctctgcgcttccttcctcctttgccatctccttcaactgctccccgctcactcccagtagaatctggagctgatctactcaaagaaattatcaagaaagcaagggttggccgggcgcggtggctcatgcctataatcccagcactttgggaggctgagccaggcggatcacctgaggccaggagttcaagactgacctggccaacatggtgaaaccctatctctactaaaaatacaaaaaaaaaaaaaaaaaattagccaggtgtggtggcaggcacctgtaaatcccagctacttgggaagctgaggcaggagaatagcttgaacttgggaggtggagattgcagtgagcagagatcacgccactgcacttcattcagcctgggtgacagagcgggactacatcaaaaaaaaaaaaaaaaagaaagaaagaaagaaagagagagagaaaggaagaaaggaaggaaggaaggagacagagagaaaaagagagaaagaaaaagaaagaaagaaaagaaagaaagaaggaaggaaggaaagaaagaaagaaagaaagaaagaaagaaagaaagaaagaaagagaaagaaagaaagaaaaagaaagaaagaaaatgaacaaacggggagaaagaaagaaagcagggttcctggcctttggcacttccccaccctggagaccagcatggtgttatcttacccaaaccactcccagccccaggccaatggggattaaagacccctgctggcagggacagctgtgaggccactgttgttttcccccaaactgtccttgctactgtggttgtctttaatttatgggaatgaaggattttgcggtggtttcctcatggggttcaagggaaggttgcgtgtgattagagtggctacaggtgaatccgatcgcccgcctgggaaagccatggtgctagaactcagcactgctccctcctgctctcacgtcctcactctgctgagacatgcctttaatcagacgtgatttgtctcatccttcttcagctccaacacgtgtgttcccagagctgtcctgccccaatttctctttgcaagacctgctctatgcctgcctccgcccaaccacaaatttgcctaaggtataaaactccacaaataggcctctctcctcttttccctcctgatgcccctttacaggccacctccccgccccaggtcccctccactacccctgccacgaagccacacccagggactgaccttgcaaacacatcctgcattttcttccccctctctgactgtgctctggtggtttctccttgcctagagcactctccccttccccgtacttctgcctgttgaagtcctacttaaaaaccacccagctcaaaaacaaccccttccaagaatatttttgttcttctttttcaaaaatttatagctacatttgcatataacatagtatcaaagaaagctacagttaagaaatgtcgaagtctagtatctgctagaatctgtgttgattttctcactttagcttgcagttgtttcataaaggaactcttctgaggtttcttacctgggacatcttatatttgaaatctccttttttaaaaattggggtcaaatacacataacataaaagttaccgtcttaacagtttttaagtgatacagtacagtagttgtgcaatcgatttctagaacttttaatcttgcaaaaccgaaactctatctccattaaacaacgaccttttttcccttcccccaccccctagcaatcaccattctttctcttgctaaacatttgactattttagataccttacataagtgaaatcatgcaatgtttgtcatttttgtgactggcttatgtcacttggcataatgtcctcaagtttcaaccaggttgtagcaagtgacaggattttcttcttttttttttttttttttttttttagaaagacagggtcttgctatgctgccgaggcaggtgttgaactcagggcttctagcagtcctcccaccttggcctcccaaagtgctggaattataggtgtgagccaccatgcctggcctccttctttctgaagacaataacattccattgtatggatataccaaatttctttcttcttttttttttttttgagacggagtctcactctgttgccaggctggagtgcagtggcgcgatctcggctcactgcaacctccgcctcccgtattcaagtgattctcctgcctcagcctcccaagtagctgggactacaggcacacgccaccacgcccggctaatttttgtatttttaatagagacggggtttcaccatgttggccaggatagtctcaatttcttgaccttgtgatctgcctgcctcagcctcccaaagtgctgggactacaggcgtgagccactgtgcccggccaccaaatttctttatccattcatctgttgatgaacatgtaggttgcttccacctcttggcagttgtgaataatgctgcaatgaacatgagtgtgcaaatacctcctggagagtgtattttctttttctttttcttttttgagacggagtctcactctgtcacccaggctagagtgcagtggcgcgatctcagctcactgcaagctccgcctcccgggttcatgccattctcctacctcagcctcccgagtagctgggactacaggcgcccaccaccacgtctggctaattttttgtatttttagtagagacggggtttcactgtgttagccaggatggtctcaatctcctgacctcgtgatccactggcctcagcctcccaaagcactgggattacaggtgtgagtcactgcgcccggctggagagtgtattttcaattcttttgagtgtatacctagaagggaaattgctatattatgtagtaattatatttttaattttccaaaaaaattatttattattagaataaaatatagagacaggggtctcgctatgttggccagattggtcttgaactcttggcctcaaacaatcctcctgcctcggccttccaaagtgctaggattacaggtgtgaaccactacacctgaccatatttttaatttttcctttttctttttttttgagacaagagtcttgctgttgctctggctagagcacaatggcgtgatcacggctcactgcaatctctgcctcccaggttcaagtgattctcttgcctcagtctcccaagtagctgggattacaggcgtgtgccaccacacctggctaatttttgcatttttagtagacaggggttttaccatgttggccaggctggtctcgaactcctgacctcaggtgatccgcccgccttggcctcccaaagtgctgggattacaggcatgagcccctaatctccccttcttataagcatatcaggcagattggattgggacccaccctaacagcctcattttaacttaatcccttctttaaaggccctatgtccaaatacagacacactctaaggtactggggttagggcttcaacataggaattggggagggaagcacaattctgcccttatagggactgtacaggactgtacggggacaggaacaagggacaaggttcaaactgtggcacagacccttcagttgaaaacccctttagtgaaagcagcacccagatgtgtgcctgaccccagagctttcctagctcagggtcctgtcggctggtagagcttttccactgagacaggaagttgtttctagccacaagcagatccctgatttcctatcttacaccaacaagtacagacataaaaagtggaggcagttggccgggtgcggtggctcacgcctgtaatcccagcactttgggaggccgaggtgggcggatcatgagctcaagaaatcaaaaccatcctggccaaaatggtgaaatcccatttctactaaaaatacaaaaattagctgggcgtggtggcatgcgcctacagtcccagctactcaggaggctgaggcaggagaatcgcttgaacctgggaagtggaggttgcagtgagctggatcacaccattgcactccagcctgggtgacagagccagactctgtctcaaaaaaaaaaaaaaaaagtggaggcagttttaggagtgaatctctaaagaagggagctgtttgacagaggaaaggagaaaagaggcatgggctggatgcggtggctcacgcctgtaatcccagctatttgggaggccaaggtgggtggatcacttgaggtcaggagtttgagaccagcctgaccaacatgatgaaaccctgtctctactaaaaatacaaaaattagctgggcgtgttggctcacacctgtagtcccagctaatcaggaggctgaggcaggaaaatcgcttgaaccagggaggtagaggttgctgtgagccaagatcgtgccactgcactccagctggggagacagagtgagattccgtctcaaaaaaaaaaaaaaaaggcaatggtaggctgggcacggtggctcacacctgtaatcccagcactttgggaggctgaggctggtgaatcacgatgtcagaagatcgagaccatcctggctaacacggtgaaatgccatctctactaaaaatataaaaaaattagccaagcgtggtggcaggcgccagtagtcccagctacttgggaggctgaggcaggaaaatggcgtgaacctgggaggcacagcttgcagtgagccgagatcacaccactgcactccagcctgggcgacagagtgagactccgtctcaaaaaaaaaaaaaaaaaaaaaaaagcaatagtagagatgagaatgaaataaatggacaaccccaataagtgtcacctgggtcgccagagtgatgccaagtcccatacaagtgacctcatgcccatgctcaccttcttgctgggccacggtacagtaataggaggaagggtggtcagagactaaggtcaagcgaattaacaaggtagccctggttcaggtccctgatccacaacttcctggctgtgtggacgtgggtgagtcctaaccctccctgagtctcttctgagaaatgagggtaacagtacctacttcataaggtgggtagctgtgagactaaatgatatcagagatgtagagtccacagccaacacttggtaacccctggctccagttttcccaaacccacatatgagcacccctctctctttaaagtcctcccctgatgctggctggctgcatcaggtttcccacgttcaaaaacaggccaaagtgtcctgagctctgctgaagtctttgccccctgctgtcagccgggcctgcctgactctgacgatgctactggcttagggttgtggcagtgctgggtggggtgtggtttgaggggtgcaccgctgcagcagctcctcttgtcccgagtccatgtccagaacccctagtgaggaagaagttttatggtccagagtggccagcgtgggaggggagacagcaactccacactcagccagtatccctctgggcatccccggcctcctgattagagctcctgacctcctcttctgacaagcaaagaaagctcagagcccaaagcaggacccaggcctcggccaccatctgaactcagaggctccagcacaaatcccacgcctgggcctgctcaggcccctgatcaggtatagtcggaaactctggagaaagtccgtttctgctgaggcagcaggatcctgaccaacatcgaagagggaaagatccaatgagcccgtgagctgtaagaaggtcagcccaggggtcacctcagctctgctccgccactctcccatgctagggactcaggattcctgcccgctcacctatttctctggcttgaataaatcacgggcacttgggcccagggaggggggataactcagaggcagagaatcctttctgcctgagagacaggactcacagcccctgcagacctccagagctggcccttttccccaactccctctctgcccataacttgggcttctcacccaatttggctccctggcctctggccaggacccacccccttccttttcttttctttttttttcccccttgtttttcttgcatgcagaggtacaggaacagcgtgagcagtgggcctgggtctcaagcccacacttcctttggtgacagctgagggtgacatatggaacttataaacaaaacccagaactacccatgcctctccccatcccctcttgaaagctgctgcgcttccccctcaccaacccaccccgcctgggactctcagcaaagactatagcaccagacttttttttctgagacggagtctcactctgtcgcccaggctggagtgcagtggcacgatctaggcttcctgcaagctcggcctcccagtttcatgccattctcctgcctcagcctcccgagtagctgggactacaggcacccgccaccacacccggctaatttttttgtatttttagtggagatggggtttcaccatattagccaggatggtctcgatctcctgatctcgtgatccacccgcctcggcctcccaaagtgctgggattacaggtgtgagccaccgcgcccagccagcattacgcattttcattccagaagaacctgcctctctcccatgaaatatcccttgaattccctggccccagagaggctgggagccctgccgatgtctctttaggcacctacaggagaggaaaagggcctggacactggggtggggcagggctcagtgagacagtcaggccaaccccaggaagccagggagatcctggatgtgaacatccaaccagtctcgggctggctccatcccagtcttgtctatttcgacgggctttgacccctccttctgaggctgaaagtaggagagcttacggggacatcaaagtgtctatgctgtgacagtgcaggaagccacagacaccgttttccgaggatttgccaaggtttcacctactgatgtcatgctccaaatattcccttctttttccctctctggggagtcccagggagagagatctgaacccagactcagacaatgtccctaagataggcacagcctccatactcatcctcccccgagggcagcgtgacatgaggctatagccctagactggtcccaggggccttgggcaagtcatttagtctctggatcttaattgctcatatgttcaacgggctaatgtgtaccttacctacctaatggaataattaagaggataaaataggagacagcccaatagggtggaaagagcttcctaacaagaaaatctgggttctaggcccaattctgcccctaacttgccgtgtgtccttacaggagttccttaccttctctaagctcacctataaaatgaaaaggtgacattgatcatctctaagtccctcccacctctactttctatgattctgtagtatctgtgaaagcctaaaagaagttctctttggaggaaagaaatcccttgtcaactgcacagtgctatttgaatgtgaggcatttggcatcctgtctgatttggatattaatttatgtaaactggtgccctcagagttggactgtagagtacagaactccagaaatgttcagacagggatgggtctgtctgaacctccctgtagctctgataaagctgtctgctcactttacgaaggcctgccaaatgtggcagctacatatgaaataatttgccctggatggtgtggaagctcatggtggaaaccgcaatcacatgcacaccgtttgcatttctctgggcatttgactgttccctcacagccctgctccagcagagggtgagggctatgcaggggctggggtggggcaactccttcctaatcacagaggcagcccactgagggccagcatcctccctccgcagttctggaagaggcatctgcggcccccaagagagaagcagcgcaggagtgatgtggattgccatgtgacacatctagttgttgtgcctggaattgtggaactctgaaggctgcagcaatagtggcctaggccaggtgcagtggctcatgcctgtaatctcagcactttgggaggccgaggcaggtggatcacctgaggtcaggagttcgagacgagcctggccaacgtggagaaaccccatctctactaaaaatacaaaaattagcctagtgtggcggcaggcacccataatcccagctactccagaggctgaggcaggagaatcgcttgaacccaggaggcagaggttgcggtgagccgagatcccgccattgcagtgaccaatctccagcctgggtgaccaaagtgagactcagcctcaaaaaaaaaaaaaaaaaaaaaaaaaaagctgaaaggccagacatttaaaagataaccctttcacacaggtctggagatgtggtgccttaaggagcatagtgctctaactctgcccgtgagtcatctcagatataatctccaatagaactctttctgatggttcttgtgaacagagcttcagtgacatgccaggcactgtgctaggtgttaacgcccgctatccagctcctgttacttctcagcctgataagcacagcgggtgtagctattcctgctttgcaaatgaggaaattgaagctccaagaacctaaaggacttgcccaagatccaaaagctcttcctcggtgcctcactcacctatgagtgctaaggcccaggttcaccaacaggtcctccgacacgtctgcatatataacttccctccacacagctcaaggcagggagagagaaacggcccagcagagccctgatcattgagctgtgggaaggctggggagggctttggaacagagcacacagcaagacctcagatctgactgaagggaggaactaggagctgagacaagaatacgtgaagttggaagagcctcagacttcatcaaggctaagggttctcaatggaagagagagtagggagtgtagggcatcaaggcttatgttccaggaaggaattctgacaccagctccctggcagaaacagaatccggtccaatcccatacttctacacatggggaaactgaggcccacagaggagaggaagcctccctaacaaagttgtactatcctgggaacagaccatcttgggaagcatgagttagtttctttttcttttctttttttttttttttttgagacagagtctttctctgttgcccaggctggagtgcagtggtactcgtggctcactgcaagctccgcctcccaggttcatgccattctcctgcctcagccttcccagtagctgggactacaggcgcccgccaccacgcctggctaattttttgtatttttagtagagacggggtttcaccatgttagccaggatggtctcgatctcctgaccttatgatccgcccgcctcggcctcccaaagtgctgggattacaggcctgagccacctgcgccccacccagcatgagttactttcatgtggcagggtgcacaggaactgtgcccatgagcagggtgaccgaacagctcccagaaacggcatgcaagtgctcatagtgtttccatcttgctgaatatattgcaatttgtaatactgttgcagaacaaagagagcgtaacttccacttcaactttcatagcttgcttcccatacttctggtcccttcatcatttccaacagtggtgaacgttgatcccactctgggaagttgacaagggacaaccgccctcccagagccaatatccatcccacccaccattagtaggtattgcccccaggttcacacagggagttagctgagaccgtcagttcccaacccagacttcttcttcctgtttcctctgctggaaatcggcactggaaccccagaggctaaatcagggcaataagagacaggagaggagaggtggccagggatggggcatagcttggctggcagtagtcagctgccctatttgcagaactggggtgggggaagttatttgggggacatcatggggcacctgtgcacacctaagcaggtcttggaggagggtagatgtgggtagcaaacagggtggtgaccccaggacctctggaaggggtgacaagcccagctgccatggtccagctccaggccccaacctgagccagccagccaggagatatggagagccttggctctaatcagatggatctgggttcaaatctcccttctgtcacctaaaagctgtcaggcacactgggcaatttcctgggcctgtctgaggctggctcttctgtataacaggattatttagcaaatacttagcaagtactttttcctcttctctctaggagaattatgtgcagaactggttgggggcgcggtaggggtcagttgtgccaggtacagaagcaactatggctagatgctagggtgagaaaaagtgtttccctggggagacagctattaatcaaattatcacacaaacccatgttaagagtgctaaagggggtaagaacagtatccactcataggccgctgtgtggtgaggttaaagccgcagatgcctctgggcacacacagaaaccttcaagaagtgcatctgtttctatcccagcccttcaatggcatctcgtggagctgataaattggagaatatatttgtccagcacttttagatttttcttttttttgagacggagttttgctctcgttgcccaggctggagagcaatggcgcaatctcggctcaccgcaacctccgcctcccaggttcaaacgattctcctgcctcagcctcccgagtagctgggattacaggcatgagccaccacgcccagctaattttttgttgttgtttgtatttttagtagagacggtgtttctccatgttggtcaggctggtcgcgaactcccgatctcaggtgatccgcccgcctcagcttcccaaagtgctgggattacaggcgtgagccaccttgcctggccacttttagattttaatagcatgttgcacacacatattaactcgttcggtcttccaataaccctaggaggtaggtgaaatttcctcaatttcttgatgaggagactgacgcccagagaggctaagtgacttcctcaaagtctccagcatggagattcaggattcaagcctctgcggtcctctgggctatccactccccgcaaccgtggaaaggaagggctgggaaacactaagcctcgggacgggagaagattgggaaaccagtccccgaccgcgcccgtcgtctaagcccgggtttcctgcctctctccgggcccgtgggccgggctgtgctccgggaagcccgtcatccgctcgtgaccgaccctccccggcccgctgccaggagggggcgcggcgctggcggcggccaaggccggagggctcctcggggaccccggcccggggctgcgcgtccttccctgctgcccacgctcccgcttccggaggggtctggacctgccttctccggcctggagccagaggccgccgggcaggcagcccgcgccaggaactcggccccctgccctgctccccgggcgcgccccgcgggcggccaacccggatcggacgcggacccccgggccagggtgccacgacacccctgacccgggcaccgggactatcgggcccctcccccgccttctcgagttcccggaacggtggcacccactccccttccatcccccggcggaggccacggacgcgcagcgcgaggtgggccaggcgcccaaatcactttaccgtgcgcctcctgctagagagtcgcccagcccaaggcagtggggcgcggaggcggaggacggggaaactgaaatacaaagggattgagtggaaagcaatagaggggggtgctgggaggggaaccagctaggctcaaagctccaaagtggatcgccgggttaatgtggggttcctgcctcgccacccactcccaatgcggctgcttagccgactgcataggcggcttctctgctttacactagggggtctgaattccccagcccagtcccccaggtagcttagacccggcctctgaaaacagaagatccctccttccaacactcctcgccggcaaggcagagatgggtctttcagggagcaggacgttgggccgcaggtttcggtaaagcacctcactcggagccacagcctccatgtctataaaatgaggaaaatggaccgggcgcagtggctcacgcctgtaatcccagcactttgggaggccaaggcgggcagatcacgaggtcaggagatcgagatcatcctggctatcacagtgaaacgtcgtctctactaaaaatacaaaaaaatttgccgggcgtggtggcgggcgcctgtagtcccagctactcgggaggcggaggcaggagaatggtgtgaacccgggaggcggagcttgcagtgagccgagatcgcaccactgcactctagccttggcgacagagcgagactccatctcaaaaaaaaaaaaaaaaaaaaaaagataattaatgaagcaaacgtcttttaaatgttagagccccgggctcctgcagccattccctggccacgtggcatgcattgcgagttaattgtgtaagtgtgtggtcttcttcccacctcctctccacccaccacctccattcattaaagtgaaggtagagctgcctcccacccgtctgctcaagagataaccattcagccccttttatttgttcaggactttaccgtttgtaagcccttcctaaatttttttttcaagacgtagtcttgctctgtcgcccaggctggagtgcaatggcgtgatctccgctcactgtagcctccgcctcctgggttcaagcgattctcctgcctcagcctcccaagtagttgggattacaggggcgtgccaccgcgcccagctaattttttgtatttttagtagagacgggggtttcgccatgttggccaggctggtctcgagctcctgacctcgtgatccgcccgccttggcctcccaaagtgctgggatgagccaccgcgcctggcccctacatacttttcatttgaacagtatgtgtgtgtcaaatcgcctgaatttaattcttgtctcccacaccccctggctgaataaacttgggcaatttgcttaacttctctgtgttcgttttctggtccataaagtgatactaatactagaaccacttggttgggctattgaggaataagaggctaatatatgtcaggtacagcacctggcacagagtgtgtcccctgaccctgttggcagttatgactgagccccgctgaatctaacatgcagcctgcttcagagggctccagatggctttccagacttggccctctggggcagattctgattccgtaggtaggtctggggcaggcctgagatccttcaggtctgaacagctccctggtgctactgatgctgctggcacccaggcactcctttgagtggtgaggtcttagagcagcggacttgactgtgcaccagacgcatctggagggtttgtaaaaatagattgctgagtgccatccccagagtttctgacttagtaggtctggaatgaggctaggatttgcatttgtaacaagctctcaggtaatgctgatgctgctgatctggggaccatagtttgaggctttgttttagagcatctcacccctcaagcttatggccaccagtaatgtcatgctggggggtgggctggggagtagaggtcattaaacagccaagagtagcttcttatgctttgggaataaaagaaagtttggggtggggggagggtgggaggcaggtacctgagattggaaaccaaaaataaaaaatcttcccaattctaatatgggtaagacaccagaaggaataaaaaggacagtgtagcttttttctcagcatcctgtaaaaataagggagactggtaaagactgcctagttgctcaagggcaaaagaaagggaatggagtctccctcagcccatgtcttcctgtttggggtcctctctccccagacaaccaggagaacagagggaagccggagggcagcagcaaagcccgcaaggagaggacggccttcaccaaggagcagctgcgagagctggaggcagagtttgcccatcataactacctgactcggctccgcagatatgagattgcggtaaacctggacctctctgagcgccaggtgcgcccccggtgggcccctcctcttctttgctctctcatctccctcccttccctcctttcccaccacccctccctggaccttctcctttttcttcctccagccagtccagcggttttcaactgtggccacacctgagaatagcctggggagttttgggtttttttgttttttgttttttgagacggagtctcgttctgtcgcccaggctggagtgcagtggcgcgatcttactgtaacctccacctcctgggttcaagcaattctcctgccttagcctcccaagtagctgggctactggcgtgcgccaccacgcccggctaatttttgtttttttttttagtagaggcggggtttcaccatgttggccaggatggtctcaaactcctgacctcaggtgatccgcccgcctcggcctcccaaagtgctgggattacaggcgtgagccactgcgcccggcccctggggagattttaatagtgctgatgtctgggctccacccctagggatgattttaattggcctaggatgggatacaggcctcagaatttttcaaaggccccctaggtgattctcacatgcagctaggttgggacctacggtctggctattcccaaatttgagtatatgttggaatcccccaaggcacttgttcaaaatgtggattctggaggtccggagagagattttaccataatgagtgggcctgagaatctgtatttctagtacattctccaggtgatctggatatgcagctggttcctgggcacactttgagaaaaacttccctggccctttgttttggactttcccttcagccaccccacacccccacacccatgctctgatacggaataatagtaataataaccgtaatatttgatagcagatttcagttgacagagcactctgccagagggctggatattgaatcagaagacttagattcaaatcctgcctctatcacttttcctagccctgggacctctgggtctccatctgtaaaatgggatcataatcctgcaggtaatactcaagctcagatgagaaaatgtgcttaccagagctatctaaaccaaaaagtgctctataaatgtgcctaaggataaggctgatgacctctgctcccagacccttggggaatggaggtagggggcagggggacctggcacaggcagggcagggcatgtgaagggggtggggccaatgcagagtgcttttagaacatgttcccccgtctggggctttatccgaagccacaagacagacctctgggcagattggtatgtcctctcttcggtcctagttcctggggcctttgagggagtagggagtggtaagtgatggtttcaagctggggtccctggagttacaccctggctagcctaagcattgacatggggaggaggtcacaccggccctggagtgaccaggctcctttgcttcctcccccaggtcaaagtgtggttccagaaccgaaggatgaagtggaagcgtgtgaagggaggtcagcccatctcccccaatgggcaggaccctgaggatggggactccacagcctctccaagttcagagtgagattctgcatggaggaaaaatgactaaggactgagccccctacccaactacccccaccccaatcccaccttcaccctcttccttccccagccagggcagcctctccacatctttccctgactcttggatatgaaactgcccagcattcctgggagtcttaggattttctaggaagttctgtccagcctcttagcagcctcttccctagggcctttgctcccacactctcatggaatcagacagagatcctaccgggccggatgaatctggaaacagcttcagagatactgcttctcagcgtctcttggctgccacccatgcctcctcctaccgctgttctcctaggtcagccaggcctcctcctggtctggacaccacctggcctggtgggagaggagctttggaaccagctggcgactcggaaagtaaatgcttcaaaaggaaggaaatgacagagacacacgcccttgcccaccttcctctgtaggctgcacatctgaggctttggggccccttagttgtcccgaaaccccaagaaaaatcagaatgaggagagtcaaggacagcaactcagctgctgcaagccagaaacacatccctgtctccaaatttgttggctaagtggagacacttctgagaactgactagagaagacagaaaaatagcccgatgtaggtttcggtgtccccatataggcccgtccacacaggcttgactgggtggacaagaatgaacccatgacagcacctgctgcttcaaaatcaaaatcaatttagggatacagcaggggctgttgggctgtgctccagagaaaaggagcagctactccttttaaatccacgatttctggattgaaaacctgtccagatgctgagttgttgggctgaacaactaggagctgaaaacaacgtagaggctggaaagtgtcccctgcattctggaggggaggggagataataaggagggctgctgggtgagggcctggagatgtggaaccctggagtggaaggttctccagtgacagtgtcctgtgactgcaaaaggggacaagaaaatccctcttcctccatgggatggatttaagctcttgctgtgtgttctacaaatgctgttattgtgggaggaaatgctaggtttttgtgtgtggactgcccagacctcagccaggtcttctggagatgacatttgaggactgatggccaaagagcatgggggactgaagccctggctgcctcagcgctctgtctcccaacaccagctggtgttgcagagggaggtcaacgtgagtttggatctcttgtacgcagatgtaatcattcacatgtaaaaataaccccacctccccaccccaaaaagggcaagagctgtggaaaatgattgccaaatgagatggctggttagagcatgattttttctaaagcatacttcatatattttcttaagattacatcaagctaattgtgcgagctcaattcactttgtaagaaaactctcggagaaataaaatcaataaaaagcaaagttcccaggcctttttctttgcagagcgaacaaccacagctcttgtgtgcaaccttctgattgaccagacaatgtctagaagcaagagaaaaagggaagaaatgatctagacagagctgtccccctttagtttttcaaaaggtgggtacaaaatataattggtgccaaaaaaaaatttttctccaatgcaaatgcatggtcttcatttctcattgtaaaagtttagctttcagtttccctaaactatgacctatcaaatagtcaatgttttataaacaaaagatgaactcttttgttaataaaggaatcttgaccacaaagtaaccatccctaatgtttaaattcaaagtttggagattttatttttcaaggtagaaaaatgtatattaatagtagtaaaaaatgacataagaaaaaatatcccatattttgtcttttttttttttttttttttgagacagagtttcgctcttgttgcccaggctggagagcaatgtcttggctcactgcaacctccacctcttgggttctcctgcctcagcctcctgagtagctgggattacggccatgtgccaccacgcccagctaatttttgtatttttagtagagatggggtttctccatgttggccaggctggtctccagctcctgacctcaggtgatccacccgctttggcctcccaaagagctgaggttacaggcctgagccaccacgcctggcctctatgtctttttaactaaaaaacaatttgtctcaccaagatgtcaacaatggacaaaacaggactggctacggtgaggggagagagggaggcaggaggggagacctggccaggatcttgcattgaggcagcctgggccaggtgtgggcagtgcctggaagtgacatcaccaggacctggaatcaggcagacccaccaaaatgaaggtgccaaatggaagtgggttcagtggctcaggttcaggttcacagccaagcaacatggacacgctcagtcacccccgtccaccctcctgctggaaactcaactctgtggcttcaggggacatcaccctcttctggctttcctcatctgtcctagatgttccttctctgtcccccatgcaagcccctttctcgatgcttctgctctcacagctggttctcaaggttttctctttcttccgccaccttccctatttttcaatctctccccagatgatcccatccacctactttttttgtttgtttgttttttgggacagtctcgctctgtcgcccaggctggagtgcagtggcgtgatcttggctcaccacaaactctgcctcccgggttcaagcgattctcctgcctcagcctcctgagtagctgggatatggctgatttttgtatttttagtagagatggggtttcaccatgttggccaggttggtctcaaactcctgacctcaggtgatcctcccgcctcagcctcccaaagcgctgggattacaggcatgagccaccacgcccggcctatgtttttttaaattgttgtaaaatactctaacataaaataaaagttatcattttaaccgttttgaagtgcacggtcccgtggcattaaacattttctcattgttgtgcagccattgccactatccatctccagaacgttttcatcttcccaaactgagaccctttgcctatggaacactaacccctatcccctcccctccattcacctgcatttacatagtgtttgcgccatattgagcactgttccgctttacatgtacaaactaagtgaattctcttagccatcctaagaggtagtactaccgtcattcccatttcacacatgaggtaaccaaggcggagagaagctgagtaaactcccaaggttttatggtggttagtgtttggggtggattgtattattgggcctggttatcttcttccctctccactggggaacatgcctccctgatcattgccatatgatgcacctgccgcggtaagggcacacttcctcacctaattgacatcagcttgtccttgtggcctgctttggccaatagaatgtgagcagaaggatatgtgctgtatccaagcagaagctttacgggtcatcacacggctgtactcctgctcttttccctctgtacgaggctgaaatggaggatccctaggttccagaaggagaaaaacatggaacaaagccaaagctgaccccatagccttcacagatgtcagtgaggatataaacatttgttgctgtaagccactgggatttgtgggtcacgagctcgtgaaaactgaccactccagtgatgaagctgggtttggaattgacgcattctggccccaggccaacacttcctatgcctgatctgggtgcctaagcttttctattctgctgcctactgccctttgccacctaggatgactataagcatctcaaactccgatatctgaaggggaaatcgccattcccgcagttgggtgagcaccactgcctgcattctgattcttctactttagctggcaacaccacaacctacctgttcattcacactggaaacctggggcacatcgtcatacagacctctgcttttccgaaccaatccactacctgggcctgctcattttacttcccacatagatacttctcccacccacggcattgtcttcccaccaccactgccttccttctggctgctgatgtctcacttgaattagagcctctgagagctctccctcctgatctgaggctgctcaaatcccatcccctctcagcctgtagagtgatcacaaaaaaaaattcaaccctgtcacccccaatttaaaacctatcggtagctttcctcacctacaaaataaagagccttcacaggtctccatgatccagcccctgaccacctccacagccgcaacctaccacctccgccacaaatcctgggctctagcaagaccaagccaccttccattccacagccataggccatgtgatttctccattccttggctcattcccttctgtctggagtgctctcccacacctggagccccaaggacttatggattctaggagcactctaaaggaacacgcaggaagtttaaatataaatatggcccaagttttttttttgttttgttttgttttttaagagacttcgtttcccaagctggagtgcagtggtgtgatcatggctcactgcagcctcaaactcctagcctcaagcaatcctcccacctcagcctcctgagtagctagctgggactaaaggtgtgagccaccatgcccagctaatttttaaatggctttgtagagatgggggtctcactatgttgcccaggctggtcttgaacttctggcctcaagggatcctcctgcctcacctcccaaggccctggggttacaggcatgagtcactgcacccagcccaaactaattttcaatagtagatcaatgcctaacacgaggcagcaacattcaccaatttctaaaaccatcagaaaaaaacctcagtgtgagaattttcctttccccaataaacccagttaataagcccactgaggagagtttgatcatgaaattaaaagtacatgcacacagcaatcaagaggtttctggtttcttttgaacattccatgcactcctctccctcttcagcgttggtgtttgattgacctgcactgggtgagcagtagctgggaccagctgttcctcaagttggtaaaaatcctccactttctcccgagggcaaagctgcatgaaggaagcaaggccacccactggcaactccttgatgggaaccagtgagtgtgaccagagatggtggcttggtaggaatccaaacaactgagaattcccagacagtaacttttcagtaatggttttctccatccttgagagagcatcagggacgagcgagtgtgtggctgacctgctgagagaggtgaggagatatgaaaaaagagagagatgaagcaagcgagtagggaatccatttccaaaggaaaaggcctagaggggctcaggccttcagaaatctgctcacctgcctgcgccaggtcctgagatggatgcgtgcatttctgatagttcttctattcaaagatgagaatcagtgtcagggagagatctactcttttctgtccagacccccaaagaaccacatttccagtaactgggtaagcccatggtgggtggctttctttccttccattgggtggaaatgattgcccttaagagctatatattctctgcccagacagaggagcctgtgcctgctaatccctcacaacaccagtgaggcactggtcagtcatgtcatctcttggccatcgtggtgctgggctctcaccatgttccttctctcaccggctgccccttctcagtcctatttgctgccaaccctggctacctgaatatttttgaaacactttgaaaaatatctcaaatccggctgggcgcggtggctcacacatgtaatcccagtactttgaaaggccgaggcaggcagatcacctgaggttgggagttcgagagcagtctggccaacacggtgaaaccccgtctctactaaaaatacaaaaattagctgggcgtggtggcacatatctgtattcccagctacttgggaggctgagccatgagaatcacttgaacccgggaggcagaggttgcagtgagctgagatcatgactgcactccagcctgggcaacagagcgagactccgtcttaaaaaaaaaatcttaaatccacgcccttctctaatgctacctgtggccatgactgttcctttattctctatcttcccaccttgtgtgtgttcctttatggccactaccacaatttgtcattcttctattttttgtttgcttattcatttatggtctgctttataagctggaagaaagagaaagggatgtgtttctctgaccattttattctcagctaccacatgatgcctggcacataatacatgttcaatagatagtattggatgagtggacacatggatggatggatggatggatggatggatggatggatggaggaaccgttaaactattgacatcactgacttctcggttcaaaactgcccattgctggacatgtggacagtgtaggagaagctcagtccagaagctggttaggtggcttgatgcagtcagggcttcagagaccaccaggtctggccggccatgcccttgaagaggggcactgaacagtcaccctgtttctacagccccagggaactctctggggccaaggttctctgcaaatccctcccccactctctgagctctgtctgaagtctggacaaacctctcctctttgacccatggttggcaaaaaaaacagcttccagagcctgaccactgacaacagcgagactcagaagtgtgcctgataagaggtttgtgagccactcacgcacgtctctgagggtgacgcttaatagcttcaaggtgacatcagggttgggactaatatccgattgaacagaaagagacatgacctaactcgtctctcaccgtgggcctggctgcgagagcttctctttctttattaatttcctaaccggagctgctggctcaggactccagcctgtccccagagccggggcccacggctgggcttcaatccagcgttagtgggaagggaacaggctcagccagggtctgagaacccccaggatgaaagtccactgagtctgtgctcatcttggcgagagcctcatggttggctttctccaccatccagcagatttaccctgctttgagaaaatccagtaggacagatccaaaggctctaaaaaattactcctggtaaaaaaaaccttgctgcagcctcccagcaagctgcaggcttccccagtggctgtaaaggatggttttatttgtgttttaaaaaatgatttaaaaccagttttccaggaacacaaatcctgtctaaagcacccggtgcacctggctagagagctgcaggcctgtgtctgagctggctgactgcctggtgggaccatgctatcttcaggttattttcctttaaaatattctctgcattggctgggcatggtggctcatgcctgtaatcctagcactttgggaggccgaggtgggtgaccagcctgggcaacacagtgaaaccctgcctctaccaaaatacaaaaagttagctgggcgtggtgatgtgtgcctgtagtcccagctattcaggaggctgaggcaggagaatcgcttgaacccaggaggtggaggttgcagagaaccgagatggtgccactgaactccagcctgggcgacagagcgagactccatctcctaaaaaaaaaaaaattctctgcattgcaggaggagaaatcctgtgtttcttatcaccttccctccccactgctctcaccctacccgcacgtacacacatacacacacacacacacacacacacacacggctctcaccctacccccacgtacacacacacacacacacacacacacacacacacacaccatctttggacactgatagattgcagttccgacacaggctgtgccacagattagctgtgtggcctgcatggagtcattcatcttctctgagcctcagtttcctcatccagtggcctgcagaagtagtggtgcttgataaacacttgttgaaaaatgctcctacaaagtacagatcatattttactcacaggctgataggaggattagattgattcattcactccacaaaaatattacttgagttctaactatgtgttaagtcctaggtagggtgagtggagacggtcagactgtccccaggaaaatggggtaaggtctacagaatgcctcgcacggtgcctgcctcagagtgggccctccaagtgggaatgagtgccctctgtcagtctgtctgtctctctctctctctctctctctctctctctctcacacacacacacacagacacacacacaccccagattctagtcagagtgctcttccgcttcttcagggaggctgcaacacagtgtcagcacaagcatggagcccggaggaggcctaggcttcagtacctgcttttctactcatttgctgcgtgacttttagcaaaccacccatcttccctggaccgatttcccaactgcaaaaaactgagcattctaataccttgttctgccttgagtacaaaggttaaacagatactatgggcaaaacgttttcaaagcgccaagctataccaaaaaagaagtgctgctgagaggcagtaggggatcgtggggaaagtcaagggcttggaggatgccagatccagatttgcttctgatgcgttaacccagaacagaacttttcacactgtggccacacatgacagcccctaagcacatcttacaataccgattcagccactatgtcaatcccctcacacccacaccccctccatgggaggcatcgctcagatcttcacccaggggcagctggggaggagcagcctcttcaggaaggaaccagaaagtgaaggccccaggaagtccctagggcgctcagcccattgttaagcttgacccgtccaccctcccttcatcctgtcttgccatggctctgccccctaggaccccacttttccttcccaacatgaccagcccgtgaaagatctagagtacagaaaaaccaggcacaactgtctcttctccacagcgaggtgccctgcaggcctgccaagcaggcaagtccccctccagaagccggtaccaagtgctgaaggctgtgtttcttctaagagagggtgggggaggcctgggccccttcaaatgccctttcatcctcagctgctcccgttcacacacctcttccctgacaggcatgaggagaagctattactcgagaagactgctggtggggacactggagtggccgaggcccatgagcctggggggacccctcagtcaggaccaggctctttctactcaagaatctgtggcccttctgggggctgtggcacaggatgcggggccttcatcccacaaatcccctctgtgcatcccctgccggatctctgtggagcagatgccaggggtgggggcaggacacaatgcccctctttgttggggggatccgggccggcagtcgggaggaaattagacagcgctcctgacagcaggctccgtctggggtgtctgtgaaatatgggccagaggggctccttccagagaccagttcatggccgccgaccacccccacccctgctttgggcagagaggacactgcctgtttggagagaaatgatatatgacacgcagcttcctttcctcctctcctgaggggcttaacgcagctctgagagcctggggaagctcatggctgctccttggaggtgtgaatgtacgcacatatgtgtacacatgtgtatgtgcgtgtgtgtgtacctgtgtgtgcacacatctatgagcctgtaggtgtgtgcgttgtgtgggtgttttctgagtttgtgtgtgtatctgctcactccatggccagaggagagggctcaaaatcctggccaaacaaaatgttggccaagatggcaccctctttagcatcccttcattttcacaggccaggatgaggacctttggggcctagggcctaaacaaagctattcagagagtggtggtgtgaggcgaaggggagggagattactgagcaccctgtccgctgattccatcctccaagtggccacctcacaaggcaggaactgttttcaggatgagcacatctcccgccccacggaggctcctaatccagccacagcatagcctgcagagcctccaatggcccctgaaccatttgtcttcaagagaggaaatggtaggctattcccacccacctaactcctttgcggccagccgggtctccacatctgggctgcagctggctgctctctccaaagaacaagaagacagagaactgtcagcagagggctccgaaaagtaccttaacccctcagcaagctggaagccacaaaggatcagcctcagtttccacatctgtaaatgagagcaagggcaaaccctgccttctgaaaggctgttgggataattaaagaatataagggccgggtgcggtggctcacacctgtaatccagcactctgggaggctgaggagggtggatcacctgaggtcaggagttcaagaccagcctggccaacatggtgaaaccccatctctactaaaaatacaaaaattagctgagcatggtggtgcacacctataatctcagctactcaggaggctgaggcaggagaattgcttgaacccgggagcggaggttgcagtgagctgagatcgcgccattgcactccagtctgggagtgcaacagagtgagactccatctcaaaaaaaaaaaaaaaagaagaagaagaagaagaagaagaagatgaggtgtggaaacattcaataagctcataagatctcaagggtggtccaaaggttagtggctggtatacatccaataaacatctgccaggtgtctgctacaggtaagacttgggatgggcactatgagagaataagaaaaagaacaattttttatttttttgagacaggatctccctctgtcatccaggctagagtgcagtggcacgaccacagctcactgtagcctcaacctcctgcgctcaagcgatcctcccatgtcagcctcccaaacagctgtgactacaggtgctcaccaccacaccggctaatttttaaattttttgtagagacaaggtctcactgtgttgcccaggctggtctccaactcctgggctcaagcaattgtccctccttggcctcccaaagtgctgcaattacaggtgtgacccactgcacctggcaaaacagtgtttttgacatcaaagctagtgcagtcttttcactgttgttgtccaccacaacctgctgaggtgggtagataatcttatgcccattatgcagttgaggaaaccaaggctctaacagagggtggtctcagagccccctcttgctcaagattacatacctaatctgtgttggaaatggcgtgccttgcgttgtgtcatttgagctgttggaaggaagtcaccacagagccctctctggcgagccaccgtggtcagcaacaccctgacatcacttgagatgggaaatggattaggtgtgaagtcacatgcagtggaaccctgggctcaagtttattattgccatgtcctgaccagtttctgagccttgagtacttccctttctcttcccttgtctgcccaaggagggttaggtctttggaacaagattccatgctttgcctctctgctgttcttcctcccctgtcctcaagatgcctggagtctcttccaggaaggaatcttgctcaggaagagccccaatgactaagggactcagggaaggtattatatgatatggtggaaagaatctggcctttaggctcaaacagatcttctctgaatcccagctcctcctcttcctagtgtggaagcctggccaagccgttgtttctgagcctcactttcctcacctgaagtgggacttcatccatggctctgagctgttgtgaagtttaaataagctaacacacatggaagagcccagccccgaacctggagctcagttagtgaacagggagagtgggctgcctttcccttgcctttactggggaagaagtgatatatgagagatagattagtgagtccaggggaagaggtaggcaagacctcactggctctggaaaccaaggaccagataaaaggagtgaagtttcggctgggctgaggcaggagaatggcgtgaacctgggaggccaagcatgcagtgagccaatattgctccactgcactccagcctgggtgacagagcaagactccaccttaaaaaaaaaaaaggagtgaagtttcagtgaaatgaggctagaaaagatggcagggaagactttcaacaaatgggctgtgagtcactaggaaaggtagagaataggtgtttccccccaccagagaatttttttttttttttgagatggagtcttcctctgtcacccaggctggagtgcagtggcgcgatctcgactcacggcaacctcagcctcccgggttcacaccattctcctgcctcagccttccaagtacaggagcccgccaccacgcccggctaattttttgtattttttattagagacagggtttcaccatgttagccaggatggtgttgatctcctgacctcctgatccacccacttcggcctcccaaagtgctgggattacaggcatgagccaccgcgcccagcctttttttttttttttttttttgagacagagtctcactctgtcacccaggctggagtgcagtggcacaatctcggctcactgcaacctccgcctcctgggttcaagcaattctcctgcctcagcctccaaagtagctgggattaccggtgcccaccaccacacctagctaatttttgtatttttagtagagatggggtatcaccatgttgtccaggctggtctcaaacttctgacctcaggcaatctgcctgcctcagcctcccaaagtgctgggattacatgtgtgagccaccgtgcccggccaaaggaatcttaagatcaaacaccactatgtagcagagttgataggcccttggagaccctcccatccagctccttgcactcatggggaaactgaggcccagagagaagggactagttcagcaaggacctaagcctagggagataagctgctcttatcagttggagttcagaagagggacaggagggagggctagaccaaagacagcagccaaagtctgggctcctgccctctgtccagggcttgatgtcctcacaacgggtccgacctgccagcagaagccagctggccagcactgaaggtctctatctgtctagactgctcgctggcccatcctgccgagaaacccaactcaaaggggggctgggacaggcggagtggccttggaggtccccgacagctccggaagtctgagcagagagtctctggaagactgagaggtgttgtctctgcagaaaagccgttggacatttccgtgtgacggtgacacaaaccattccttcctccataatcaccccttgctacagtgctggctcagggcagacagcctgccgtgcatggactttattttcaaaaccctcttacttcttcttcttttttttttttaatatccctgtgaatgcctgaactcccaggcagagggaagcactcaagcctgtccttgagtgtgctagtggtgatgtgatgtcccagacgggaccctccgagctctgcggcaggaacaaaccccctgctgatgtaatttaaaagaataacctcccaattttctcatctccctttgctggatacaccttatcaaatgacaggagaagccaatgtttggttaaatggttcagaggttaatactcaacagatgggagaatttttttcctttttcttttttttttctcctttccaggagatctggtctgctcctcttgcttacaacaggcttaggtagtggagggtggaggagagatggggggagggggcagggggcattcttcccatcgtgcccgtttctctccagttaccactgtcctcagggtctcaagctgtgtcctcagccttcacaggaccgtgctaataggcagggccagccagagctgcttgcatttgggaaggtagaacctgtccaccctgtgagggtacctaagtacatcaggccgtctgctggcattgggcaacgtgcaaaagggcagaataaagggaaggaaaccaatacaagtgaaaatctcaaaattatctctccatgcattgggcaaattattgagtctccctgaaactcagtttctcttttttttcttttttttttcccccttttgagacagggtctcactctgtcacccaggctggaatgcagtaacacgatcttggctcactgcaacctctgcctcccgggttcaagtgattctcatgcttcagcctcctaagtagctgggattacaggcatgagccaccatgcccagctaattttttgtattttcagtagagatggggcttcaccatgttgcccaagctgatcctgaactcctagcctcaggtgatctacccgcctcagcctcccaaagtgctgagattacaggcgtgagccaccgcgcccaaccagtttctttattcataaaatgagatataataatttacatggcaggggtgttggggagactcaaagaggattcttcagggaaactagatattcgcctatgctgccagtttcaccctagatggttggtcagcagcaaagggtaaaaaagaacattgctggctgggcatggtggctcatgccctgtaatcccagcactttgggaggctgaggtgggcagatcacgaggtcaggagtttgagaccagcctggccaacataatgaaaccccgtctccactaaaaatacaaatattagtcgggtgtggcgacatgcatctgtagtcccagctccttgggaggctgaggcaggagaattgcttgaacctgggaggcggaggttgcagtgagccaagaccacaccattgcactccagcctcggtgacagagtgagactccgtctcaaaaaaaaaaataaaaaaagaaaaaaaaaagtacattgcccatggaaaaatctggctttcccagtcttaatccagtgatcaatttagcatcacaaatggtagtgtagccatgtgatctgcctccttatgtaccctacatggcccagaagtgtgcttgacaaaagtggtaaggaacctaactcaggtctttagctctaacttccagtttacaagggcagagaatgggggagcgagctaaacaagatgaggaaacagtagacaattcctagagaatgactggctcagtctcttgaaaaagttaaagtcaagaaaataaaaggctgggcacagtggctcaagcctgtaatctcaacactctgggaggccaagggacgaggatcacttgagcccatgtgtttgagaccaacctaggcaacatagtgagacccccatctctataaaaaataaaaataaattagctgatcatggtggcatgcacctgtggtctcggcttctttggaggttgaggtgggaggttcacttgagcccaggaggtggaggctgcagtgagctatgattgcgtcactgcactccagcctaggtgacagagtgagatcctgtctctacttcaaaaaaaaaaaatcccatactatttcaataatcacacccaatactcccttccccaaccctctggcaatcactaatctgtttcttatctttatagatttgcctattctaaatattcatataaaaggaatcataaaatgtgtgaccttttgtacttggcttctttcgcttagcatgtttctgaggttcatccatttgagcatgttctgatacttcattccattttgtggcaaaataatattccattgcatttgtataccacagtttgtttatctattcattcattaatgcacatttgagttgtttccaccttttgtctaatatgaataatgctgctataagcatttgtgtacaagtttctgtatgggcatgttttcatttctcttgggtatatgcctagaagaggaattgttgggtcacatgctaagtctatgtttaactttttgaggaaccatcaaaatgttttccaaagcagctgctacatttacattcctacctgcaacatatgaatgttcttatttcttcctagccttgccaacttttgccattttccattgttttaaattatagccatcctagtgggtgtgaagtggtatttcattgtgggttgttgttgttgttgttgtgttttttttttttttgagacagaattttgctcttgttgcccaggctggagtgcaatggcacaatctcagctcactgcaacctccgcctcccaagttcaagcaattctcctgcctcagcctcccgagtagctgggactacaggtgcgtgccaccatgtccggctaatttttgtatttttagtacagatggggtttcaccgtgttggccaggcttgtctcaaactcctgacctcaggtaatccacctgctttggcctcccaaagtgctgggattacaggtgagagccactgtgctcggccaagtgtaagtcttttaactttctctttttcaatattgttttgactattcaggcccattgcaattccatatgaatttgagaatggaattttgcatttctacaaaaaaaaattggaatattgatagagactacaatgaatcttgtattactcaggttctccagagatagataataaatagaagagagagagagagtgcgatatggatgaaaggggatttattaggagaagtggctcatatagttaacagaggctgagaatacgccatctgcaaactgcaaaaccaaggagctcagtagcatgactgagtccaagtctgaaggcctcagaaccaggaaagccaaaaagcctaagaatctggagttctgatgtccaagggcaggagaaaaagggtgtcccagctccagaagagagaaagctaattcacctttcctttgcttttttgttctatctgggtcattagccaattggatagtgcctacccaca

SEQ ID NO: 12383 - DNA, 31040 bp, Human
tcagatttttacatgaagtttcccaaatttcaaaatgctgttcaggctggatttagcccacaggccacgagtttgcagcccctgctttagtgagataactttttccattttcactctcagctctcagctctccaacttggctctctggctatccacaggacgtggacatgagcccagtggggctgggccaggaggcaatcccccttcccaactgacctcagtctcgccctctccaaaacagccaaggtttgtcactgggtcaggctgaagggcctggctccctcctgcggggcaaggtccctcccaagagggtcctttaaaactgactctggaaagtcagagcacacacccaccagacaagcctgaacttgtctgaagcccactgagacccaagccgcagagacttttctagctgtgatgatcaagacataatcgtgacctccaatgccccccacaagtatattgctcctgattctttcagcccctgaccttacttctcaaactgttccctgctgacccccagtcctatctgcccccttcctaggctggtccttactgacccctccagctccatcccctcaccctgtgccccacctttttcagatagaaaaaactttcttctccagtgcctcttgctgtttttcatctctgggccattgtcaatgttccctaaaacattccccatattccccacccagcactccacctctttagctcttcaggtctcagctcagaagtcacttcttccaggaagccttccttgattgtctttactagtttaggggctgaagtcaggcgttcccaacagcctgctggagttccccatcacagcttatctctcaactgtctttcctgagagagggagaagacattcctcagagacggttgtcacagggagaacttcaaaattgggattcgacctgagaggccacatggattcttggcttggcgcaggaaaggattcaagagtgagtggggaattcgtggaactgagggctcctcccctttttagaccatatagggtaaacctccccacattgccatggcatttataaactgccatggcactggtgggtgcttcctttaacatgctaatgcattataattagcgtaaaatgagcagtgaggatgaccagaggtcgctttctttgccatcttggttttggctggcttcttcactgcatactgttttatcagtggggtctttgtgacctctatcgtattaaaccagtcttgcccaatttctatctcatcctgtgaccgagaatgcggaccctcctgggagtgcagcccagcaggtctcagcctcattttacccagccccctgttcaagatggagtcgctctggttccaacgtctctaacgcggggcccctgactgctctatttcccaaggtgtatctagcatctcgcactatacgaggccaagttaaggcttacacatttgcagaaggaaagaggtaaggaagcaacctgggaccttccactgtctctgtttccatctctctctttccatctctgttcatcccagaatctctctgtccctatccctaaatatcgaaaatttctgtctctgaccatctatcattgtggctgatcatctgtttctgaccattccttcccgttcctgaccccagggagtgcagggtgtcctagccaagccggcgtccctcctagtagtaccgctgctctctaacctcaggacgtcaagggcctagagcgacagatgtttcccagcagggggttctgaggctgtgcgcccagatcgcgagagaggcaagtggggtgacgaggtcgtgcactgagggtggacgtagaggccaggagtagcaggcggccggggaaaagaggtggagaaaggaaaaaagaggagaaaagtggaggagggcgagtaggggggtggggcagagaggggcgggcccgagtgcgccccccgcccccagccccgctctgccagctccctcccagcccagccggctacatctggcggctgccctcccttgtttccgctgcatccagacttcctcaggcggtggctggaggctgcgcatctggggctttaaacatacaaagggattgccaggacctgcggcggcggcggcggcggcgggggctggggcgcgggggccggaccatgagccgctgagccgggcaaaccccaggccaccgagccagcggaccctcggagcgcagccctgcgccgcggagcaggctccaaccaggcggcgaggcggccacacgcaccgagccagcgacccccgggcgacgcgcggggccagggagcgctacgatggaggcgctaatggcccggggcgcgctcacgggtcccctgagggcgctctgtctcctgggctgcctgctgagccacgccgccgccgcgccgtcgcccatcatcaagttccccggcgatgtcgcccccaaaacggacaaagagttggcagtggtgagttgctgcgctggcctcaaggaaccacgtttagacaaacttcggaggcaaaggatgggggtgtctctccccctgtcctcggcggtgggcacacagcgtgggggaggggcttcggtaaacagcttggggggtctttggcaagctattggagtgatctcttgcaaacggtgggggatcttttgtaagcaaagaaaacctttgataaacaatttggcaaccttcagcatacagcagtggggcgaaaaacaagccagagagtgggagaggggtgacctggcaaactactggaaagggactcttatgtaaatagcggggacatcctctagtatctgggacatttggcgggggggggggcggtctttgtaaacaacttttggacacatctgggcagttgctaagggctcttgccaagcgtctaggtaagcctttggcaaacagctacaggggtcgtttttgctaatgtaggactttgggaacggtgctctggcacacaatttgggtaaacttatgcgcgcataaggatgggagggagcttggtcaaagcggggcttggcaaatttctaggaaccttcggcacagatccggagagggacctttaaacaaacagctcgagggggccatttgggaagtgattggggcaggagggaagcagagagcgcatcttttttctcctggcttaatggacaaattggtcaagggctgggcctcggaaagtttcctcgaacttctccaaagggtcggagaaaagaaggagagagctggcccggcaggagggaggaggagtggggcaggcgctggagggcccggcgcgtggggcgggggcggactgcgctccgctcgggtcggagagcggccagagagccctccttcctggctgggctcccaaaccgcggttcagatgttgtcttgtgagcgtgcgcgcgcctggctggaggggcactgagcctggccgcagtgttgcgtaagtagggcctgaggagagaggcaggccagggacccatcaagatgtcctttccagtccaggggatatctgcccccttgttgcttcagccaccctgccctccagcctccccctcaacctgtccgggagaagacgcccatgccctctggtcaccctaggaactccttcaggaggtgacaactaccctctcccaactctcacccttccaaacagctaggtctcagccccctctggatagatgggttgggaaacctccatacatttttagagggctacttttttcaaggatctggagctggctggcataatgatgtggctgttgggtgggggtgagagtggagctttgggacaatgacaaagctacttggtttcctacaccttttccagccaatgggtcacaggatgaacccctaaattggggttcagcctgggggccacatgggttcttggcttgcacaggaaggaattcaagagcgagccaacagagtaaagtgaaaacaaatttattaagaaggtaaaggaataaaagggtgattattccatagacagagcagggaatgggctgctggactgagtatacatatggttatttcttgattatatgctaaacaaggggtggattatttaagagttttccagaaaaagggtggggagttcctggaaccgagggtttctctcccttttagaccacatagggtaacttctcaatgttgctatggcatttataaactgtcacagcgctggtgggagtgtctaatgtatttaacatgctaatacattataattagcatataatgagcagtgaggacgactagaggtcactttcattgcagtcttggtttgggtgggctttctccagcttctttactgcatcctgttttatcataggggtctttgtgacccgacctgtatatggtgaaatcagtcctaccaacctcctgtctcattctgtgactaagaatgcatgcctgccctcctgggaatgaagcacagcaggtctcagcctcatcttacccagccccccactcaagatggaggtgcctggtttgaacacctctgacaaatggaagtctgtgttgtccagaggcaatgcagtgggggcttaagaagataactctggacttagaccgcttggcttcaaatcaaagagtgcatgaaccaaccagctggcctagtgatgatgttaggcaagtgacttctcagtttcttcatctgcaaactgggaaatttcctatctcagggttaaaagagaggtaatcttaggtgcttacctagcacatggtaagtactcaataagcactagccattattctattatattattattattgttatgtcctccatttcccctttcctaactacttccaacaaggctaggaccgttgtcagaagatctcctggctcctttcaacattctaacacagtacttatcacatacttcattttgttttatttgggatctatcagcctccctgctaggatttgaaccttagagacagaattgtctatctttttcacctgtttttcctcagcagtagcactgggcttggtacatggtaggtattaaaaagtatttgttgaataaataaatgagtcggttgctccctgaacctctgcagggacctgctcagtttgggcctcagtttgggcagggccagttgtatgactcatgaaggacaggactactttctttttgcaaatggctgattcaggatttaaacccaggtctgtctactgccagagcccatgcacatagtccttgaatctctttagaagaaaacaggaggaaaaaagtccccaagtcaccagccgcaaggtagataaatgagttgatagaggtaaaggaaggatgctggagtataatgattccatatcacagcctctggagccagattgctttgtcccaaatccagatctaccatttgtgaactgtgtgatcgtaagcaagtttcttaacctctctgtgcttcagtttcctcctctgtataatagggttagtatatctacattacagagttttgagcattaaatgagttaacatattctgactttagtgcctggacatatagtcagcacccagcaccaacaagtggtagccatgctctctatagctgtatgtcctgtcgctcaactaatgggtgaccgtgctggtttgggaacccagtactccacccagtgctctgggacccctggcttatatcctgtctggactatggcactgggttggggggctgattgctacagcctgctttggtcagtactgtgccatcctaatgtggctaattgccttgggggtgtgcatttctttcagcaatacctgaacaccttctatggctgccccaaggagagctgcaacctgtttgtgctgaaggacacactaaagaagatgcagaagttctttggactgccccagacaggtgatcttgaccagaataccatcgagaccatgcggaagccacgctgcggcaacccagatgtggccaactacaacttcttccctcgcaagcccaagtgggacaagaaccagatcacatacaggtgccggggcagggcttggggaggcagggccatggggctgagggacacgagtctccttgacccatgcattctctccactcaggggatccatgaggtgtcttttgtgaaggcttgacatcttagggagtttcaatacacagttcttagaaaatgaagtcagacagacttgagtttcatacttgctagccatgagacattgggttacttttcagtgctgtgaatgttggctttccaatctacaaaatggggcttaaaaaatgcccttatatggtatgttggggaactaagctaggctgaactaatacaaacggcttctatgatttttgacacagagcaagagtgtagtaatgctagtcattgttattgtttttagatgaggtcattgggatgggcagaaggaacgtgatgattggtagctaattgggtttagcagcccaattgggttataactggttgctaattgggccaagagctgtgctctgtatgggtggtgctgggttccaatggtgggatctttgccctgtgccccataatgcactacttatggccctcccccaccagccagaagtgacagatggaactcctgagctggggcctaaaaatgttggctggcctgggactccctgggtcttcaaggcattctgggagggttgtccttggcagtgagccctgcccagcctacacacacatacacgcaggcacatgctcacatatacatacacatacctgtgcacccttcccgtgcttgtgcatatacttgtatgttcacatacacacacacactcaaactttttcatacatctgtgcacacacacatacttgcatatacatacacttatgcacatgcatacacactcacatgcagttctaccacctccaggatcattggctacacacctgatctggacccagagacagtggatgatgcctttgctcgtgccttccaagtctggagcgatgtgaccccactgcggttttctcgaatccatgatggagaggcagacatcatgatcaactttggccgctggggtaggcagaagatggggcagaagaggggccagcagggatcagtgttgagacgagggggtgagatggacattagaggggcgtggggatcctaagggcggcttagataggacagtagatggtgtgggccctgggggtggtttagatgggggcagcacaacacggagtggacactggagagccacgttgacatgggggcagatggtgtgttgtggtataacctggaggccgtctaaacccgaagcaagtggtctactgtgctgtccaatatggcagccattaggcagaatatacatggctgtttaaatttaaattagttaaaaattttaaattagtttcctggtcacactgggcacattttaagtgctcaaaagacacaggaggctagtgactattgattttggacagcacagacaaagaatattcctcttaatcacagaaagctctgttggatgatgctggtagacactgaggaactgtagatatatgagagtggtttggaaacagtggagcagtgtagacactagaggaagggtcgtagaacctggggccaggtggccatgtgagtttatggtgtgaacactgccagtagcacagacataaaggtatgtggtatagacactgagtggtaagtgatgaaggtaaagagcaggggaaacaatgtagacaagtgggtgggtggtacaggccttggtgacaaggtgggcatgaggattcatgttgcagatattggtgatagtgtgacatgaaggcaggattgtggttaagagggcagtattgacaggatggaggatggcatagacactggggatgatgaagatggggtgaggacactagtgtggtaatgtgggtatgtggtacatatagtgtcatggtggtagagtagacaatggaggtagagggtatggatactgggagtcatgtaaacctgggagagcagtgtagaccataggatggtaacaaccaggtcagcagatctctactgagctcctgttgacagtcctggataaccccactgggacaagggaaggggacagatgctgggtgggctgacaggctccacatgtagatggggtgtggaggggtttcagggtctaggtggcacagctagacgctaagacccagtgtgtgtttcagagcatggcgatggatacccctttgacggtaaggacggactcctggctcatgccttcgccccaggcactggtgttgggggagactcccattttgatgacgatgagctatggaccttgggagaaggccaaggtgagaaaggggccctctgcatgccccagaccttctctcctgtcctctctccactccatttgcttggaccagagaggtgggaggggaggaaagtcacacatctgggtgagtcagaatcttggtctccaaagaaggcctggagaagtccaacctcccccttccatgtcactctttagtggtccgtgtgaagtatgggaacgccgatggggagtactgcaagttccccttcttgttcaatggcaaggagtacaacagctgcactgataccggccgcagcgatggcttcctctggtgctccaccacctacaactttgagaaggatggcaagtacggcttctgtccccatgaaggtgagcatccactctagtccccaagactttccaccccaagcctccagcttcccgggctccccagtgtgctcttccctccacactctccaggactggctgccactgccagttaatgagcatccctccaacgtccttcactcagttcccccccatcctgatctgagccattgctgtttctctcccaccagtaccatgatgaacgtagtactctaattaaatcaagttgattttttttaagtttcaccattagcaatcatttaggaagtcacagatttgatttgctaattatttatttctaatatatattggagtgaacttagaactattacaatgcccagtggttctctctagaaccagtctttacacttcaatcaagattgatacttcaagggcatgaggaaaggcttgctggtagctggaaacctagcagtgtgatagggaggcaggactcagaccagggctggactcaacctggtttgcgtactccaactgaggaatttcagctattgctcctgccttggtcctgatgctgcctctgctaatgcgtgtgtgtgtgtgtgtgtgtgtgcctgtgtgtgtgtgtgtgtgtgtgtgtgtgtgtgtgtgtgtgtgtctgggcacgggggctatactatctgcctctcttgggcactgtctttttctgcctcctgtctagcttgtgtctgcatctctgtgtcttgataaagactttaggcttgactcagtatttgtgtttgtgtgcttgtcagtgcctgagatgcaacatttcagagattttgaagccacatgggggaaatcttttaaaatggggtacagatattgacatacacactcaatcctttttaaaaatatccttgacacacttaatagtcataaatcacaaaaagacaatgtaacttcatactctatgaagtcatcatatttgataattctgcagattgaaagcccagaaaacctggcgaaaatggaaaaaagtctaaaaatttttaacactatcttctttcccatgtcacaaagactctatagtctacatagactaaagactgtctttttgtctgtaattttatgtctgtgaatctccctaaccccactgtaactgaaaactaagcaccaaccatcttgacagaatgaaagaaacaaagagctagttaattcccttcctgtttatgcttttactaccagagctaaactttatattaagtaagagtttaagccattcaccattaataagtcagacattttgaaataaaaatattttttgtatcttgcgtttcccggtagggattacatgtggcgttaacccttccctgtgtcacccctctgataggaacagaaagctttggtgatagttagatgtggaaacagctgtatttcataaatttgggaagggttattccctgcattggacattagccatttactttgtgcttagccagatgcaagtacgcacaacacgcacgtgtctgggtctcgaggcagagattgttgttactcagcccctgctgatggctgagtcagtgtctgattcttgccatccttgtcaggggaatttgggaggagacaggggcttcctgggtggtagaaatgagaggtcagaggcagggggctggcattggtcgaagttaacgctttgcctttctcaactctgaggccactaaggtatctggactcagtcttgccttttctctaggtgccattgtttctggcattgcaggacaaggtcttttggtagagaggggagtggtgaggatacagggcctcgagttctgtggtgggaggccagggactgggctccattccggccatggtggagttaacgggggctggtgaggtcacctctggcgccgttgtgcacagatggtccttgttatggacttgtggttttgctggttggcaattccagagacaccattttttagctttgggtggatgaggggaggatggggagaatccaagacagacaggccaggctctgaaccccactccctcccccaactctccatttatggcccctgtcttgaagatgtcaaagtaggagcccagagtgtttagtaaaagggacctgaaggcaccacctccctctccctccctcctcctcttcattctttctctccttcctacagagactgcaacaaggccatccaggaaggggcctggggttgacaggaggtaaagcaagctttctgtgtatgcgtgtgcacgcacacacacatatatgagagtgacagactaagcaagagagattgagattagtgtgttttgtagtttttagttacaaccttcattcacttctttcatttctgtgaccatgagcagtttgagaaccatctttgtcctagccttgatttctccacctatcaaatggagagagattctcgtggtcctgcctgccatgactgatatattcatgtcatacatcattattacatgaaatttgcatggtacaggtgtggaccaggcagaatggacagtgcccttggggctgaggcagggttctagaagcccttgctgtgtgccaggtgtcaatcattttgttgttgggtggtccacaaggtcccacgggagggattgggataaccagggaagcaggggttctctctgggagctcagagaagcagctccttaccaaccagtagagatgttttcttaatattttaacaatgcatcaacttcactggtgtgaaccggcaggtgggcagccagccagccctgtgcccatggaagcatgtctcattcacatccttccctctctcccccacccttagccctgttcaccatgggcggcaacgctgaaggacagccctgcaagtttccattccgcttccagggcacatcctatgacagctgcaccactgagggccgcacggatggctaccgctggtgcggcaccactgaggactacgaccgcgacaagaagtatggcttctgccctgagaccggtgggtgccactccctctccctccctcagggcccagcacctgctgtctgacaaaaaaaaaacccataagactccgagtgcccacctcctttccccaagacaggggtgctaagacatctgtgcgaatgacatccacaccaagatgtccgtgtagctagtcaggatacttgtcacctggtatggcctgggcactgaaatcagaacagacattgggcatcaacagttgaattggtgacacttaaatgtcaggcctgctcaggatcctctgaccgacctgcatcccttttctctcaggctctctggcagagacttctctctcctcctctctgaccctgcaatctctcttccctgcctttcctggtctgtatctccaccttttagtctgttttttattaagagctccgtgctttcctccctgtctccttcctgccctcctctctatccctccctcctttccttcttcccttcctccaacaggaatttactgagcgcctgctttgtgcagcatacacagaggttggtctctgcaaagccctgcccaagggggctcacagctgaggggcatgtgctggtgccatcagcttcatccaactccctttgcccctagcccatctgcccccttccatgggaggctcattagaactctggaatctggcttcctgggtttgaattgcagctctgatacttcctagcagtgttggcttagggaaatttcatcatctctctgatctatttcccatccatgaaacgcggtgctattcagtccctcctgcacaaggctgttgtcaggggtgggtgagatgagtctaaagatacagtgcctgggactgagtctaacttaggtgtggttcattaaggtcagcgtcatgtcattgcttcctggtggtagcctcagactctttgctgcgccttgacccgtatccctaaccccacagccatgtccactgttggtgggaactcagaaggtgccccctgtgtcttccccttcactttcctgggcaacaaatatgagagctgcaccagcgccggccgcagtgacggaaagatgtggtgtgcgaccacagccaactacgatgacgaccgcaagtggggcttctgccctgaccaaggtacgaggccctggtcattggacagagaccctggacattgcccttgcccctaaacttgctccaaaaaccttcctgagacctcacccacttcaagcatagacactgccccccagacacccacctacccagacccgcccacctgggctgagacaatgcccatctctggtggagccaaggtccctgcttagatcctgcccatccaggtggaggcacagcctccaaaatcagaccctggtagaccagatgctgctactcacctcccgggtaagaactggccttcctgaggggtcactgctcttgtcttccccttcagccaccctccaggcgggcttgtgactaccaaaattggctgaattctgagcacagattaccagagagacaattctcctaagagacattcccactgcacaaagaggtgccttcaaggagctggtaggcagtagaagaaaggaaaaaaggaagagcctcatgcttgatctgacaccatggtccacgcagccctgggggagcccccagagccctctctcccccatcagtcagcaccatctgttaccagggtgtaaatggtgggtcctcgtcagtcctgggtgctgaggatggagctgactgggacagctctctgccccctaggactcacaagctcaggggagagagtgaccaggagacagcttgtgaccttactatgtgctcagtgcagtgagcagggtgcttggggccctgtgcccaatctaggctacagagcccagggttgcagggttgcttaaagctccctgatggcccataatggccaggtcagtgggcaggtccagggcctgtcagaattaggcaagcctgtctttatgttgctttcattctttttaatcatcatgagatggaacttggcagatgtcagtggacagaggctggccaaaggaggttttcttatcccctgctaaattccttgctaggacacagtctgattttaccagcttaaaggtgggattctccaccttcctgagtggttcaagtatccagagctcagtggctcacccagggtgaatattatagtctcctggggctgccatgacaaagtgccacaaactgatggcttgaaacaaaccccatgtattctttcatgcttctggaggctggaagtctaaaatcacggcgtcagtaaggccatgttccctctgaaggatgcgtcactccagtctatgcctctgtcatgacatggatggccttcttccccctctgcttgcctctcctccttttttttttttttgagacggagtcttgctcttgcccagctggagtgcagtggcatgatctcggctcactgcaacctctgcctcctgggttcaagtgattctcctgcctatttccaaataagttcacattcacaggtccctagggttaagacttgggcaaatcttttctggggggacgcatttaaccacaacagggtgtgacacaggttttgctcgctggctgtggctcagcctgtgcaaccacgctaagtgtgaaaggtttttactgctttcacctgggcagaaatggtggcaacatggggccagcctatccccactcttcttacctcttcagagaggctgaggagctgggtttgtagagctcatcttttatagagagacataaaaagccaggaagcaggattttaaaatgaatggggttttaagtagaaaattcgcagatactacttgttctgttcctttatagcacacctgtcctgatactgacttggaaagagacaagaagactttggctgaccccacttggaaacaataggcactaatcccaaaattgtgtattgatcccagaattctcaggaaaagaaaaaaaaaatcaatacatgccgcttccagggttctcagccttactgtggggctgtcctcaaaagtctgcatcactgggtcaggtcttgacttctctctcatctctcttcctgtctttcaaccctctctcctccctgcaaccctcagggtacagcctgttcctcgtggcagcccacgagtttggccacgccatggggctggagcactcccaagaccctggggccctgatggcacccatttacacctacaccaagaacttccgtctgtcccaggatgacatcaagggcattcaggagctctatggtaaacctccgggcgggggttgggggtggagggtgaggagggggcaggtcatgtagcctgggatggaggcccagggggtgggaccagcaagatctcatccagccaggagtgctggagacgagggcaggaaatgggagtgttgacctggtcttgggaaggcagagcagctctccaaggggatacttggataactcttccctatccgaacaatgctaatatccatgtcactcttagcgctccatttctgggtttctcccattttctaggtgagtaaggtcacctggtgcaaggttacacaggtttgagcaacccagtggagtttagaatccaggagaatagccaagtacaggacagaattttccatcatgtggaatgaccttaacaatacgggggtggaagtttctagttttcataataagctttgatttttagtatgtagtagaaacagaacaaccagtgccttaagccaattatttatttatttatttatttatttatttatttatttatttattgttggttcttacagtgaggctagagtttaaaaagtcagttcatttttaaaaaatatttaatggtccaggtgatatctgagccaggccaaaatagtgaaaatggtgcttgagtgatgaagtttggggactgctagactcaggaaaaagcccaaggtctgccgtgaggggtgctgggttcaaatgtggcctctgcccttcactagctgcaagatattgtgtaagtctttatacctctttggactcagtttcctcatctctaaaataattgcttatcatgaaaagtgccatactgtcagttctggacacaccagcggccccctgaccgccctgactcttgtgggcataagaatctgagctttgggtttgaatccttgggcaagtcactcaacttttctgggcctcagtttcctcacctgtgaaatggtgcaatcatgataccccactcccagggctatagagaggactgatttgggtgatgtcagtaaaaaacatatataaagtacaaagggccccaggactccccaagtccaggcatcttcttgttaccttacggagcttacactaaggccagaaggcgatttcttctgactcttagatggttgggtgggcacccctgggggctcaccctagtggggagaacctctggagctgcagagagtctaaggtcaggtgttctccccaggggcctctcctgacattgaccttggcaccggccccacccccacgctgggccctgtcactcctgagatctgcaaacaggacattgtatttgatggcatcgctcagatccgtggtgagatcttcttcttcaaggaccggtgagtgcaggagcttgcttcttgtcctccttgtctcctgtcctctgctcttataccattattcttttccctcactcttcgctgaagactccaccaaatgcttcccagaatgacctgaattaggcagtttctgctgtgtatcaaacaacctccaggtttcagtggatttgcacccaagcattttgtttgctctctcatagtctgtgggtctactagttatcttgactttcagctacagtttgggttcaggtgtgctctgcctgttgttctcatgggattagcagctactcatggcagatgacagggtgcaagaggccaaactgaactacacaagctcatttaaagcctccactcacatcttgtctgagaatattccactgcctgaaataagtcacatggccaatcccaagacctaccctagagggtagtactgcaaagtcacatggaaatgcatatgaatgcataatcctaaaatcgaaatggagggaagaattgggaaccataattcagtctaccacaggccttctagaatggcgttgccctcaaatggccaaattactctgtgtatgggtggtgagtgactgcagagtagaaagaggtggtattcttcatgctatagataaagatcaccactcagttgactaaagactgaggtttaccctaatgccctagttccctggagaatggcaggcagtatctaggacctcattaaagggtctgtccttccattcttctatcatccatccatctacccatccatccatccatacctatatctttccatccatcatccatccatccagccagccatctattatccattatttatgatccagccatccattattcattattcatccatttattcattcatagagtatagtagttgagaaaatggactctgaagccagattctctgggttagaattctgtaactgctacttactggttatataatcatagacaagttaattaagtatcttctttgtaccttggtttcctcatttataaaatggggctaatattccaacctatctcctagggctgttgtaaggattagatgaacttagtgctgagaacaaaaacaatgcctgacacagagtaagtgtattcatattagctattgttattgacaaataattgtttggcatctactgtgccaaatactttgctaggctttagtagctggaggaggaagaatgatgttctcgggacagtggggtggggggctgctagatcagtgttctcaaagacaggcgcatgggcctcctataacagaaccatctagagtgtgggtattaaaaggtgggttttctgccccagcttcagaccctcctgactggaactctggggctaggccccaggaatctgcgttttagcaaattctcccagtgattctgatgcacattaaagtttgtgcatcacaagtccagtttgagaaataggcatggagaactgacatggcaagatgaaagaaaagtgatcgcagaggtgttaggtgcttttgtgagcacgtcccagtcaaggaaggcttcacagatgcagcagcatttgagcagagccttcaaaggagaagcaagaatctgatgggggtgacaagttaggaggttctttgagacagagggacctgcagagccaagccatagtgatgtgaaagtttctggattagccagtgagaatctggtgaggctagaagatgttccataaactttcaggaagagtttcctctactctaggcactgggccaaattctggggtgcagatgccttgcccttcacagggtctgctggccaatggggaaatggcaagaatgcaatgagagatgagacttagaatgtagtgagaaatcaggtcccgtcaggcctcgaatgcccaaatcaggatatataacagcagatgtcagcactgctctgcagttcccattgtaaggatctggcaatgtgcttcatctggagctcctcccactaagaaagccctgaccacacatgcagatctcagatgtgtggggcctaggaaaggatgcagagcccagacccaggctggagccatccctggcctaccacatcacagttttctttcaaaaggaacgtgatgagtgtttaatgggtttatttgattaaccagtaaatattaaacttcaaccatgagcaaaaattgctgctaggcactggtgagggtgggggtcatgaaggacagtattgcaggatgattaaactcagactttggagtcagatctggatatgaatcttggtaataactaatttatttagtcattgatgtagtgataactaagtaatttgaatcctaacctctctgagcttcatttgctaaataaaaattgtgacaccttcctacgctaggatgtttttctgcaaataacagagaccatccctctgcaaactcaatccagcctaaacagtagagagaaattgctttcatttggtacaaagtccaggggtagagctgcctgcaggggcagagagagggtcagtgacttgatgtctttgtccactgctagcctctgcacttacttcatcctaaggccggttctacctcatggtcacaagaaggttaccagtggcagttggggctctaatccctgccctctcccaggaagcgagagagaaagagacacgcacagatacacacacacagacccccagatgtgaaatacaagtctgtgtgttccgtctttacaccactgtaagtcatatggcaactgctgaatcagtaacagtgctagggaatgctaaactctgattggcttagaccagtagttctcaaaccttggcatgcgttagaatcatctggaaggcttgttaaaacacagattctgggccccaagcccagagattcttatctgtagatctctgtaaggacccaatcatttgcatttctaatgagttctcaggtgacgcagatgctgctggtcaggagactgcactttgagaaccagtggcttataccaatcagtatctacccctagaatgggggtaggggacacagggtcagaggaggtgaaggctggatcataaatgtggagttttgtgaagaaggatggtggggaaatagataattaatgctaggtagaccatccagagtgcatgctgtcttaaaagattgtggggattaaattacaaggcacataaataaagcacatggcatttagtaggaccctcaataaatgataactcttactcttgacaaagtacacaaattcatttcattttaattcaggaaatacttgagtgtcatcagctcctgccccaattggcctctaatcaaataggagagttaagacaaacagacactactgttccaggcactcagagttgatgattttgagaggcttagagagggaaaacacaatatggatggaggtagtcagggaaggcttcctggaggaggtagagggagagaacagggtaggaggatgtttctcagctccagcagattgcagacaggaactctgcccgttctccagtccttctccaaccttcctttgatcctgcctcccactcccatcatggaatcatctctgggatgtttctgggtgggtttgggggggtgtgtggttcgagctgcagggtgactgaagatgtggtttcctgtgcccccttgcctcctgccaggttcatttggcggactgtgacgccacgtgacaagcccatggggcccctgctggtggccacattctggcctgagctcccggaaaagattgatgcggtatacgaggccccacaggaggagaaggctgtgttctttgcaggtgtgtgggaagcacccttccttggccctcagctccacagggctctgcaccagggctcctgggtgtcccaggctcactccccctctcaaaccacagttcctatgcacccgtgggtgctccctttcctttatggattcattctttcaacattatttcctgaagtgcgcagctcctctgggagattggttccgacacccaacatcagatagcattaaccctcagtgtacacatttcattttcttaattcttttcaatccgtctcatttcttttctagaagaaaaaaaagtctcagtttagtgctggtgtgtccctaacgcctttgtagtgatacagtctttggcaggtaacagttttagttcgaatgttttaaagaatatttgttttcatttttacttttagacataaattggttttaacagaggcagttagttataatagtgtggagtttcaaatcaggacagaaacggattattcagtaactgatattttgacagtcaaaaaacattttttaataaatttatttttaaagatttcaaaatgaattcactgaaagcagaatgttaagtaaataatagtacagggagcccctagaagtggtagaaatcatcaaggtgaggtctgtatggctaaggtttactcatttaacatttattggagcatttccatgcgctgggctttgccataccctggggatacaagctctgccttcgcgatgctcacaaaccactcagggagacagacagctgggctcttatgaggggtaaagaaggatttaggaggtccctgtcctggtctgaggtgggatcctagagaagataaaggctcagccaagactgttgtctccaccacctggctcccacctcccccaatccaccgtaatcatgggtcccggagaggacaactgctggctcctagggcacctttttgcaaattagcaaaaggtgcctctttatgacagcaaggcccttagagtgcacgacttggtgagcagagtgtgagctggatttatcccccaactcatgtccttgaccaggcaccttctgtaattgacttctaaagccctctgtgtgagccctgattctgggcactgcaaccaggagtgagcaggaagttgcactctgttgggaatggctgcagtggggcccgtggacagacagatgatgggaggaacaggctggcctagggcatgtcagcaccagccaacacaccctttgcttccaccccagggaatgaatactggatctactcagccagcaccctggagcgagggtaccccaagccactgaccagcctgggactgccccctgatgtccagcgagtggatgccgcctttaactggagcaaaaacaagaagacatacatctttgctggagacaaattctggaggtaagggagggcggtgggtaggacagcagcacagttggctgcgagagacagagaagccgccctgaggcttcaagcctcctgggctgagttcagaggttggtgggctctggatgccctctctctggtatctaacctctttggtctctggcacctctgagatgttgccaaaggtgaaccattcttgtacacattgctgatataattctggtggaatatcctttctctttgcagaattcttttgattggcccatgtctggtctggaccctcacattttgaaatgactcactgaagaagggggtaataaaaataaagataataactgctcctattgacactatgtgtcagagactgtcccaagggttctatgggataggaattattattcctcccattttactgatgaggaaacctgggttcagaaaggttaggtaaccgtggctgggcacagtggctcacgcctgtaatcccagcactttgggaggccaagatgggtggatcacttgagctcaggagttccagatcagcctggccacatggtgaaaccccatctctactaaaaatgcaaaaaaattagctggacatggtggtgcatgcctgcaatcccagctactagggagactgaggcaggggaatcacttaaacctggaagacagaagttgcagtgagctgagatcatgccactgcactccagcctgggcaacagagtgagactccaactcaaaaaaaaaaaaaaaagaaaaaagaaaggttaagtaaccagcttggagtcacatagccaggtagggacaggttgggatttgaaccctggcattctgtctcctgggaaaacatgttagtcttcactcttcactactattctatacccgagatggtggaatgggggttccaagagatgggggaacatgaaggcagtggacaaaatatgaagaagacttagagatgggtgcaccagtcatccatagaagccagcatccaaatcagaccccatggaaggagcaggtgccctgtgtcatgctcacagcaggcccgtggctgtgggtgcaggttggcaggggaacaatttggaagcagatggttctgtgctccaggttatctacaggaaagggtccagttctgaggggctatagtcatgaccagggaacctaatatccaggagtggctggtgagaggtagcccaaacctcaggagtttgactgtaattcttcacactttctagaaaaggaaacggaggtccaaagaaattaaataacttgttcaagctatagagatatgtgtatttgcacaaagccaggattatagctacttctcttgtattctaactgagtaccccctccactatacctgccagtccatttgattagtgaggaaagagtggtcggggcacaaagacttgtggtgtgtctttccatcccctccctcctggtatccccacattccttccatggctgccactgcatctgggccctacccaagaattttagagggcacttcctgaggcctttgtctgccatccccaaaacaatcccgcttacttcctaaggcctctgtcttctcccccttccctcctccccactactctgccccccagctgccctgcattcagaaactctttatatcccaggcctgcccatgtcagggtggaattccagacatattgctaagacacttagcaacctaagctgattgatatctcaagcctcaagaaagaaaacagtcaggcaggaaaccacagagcaggctttccacccaccagctccagacactagccccagacagtgtgcacgcacacgcacacacacacacgcgtactgcgaatggcatctcagcattgtaggagccctgaatctccaagtcttagaattgtggctggtgagccacacagactcacagaaacgtgaatcttagaatcctaaagccctgaagttttcaaattatggtgttggaagaactttttaaatcacttttccatgcactgtatctatgtaaacatgcaaaaacagacctgttcctagcatataggaacatgattgtgtgcgcatgtgcgcatacacacacacacacacacacacacacacacacacacacaggcatggaggttgtggcagtgccttgctggatttccaggcagagttatttgcctcccagtccttttccacacaagcccacctcccaaagccagagccaggacagacagcgtgctctacagaggaaccaccctgagacttcctgaaaagggacagagctgaagggcctatcagaagctctgggctggcttccaaaggagacagatctctattccaagagaagtggtgaatgagcttgtgacactggccctgccgtggagtctgcagaggccccagaggcatctttgctggagaaggagagagagccccagagtgacagaggctgagcagctgtcttcagcatgccaagaagagctcaggccctgcttgtagaagctttcactaagccacaaatatatgttccacatctgctgtgtgccaggcacttagctagctgctggagagacgggggtcaaaaaatcatcacaccctgccctcatgtagtttatagtagaatgagggaaaattatgtaaacacatttgaatcagataatgatggctctcagtatggggcctctaccatagcccagcctgaggctatgcaggtcacctatatttctcagttgaggtagatactgttagctccttttcccaagtgtggaaactgaggctaaagtggctcaaggaaaagctgggacacaaatatctgtgttcttaacacctgctatacatggcaacttctacagctgcagagaagtaccacatcttctgacaccacagtgcttgtattctttctggatgaaaagaacttggaagcaaactaattctcttatctgagactcagtttcctcatctgtaaaatgggcttgacttctgccatccccaccttctgtgggtagaatgagaaagaaatgagggccagttcaagtgtgggacacacatctccaaactatcctaacgctagggaatgtagtttgagggctcagtggaggtgccttggatgggagtgttgggattttgagctagggaacttggttttggtgacccagggcatgaggaagcatgccaggttttgtaagaatgagttttatgctgcacctgggattaaggaaggcgttagttcttcggggtgatggctgagggagaagtccctttgagggagaagtctcctctagaagggagcatatagggaaagctgctgttggggtccagggtggaggtggtcaaggctggctgcagaaaggaagggagccccctaggaggcactgtggagcaaaaggtggctgctaccaggatgggatgcgaacacagattcatctagaaacagctccacttgggcaagacttgtttactaggatatccatagctcccatagtgggagctcagtaaatatttatggaataatgaagtggagaggcaaaggaatcaacatgacagcagcatttaaaaagttctccaaaaatcttaaaagacagaaggattgctagccagggagaagaacatactaaccgatgcccaaagtatttacctgaattaaaggcggggcccaggattgctgccgccggaactgaggtggcatgtggcccaccctgtgactaacaggccttggacttacacgtaccttccaccttgcattgtaacctcactgccccagccatggtcatctcccagggcagggactgtcatctccctgtggcagatgaagaagcagcaatttttccaagccatgaagtgaaagaatgatggggcagattcccatccctgggcttctagtttagcactcctcggattacagcagggatttgtttgtaagggagctaacatttcttaagtacctactaaatatttatgagacatggggatagaggctctgcatgtgctgttttatttaatgcatgcattaaattaaatacactaaattagacacaaccccattttacagctggtaaaactgtagctgtatggaaagtggttaacacactgtttggcatgtagtaagtgctttataaatgttagcagtaatcatgagattgtttttatggggtcatccaaagtcatataattaaaagtggtagatctgaggctcagactcaggtctgattccatgcccttccttccactgcagctggctgcttccctgaagggctaggtccagtttccgaggcctatccaggagccatcagctgggtgctcccatccaggccaggggggaagtgtcctttagagaggccctgctggttcactgtgtctgtttctttacagatacaatgaggtgaagaagaaaatggatcctggctttcccaagctcatcgcagatgcctggaatgccatccccgataacctggatgccgtcgtggacctgcagggcggcggtgagccacccaggactgtctccgctttctaggactccccgcccctagccagggcccagctccttgcaaatacacacttctttattgtgcagggcaggcaggcaggcggcgcccaggaaaacaaatcaactccttcatcctagtgctgggaaggtttccagatccctgacctctgctccttggcctggctccaggcagtaagacccagaaagacttctcacagctgcagggcctggagccagggcaggggagggcggaaggcctgggccaggggagaaggaacatgggctctgtgccgtggattcattctggggtttgatccaggcccatttgcgttttgcaggaggcctgtgaccacctcccattagcagaaggatggctccatttgagacaaggcaaactttgtcatgctctgttgctcatgtggcaaagatcctccactcaaccagtttgcccctggccccctgctgattaaaacacaaccagtagcagcgagggatagaatttggagtttgaaaatcatactcttgaggaggcatctgtgagctttctagggtcctggaaatgggtccagtttggctttttttagaggagatttcaactaaattccacagatttttttttttttgagcacctactgtatgctaagcacaggccctgacctccagtagctgaaggtcttacatgtccaagaaaatgcagtgtacaatcagatgctagattaggagttatcttcaagaataaacatctattgagcacctactacatgctagcatattaatagtaaatgagattatgtatgtcaggagtcacaaactccaacagctccatgtgtcaggcaggtagcacaaatgagtaaagcaggcaggggcagacagtggggaactgtggagtctgtgcggaatcagagcacatgcctcatttacaggagacactttcttctcaccttcagataattattggcgggcaagattaggggcctaggcagctgccatggttcacacctgtcatcccagcactctgggaggccaaggcaggagaactgcttgagcgcaggagtttgagaccagcctgggcaacatagtgagactctatctctacaaaaaaattttaaaaaacattagctacacatgacggcgcatacctgtagtcccagctactggggagggtgagcagagaggatcgcttgagcccaggagtttaaggctgcagtgagccgtgttcatgccgctgcattccagactgggtgacagagtgagacctggtctcaaaaaaaaagaatggggcctggtgttgttagatattctatattagatattctagtttttttaaaggaagccagaaatctgtacttctgtgtgactttttggatgtttacatgttggcaagttattcagatttaaagacaaaacaaaacaaacttgtgagagtcaaataaaacccatctgtgggcctgacaggactggatatatcctgttttgccacctctggtacatggaatgtgcttagtttgatgcttgtgttaagtggagttattgtttttaataatagcatatgttatctgacttaatgctcactgcaagccctagaaggttgataatctttatcctcatcttagagatgagcaaacagggaataaaagagcttatttcacagccatttcccttcttccactcccagagggggctcttctgggcttttgttgtgttttggttttgtttttgttttcttttcttcaatcagctcagattgaaacaattgaatttttttttttttttttttgagacagagtctccctctgtcgcccaggctggagtgcagtggcgcgatcttggctcactgcaagctccgcctactgggttcacaccattctcctgcctcagcctcccgagtagctgggactacaggcgcctaccaccacgcccggctaattttttgtatttttagtagagacgaggtttcaccatgttagccaggatggtcttgatctcctgacttcgtgatctgcccgtctcggcctcccaaagtgctgggattacaggcgtgagccaccgcgccccgccacagttgagtttttttttggcggggggacaaggtcttgctctatcacccaggctagaggcacaatcatagctcactgcagcctcgaactcctgggcttaagcgaccctcccacgtcagcctcctaagtagcttggactacaggaatgtaccactatacccagctaatttaaatatgtttttcgtagaaatgggggtctctctatgctgcccaagctggtctcgaactcctgggctcaagcaatcctcctgcctcagcctttcaaagctctcttctcgtttaaaagcttcttccctatgccaggcagaaattcaaagttcccaggaagcttctgtgtgccagaatgtcaggataagggggtcacggtctcttctttctctatcccaggtcacagctacttcttcaagggtgcctattacctgaagctggagaaccaaagtctgaagagcgtgaagtttggaagcatcaaatccgactggctaggctgctgagctggccctggctcccacaggcccttcctctccactgccttcgatacaccgggcctggagaactagagaaggacccggaggggcctggcagccgtgccttcagctctacagctaatcagcattctcactcctacctggtaatttaagattccagagagtggctcctcccggtgcccaagaatagatgctgactgtactcctcccaggcgccccttccccctccaatcccaccaaccctcagagccacccctaaagagatactttgatattttcaacgcagccctgctttgggctgccctggtgctgccacacttcaggctcttctcctttcacaaccttctgtggctcacagaacccttggagccaatggagactgtctcaagagggcactggtggcccgacagcctggcacagggcagtgggacagggcatggccaggtggccactccagacccctggcttttcactgctggctgccttagaacctttcttacattagcagtttgctttgtatgcactttgtttttttctttgggtcttgttttttttttccacttagaaattgcatttcctgacagaaggactcaggttgtctgaagtcactgcacagtgcatctcagcccacatagtgatggttcccctgttcactctacttagcatgtccctaccgagtctcttctccactggatggaggaaaaccaagccgtggcttcccgctcagccctccctgcccctcccttcaaccattccccatgggaaatgtcaacaagtatgaataaagacacctactgagtggccgtgtttgccatctgttttagcagagcctagacaagggccacagacccagccagaagcggaaacttaaaaagtccgaatctctgctccctgcagggcacaggtgatggtgtctgctggaaaggtcagagcttccaaagtaaacagcaagagaacctcagggagagtaagctctagtccctctgtcctgtagaaagagccctgaagaatcagcaattttgttgctttattgtggcatctgttcgaggtttgcttcctctttaagtctgtttcttcattagcaatcatatcagttttaatgctactactaacaatgaacagtaacaataatatccccctcaattaatagagtgctttctatgtgcaaggcacttttcacgtgtcacctattttaacctttccaaccacataaataaaaaaggccattattagttgaatcttattgatgaagagactgatggctcaagagaagtgatttttccagggtcccatagctattagggacctacaaggccaaaggatagcctagcagaggagctttagctctcaaaccagaatctcaccaccctccgccaccctcaaaaacacccccaccaccttcaaaaccgctcctgctaccctccaccacccccaaaaccacgctgggtaaacacagctaagggagaaatactgtgctttcttctaaacacagctggtattaatggataagctcgttactccttcctaccagtctacccactcctaatctcctacatagaaattctggagctactgctgaacagaaattgaaggcctggggtttttctgaggccctttctggctccgatagtctgattgatagtatatatattgcttctggcctcttatgatggggctggtgaggaaggtgcgtaaggagtgaactctacaggtgacctcctcagtgagcctgatgtcattgtttctatctcttttttctgtttttgagatggagtctcactctgtcacccaggctggagtgcaatggcgcaatctcggctcactgtaacctctgcctcccaggtttaagtgattctcctgcctcagcctcccaagtagctgggattacaggtgcacgccaccatacccagctaatttgttttgtattttggtagagacaggtatcaccgtgttgcccaggctggtctcgaactcctgagatcaggcaatccacccatctcggcctcccaaagtgctaggattattggtgtgagccaccactctcggccccatcttttctatcttttatcctcccatggcctgtccccttgactcagattctttttgtttcttcttcttcttttttttttcttttttgagacagtgtctttctctgtcacccaggctggagtgcaatggcatgatcatagctcactgcagacttgatcttctgggctcaagcaatcctcccacttcagcctcctgagtagctgggactgcaggcatgcaacagcacagccagctaatttttaattttttttagagatggtggagtctctctttgttgcccaggctggtctcgaactcctgggctcaagggatccaccctcctcagcccccaaagtgctaggattacaggcgtgagccactgcacctggcctggcttaggttgttgacagttggaaagacatctttctgtgcaggtatctggctaaagagtctcaagggtctgccagtcccaacttgaagaccccctagactggggaatcttctatcatggctgtaatgcactgttattaatgttccctgttacactgagagaaaagtcagtggctccacaacataataatgcttaaaacatgccatttcttcagtgtttctctatgaacactacacatgcattattttatttaatccttgctacaattctatggagttagaatgaatctcccattcctagacaaggaagcaaactcaggttaagtgactgactcaaggccacacatctatgtggtagggctggaagattctgacattcagaggg

SEQ ID NO: 12384 - DNA, 39154 bp, Human
  misc_feature (1)...(39154): n = A,T,C or G
tcatcatcctcaggtcacaccacccctcttcctgtcaccagcacttcctcagtatctacaggtcacgtcacccctcttcatgtcaccagcccttcctcagcatccacaggtcacgtcacccctcttcctgtcaccagcacttcctcagcatccacaggtcacgccacccctcttcttgtcaccgacgcttcctcagtgtccacaggtcacgccacgcctcttcctgtcaccgacgcttcctcagcatccacaggtgacaccacccctcttcctgtcaccgacacttcctcagcatccacaggtcaggccacccctcttcctgtcaccagcctttcctcagtatccacaggtgacaccacccctcttcctgtcaccgacgcttcctcagcatccacaggtcacgccacccctcttcctgtcaccatcccttcctcagtatccacaggtgacaccatgcctcttcctgtcactagcccttcctcagcatccacaggtcacgccacccctcttcctgttaccggcctttcctcagcttccacaggtgacaccacccctcttcctgtcaccgacacttcctcagcatccacaggtcacgccacccctcttcctgtcaccgacacttcctcagcttccacagatgacaccacccgtcttcctgtcaccgacgtttcctcggcatccacaggacatgccacccctcttcctgtcaccagcacttcctcagcatccacaggtgacaccacccctcttcctgtcaccgacacttcctcagtatccacaggtcacgccacctctcttcctgtcaccagccgttcctcagcatccacaggtcacgccaccccccttcctgtcaccgacacttcctcagtatccacaggtcacgccacccctcttcctgtcaccagcacttcctcagtatctacaggtcacgccacccctcttcctgtcaccagcccttcctcagcatccacaggtcacgccacccctgttcctgtcaccagcacttcctcagcatccacaggtgacaccacccctcttcctgtcaccaatgcttcctcattatccacaggtcacgccacccctcttcatgtcaccagcccttcctcagcatccagaggtgacaccagcactcttcctgtcaccgatgcttcctcagcatccaccggtcacgccacccctcttcctctcaccagcctttcctcagtatccacaggtgacaccacgcctcttcctgtcaccgacacttcctctgcatccacaggtcaggccacccctcttcctgtcaccagcctttcctcagtatccacaggtgacaccacgcctcttcctgtcaccatcccttcctcagcatcctcaggtcacaccacctctcttcctgtcaccgacgcttcctcagtgtccacaggtcacgccacccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaacaccaggtagctgccaactgcctcgcctttatgtctcccagtgggccccttggcggaattcagcctaaggagtacctgagaacactggtgcattcgcattacctggtggggccgtgtcaggtcccacaggggaggaggtgatgggtgtggtgggtgacaggctcaccctcctttgtgccgcaatcgaaaagcactgatgtcgagagtagtttggatatgagcaggggagagacaaggagtttccagctctctcttccagctcctgatttctttgaatctctttgactctcctgttttgttactgtaagaaacaccccgccttgtcttttcacgtgtccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggtgaggccatacaggtgaggcctgtgccttttgaggggtgatgtaactgaaggctccctctcagcctacttcccacagtctctgctctctcgggtggggagagccttaccgaggacagggacacagcatcggagtcgctcctgagggctggctttgtgcatggcactgggccaggagctggagacagagaaatgaccccagtgccattcagcaagggatagatggacggtccggtagcggcggttagaggactcatcccagggtctaagtgcacacaatggaaggccctaaggaatgcagagccggggatggaggagcaccccaggcagggaggagggcgggaacagctggaacaaaggtgtggaaggtatgggtgtggaaggtatgggtgtggaaggtatggccgtggaaggtatgggtgtggaaggtatgggtgtggaaggtatgggtgtggaaggtatgactgtggaaggtatgggtgtggaaggtatgactgtggaaggtatgggtgtggaaggtatgggtgcggaaggtatgggtgcggaaggtatgggtgcggaaggtatgggtgcggaaggtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggtatgggtgtggaaggtatgggtgtggaaggtatgggtgtggaaggtaagggtgtggaaggtatgggtgtggaaggtatgggtgtggaaggtatgggtgtggaaggtatgggtgtggaaggtaagggtgtggaaggtatgggtgtggaaggtatgggtgtggaaggtatgggtgtggaaggtatgggtgtggaaggtatgggtgtggaaggtatgggtgtggaaggtatgggtgtggaaggtatgactgtggaaggtatgggtgtggaaggtatgggtgtggaaggtatgactgtggaaggtatgggtgtggaaggtatgggtgtggaaggtacgagtgtggtaggtatggctgcagaaagtcgtcccggtgctgcatggggagtggatccccgaagcatttggggtggctgaaaatgagaagaagggtagcaaaaagtgcggccggcatgcggggaatcctgtaggcaacgggagccagggaggactcagttttgcattgtacaaatggcatttaacaagtggtgcctggagcggtccgatttgcaggcagtgaggaggccaggagagcctgcgggtttccaagcaggaccaggggagggcgccaaggagtcggcagctgcgagaaatatttgggacaaggtttctcacactggagcccgagggcctctagggagtcctaggttaaattggaggagtcttcaagtttatctggagaaaggccgtcttaggaaacaagtctcattccctgaaaagggctttgcagttactcatcttcattgcgctggacttttgtctatttttttttttttttttttgagatggagttttcgctcttgttgcccaggctggagtgcagtggcgcgatctcagctcactggaacctcagcctcccgggttcaagcaattctcctgcctcagcctcccgagtggctgggattacaggcatgcgccaccacacccggctaatttttgtattttaagtagagacagggcttctccatgttggtcaggctggtctcgaactcctgacctcgtgatcctcccgcctcagcctcccaaagtgctgggattacaggcgtgagccaccgcacccagcatagacttttgtcttttaaccctgaaaaggattgagactaagagattgagaatcgtttgctggtattctgacagcaggacctgtttttctccaagctggggaaggatgagaggcgcagtttagggagtaaaatgaccacatgcatttaatgtgggtggagagggagcgagaagcaccctagatggctgcctctggggccctcggggaacacaggacaggtgtgggcagcctgcggggagcgctctgggatccctttcagccctaaagaaggcccaggcccacttggacttcctgctcttctctgtcctggcccaggagtttccctcttcccctatggggcagacgccggggacctggagttcgtcaggaggaccgtggacttcacctccccactcttcaagccggcgactggcttcccccttggctcctctctccgtgattccctctacgtgagtccgggctgcggcccgcgcagcctgaactcccagggcccacttctctctcctgcttcgagacggaacccagaggaagcgggaatggaagcagccttggctgggcccctcgtccatccccacagcctccttaatgtcaggcctctgcctgaggaacacagggtgccaggcgagggctgcccacctgctgggcccaccgctgcttctgcggggccttctcaggagtaaaaagctacacttgggaaactggactgttcctgccgtttccaccttctgggatttgtctctggccccctggtccctgcctcctggagcagagttggagggacagtcctggctcctgtggccctgagggaggaggctgagtccgaacacagcatgagagggcgactgagcgatggagagggtgtccacacctgctgagcgatagagagagggtgtccacacctgctgagcgatggcgagagggtgtccacacctgctgagcgatagagagagggtgtccacacctgctgagcgatggcgagagggtgtccacacctgctgagcgatagagagagggtgtccacacctgctgagcgatggagagagggtgtccacacctgctgagtgatagagagagagtgtccacacctgctgagcgatggagagagggtgtccacacctgctgagtgagagagaggtttccaccccctaagtgatggagatggggtgtctgcacccctgagtgatggagagagggtgtctacacccctgagcgatggaggggggtgcctacacctgctgagcgatagagagaggtttccaccccctaagtgatggagatggggtgtctgcacccctgagcgatggagagagggtgtctacacctgctgagtgatagagagaggtttccaccccctaagtgatggagatggggtgtctgcacccctgagcgatggagagagggtgtctacacccctgagcgatggagagggggtgtctacacccctgagcgatggagagaggatgtctacaccccgaacgatagagagggtgtccacacccctgagcgatgaagggagggtgtctacacccctgagcgatggagagagggtgtccacacccctgagcgatggagagagggtgtctacacccctgagcgatggagagagggtatctacacccctgagcgatggagagagggtgtctacacccctgagcgatgaagggagggtgtctatagccctgagcacccctgagcgatgaagggagggtgtctatacccctgagcgatggagagagggtgtctacacccctgagcgatggagagggggtgtctacacccctgagcgatggagagggggtgtctacacccctgagcgatggagagaggatgtctacacccctgagcgatgaagggagggtgtctacacccctgagggatggagagagggtgtccacacctgctgagtgatagagagaggtttccaccccctaagtgatggagatggggtgtctgcacccctgagcgatggagagagggtgtctacacccctgagcggtggagagagggtgtctacacccctgagcgatgaagggagggtgtctacacccctgagcgatgaagggagggtgtctacacccctgagcgatggagagagggtgtctacacccctgagcgatggagggagggtgtctacacccctgagcgatgaagggagggtgtctacacccctgagcgatgaagggagggtgtctacacccctgagcgatggagagagggtgtctacacctgctgagcaatagatagagggttccaccccctaagtgatggagatggggtgtctgcacccctgagcgatggagagagggtgtctacacccctgagcgacggagggagggctccacccactgagcgatggagggagggctccaccccctgagcgatggatagagggttccactccctgagccccacctaatgtgtcgcaaacttcaggatggggcccaggggactggccaagaggggtgtgcctgtgaggggctggtccacggccagggatctgcagtgaaacaggaccaagcctaccacccgaggacgcaagggatggcctgagggcggagcattctgtgagattatatggaaagggctctccccaaaacaggacacaggaggtgacttccaggggttgttagcatctctaaagctctacccttgggggtcacgcttttgaggagctggaccaaggctgggactttcctccccacttccctccctgaatgctgaccacaaaacccatgtgctcagttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggtgagcctttcaaagcctggcagtcaggatcccccagcagctggcaggggagacaaagagctgtgtggaaggctttgccagagttgctgctgtgacagcccctgcagcaggggactgaggcttaaatatgggtgtgggaggaagcagtcaagggacattaagctgactcaggagtaccccaacccaaccacgagactgaccaggaataccccaacccaaccacgagactgaccaggaataccccaacccggccgcgagactgaccaggaataccccaacccaaccacgagactgaccaggaataccccaacccaaccacgagactgaccaggaataccccaacccaaccacgagactgaccaggaataccccaacccaaccacgagactgaccaggaataccccaacccaaccacgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccggccgcgagactgaccaggaataccccaacccaaccacgagactgaccaggaataccccaacccggccgcgagactgaccaggaataccccaacccggccacgagaagacctgcaggtgacgggggatgggggctgacaattcagcctttgattgtaaaatcaggctgtagggggtctgtcctaacaagagtgagtcaagagggcccgtcctgtgctcctggactgggtgaataactccaatcagaggaaatgtgatgaaagctactgcaggaagtgtggaccgtgcccctgccacggacagggcagtgtggaggctccaagaggaagagactcacgcctgttctcaagaagctgcagattaggcatggggaggtaaaagtgggcccgagtggctctgctctctgggccagtttgagctaagatgcttgagttcaagtccagaggtcttggacgtctgggccacgaccctgcattctgcacactgcaggccttcctgcagcccaagtttgaattgaacttcacctcagaaaagctcacggcaaaaatgcaggcctgggacaggggagggcaggccattgggtgggctgaagtgggcagggtcctcaggcagaaagtggggggcccatgtgtaggagtgggaccctcgttggcttgttttcatctgccctcctttcctaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcggggtgagtagacccctgggcagctcccaggagctatctgggagtcagacatcctagaatcctaggcaggggccactcttccaaaatcctctctggctctaggaaagattgctaattatagcaagcccccccaccgccacccccccactgccaccactgttggctgagcactcaccgtgggcccggcctgtctcggccctttgcctacttgacctcacagcagcccagcaaaccgggtattattaggctgaaacatagcaagtggcatttttgtaagtcaaaaatgtctggctattcgcaatttcacgtggctcagtctggtattatgctccccattttacagatgaggaagacaatggttagagaggttaagtaactcgttcagagtcacgccgctggcaaatggcaaagccaggcctgagtggagcttcttctgactccagcctctggctctgaagcacaggctcatccaacgggcacagggtgcgccacaccatctcctctgtcctccctccgaggaccccgctcttgtagtcaccaagttcttccttatgcctggtctaaagtcactcatttcttcattcactcgacaaaagttcactggtcacctactgtggacaacgtgtgcgccttcagtgaaccccagtgtcatccatgctgtttagatggaggagacaatttgggcaatgtccttaaatatccgcgcgggagctaatgaagcctcctctctagctctctggtatcttggctgatctcaggttctggtagctttctctaacaaacactcatctaactgaattgtaacccagaaccctttatctcccctcctggaagaaagtcaccaaaaggcaaatccaccgtggtaagtgcgttcgcacccagggtgaaagctgccctcactgacccaaaacttgccagcattttgggcccatgtctttgctgtgggcagaccaggaacagatgctgtgcgtgtcagagcagggctgtgggacgggcggggggacataagagaggagaccccggatctctcacgggcatccctgtgttttcttccacccacccccagagcaacacctaccaagccatcctctccacggacgggagcaggtcctatgccctgtttctctaccagagcggtgggatgcagtgggacgtggcccagcgctcaggcaagccggtgctcatgggcttctctaggtaggatgggaggggctgtcagcactgagcagttggcagggaggggtgtagagtcggctttcgctgcacacacactcccatcctggggcaaggcgggaaccctcctggctggtgcttctgactcacgctgactccagctcccgctggggccaggcatctggctgcttcccacgacaagatcacccatttgtccgccatgccctttcccatcccagtccccgtgagttgtaatcattcccagagctttggcttccctgatttccactgacattagctggcctctcttaccttctcaaatatcgtgataataacagccaagactgatgacactaacacttcgtgtacattactgcatgtcatgatcacagccaccccacgaggcagatactatttatcatccccattctacagatcaggaaactgagatacaaatagactagcaatttgcctaaagtcccagagctgggaagtggcaacatggagatttgaacccagacatctgaggctagaatctgccttcctgacttcctgagaattacccacttatccagggggcacccaaaagcttatatggagccggtggtgaagggagagaggaggcacggggctgtgggcggttgaaatgtggattcccgtgtgtgggaggctgtctccgatgtagcagtgcgccatctctgttcccatatgctggggtgtggcaatcagtacgaaggccacatgtcttttgttcttgataattgctgcaaatgtcttctcttacattgagtgtgttcaggttacccctttgattacactgctttcactagtttcttggtgtgctatgaaggagaaaggaggggaattacccaactctaggaatttcacacggtccaggtacacccaaggaaggtgtcacgcaggggtgcatcatcctgcttgtgtcagggaggaggaaaagcccaagagtccccactctgcagcaggcacccagggtggggctgcaggcggctgctccaggctttcctccttcccgggccatgctcggaccccacacctggggacggtgatggcgatagtggtggtggtggtggtggtggtagtggtagtggnnnnnnnnnnnnnnnnnnnngtggggcgccgcgcggtgctccggccttcctccttcccggggccatgttgggcccccccccctggggccggtgatgccgataatggtggtggtggtggtggtggtggtggtagtgccggtggaggtgccagtggcgatggtgatggtggtgatggtggtggtaatggtggtgatggtggtggtgttgggggtgatggtgccgatggtggtggtggtgatggtggtggtggtggtgatggtggtgatgatggtggtggcaatgatggtggtgatggtggtggtggtggtgatggtggtggtgccgatggtggtagtgttgggggtggcagtgatggtggtgatggtgatggtggtggtggtggtggtggcgatggtggtggtgatggtggtgatggtggtggcaatggtgatgatggtggtggtggtgatggtggtggtgatggtggtggtggtaatggtgatggtgatgatggtggtggcgatggtggtggtgatggtgatggtggtggtgatggtgatggtggtggtgatggtgatggtggtggtagtgttggtggtggtggtggtgatggtgatggtgatggtagtgttggtggtgacgatgatggtggtggtggtggtagtgctggcgatggtggtggtggtggtggcagcagtggcagcatctgttgtatcaaggcctcactcagttctgagggatttgcagatgttactgcatttaatcctcacaatacagtgaggtagatgccactgtaatcccttttatacagatgtgaaaactaagaatcagagagggtcagtaacttgtctgtggtcaccaagctagtaagtggggggatcagcagttgaatccatcactgcctaactccagaaactgggtcttaaccatcacaatacactgtccctagagtctgtcccgctccaaaccctctgcttgttgaagggaaacaaacagaaatgaggcctgaactctgttgttttcacgcccctgtctcatgaccaagcggacctgccagtttcttgcagctagcgatcagatgtggaatcggttagagcctcctacctctgcccagccatcttgtcccctctcctgctcagtgctggggcttgacgatgggggctggctgacccactgacccactgcccgcctagctggttgaccagctgctgaccggctagcgggatgaatggacgccttgcaaccgcgaggcaagagcctgtgcacggcagaggcctgagagtctctcctttcctgcagtggagatggctatttcgaaaacagcccactgatgtcccagccagtgtgggagaggtatcgccctgatagattcctgaattccaactcaggtaaaagtgccaccttatcacacctgagctggtctcaagccctcgcgtgtcctccagcccatacaccatcgcagtcctagagggcacctccctaacatcacggccatcctgaagggcctcccccacacagttcaacctcctacaggtctaggtgggatgtggcaccacccagggagcagctggcacctcctgcacccctggacacagcacagtctcagagggggctacatctcctccctcagatgaaccagcccaagagggctctcggggggcccagatcctggaagtgaggacagggtcttgtgggaggtgggatttgaatgggcagttcagacaatactccaagtgtcctgtccagagcaggaatgagaacccaggtgagatcctttaagaaaatctaccggctgggcgccatggctcacacctgtaatcccagcattttgggaggctgaggtgggcggatcacttgaggtcaggagttcgagaccagcctggccaacatggtgaaattctgtctctactaaaaatacaaaaattagccagacgttgtggtgcacacctgtaattccagctactcaataggttgaggcaggagaattgtttgaacctgggaggtggaggttgcagcgagccgagatcgcgccactgcactccagcctgggtgacagagtgagactccatctcaaaaagagagaatccaccaagaagaggcccggaggtctcacgttcattgtcatcatttactgggcacctgccgtgtgctggacaccgtgctaacagccagaaacaaaggaaaaagaccaactgtgttttctctcaaagagctttcatgcgggtagaaagacaagcgtcaagaggcaaacaatggcgccttctccatgactcagtccagaggccccaatgggaaagaaataatagtttccaaaatgtgataggttgaaggacattttagccttagaaaccagccacgtgaactgtgaagtgtaaatccagttctatttgttctgtggcaaccacgtttggtcgtcagaagcagacgctaagtcaagcgaggggctttgggggaggaattgttgcccatctgacttgggtccaaagaggtgagaagtggcaggagggggtgcatttgtgagttttggttgaccctaaagctgagacagggcctgcagccccagccctggataagccctttcccccccatccccgacctcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtgacacctccttcccgccccccacaagcccacccaccaccctctctgctcacgccctcagcctctccccagaaacagcccctgcttgttcccaccccgcccctggcagccccagcctgggcctgagtgggactggacttgtttcaggtcgctggggcctcggcagtaggcagctgtgcagcttcacctcttggcgaggaggcgtgtgctgcagctacgggccctggggagagtttcgtgaaggctggcacgtgcagcgtccttggcagttgggtgcgtgagtccgtgatctcaaccccaccttcccggccaagtaggggaccctcagcatgaagcctctcgtcctcattccttcccagacccttcccctctctgggcctccacttcctgatcgggtaacgttaggaagcttccaacatccccaccagcggacattcggggatgtatgagctgagagcctctttcctcatctctatacctggctccacatccccaggccagagtggggccatttctccaggcaagaagagagcgcctaggctgaccccgtccctgtagacccagatgagcaggatgtttgggggaagactgagagtcagctcccacagagacgctccaagggagctggagagcgcaggggtgtggggtcacgtggtctgtgtcctcccgttctctcccccgtcccatggcagtttccacagttcccagaccgtcagctgtgccctccccactcccagcacgttgagagcagcagtacttggctctccaccctcaagacaggaaatttgcttagctcctaccatgcgccctgctgcacagtggccccaatgcctgcaaaagagacagcaccctattcactgcccaaggtcatgagaagggccatgctggattccaaagccatgctcttgccaccaacaccgccctgccctaccaagctctccaccaacaccgccctgccctgccaagctctccaccaacaccgccctgccctgccaagctctcaaccaacaccaccctgccctgccaagcttctccaggtcctcaacctccccgactcactgctgttctccgcagcccaggaactggagccacagagctggtgctgccgctggaatgacaagccctacctctgtgccctgtaccagcagaggcggccccacgtgggctgtgctacatacaggcccccacagcccggtgagcgacagggcccaggcccaggaagagcctctggggagggggagcttctgggcttccgggaggtggttaaggagtaggggcagagctgtggccacaagggaagatggagatgacgccagtgatgggtggatggtcagtggaggggctttgtacctgagttggggaaggagtgagaatagcggggcacgaaaatgcaaggaggcttgaggggaggattctgtgctctgtgaacatctccccagctgagtccgcccggacaagtgccccagtcgactgcagtgaggaacctcaccctgagtcctcctggacaagtgccgcacctgactgcagtgaggaacctcagccctacacatgatttgtcatgctgaggcagcatctcttttttccttccagcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtgagtgaggggtgccggggacctccctgcattccacccacagggaccttcagccacatactgaggccgaggagaaggaagagagcgaaggaggggaagccgggcaggagggagggaggacacagcccatccacgcagctgtcccggagtaaatcctggggatggtggattagggctctggccccacggtttcccagctgcttggcttcgaagaaactacttaatttggttttctcctagtaagaatggggatgacattacctgcctcacgggctgttgtaagagctaaagggcataatccgaaaaccatgcctggccctgccgagcacacggtagacggcggctggcatcacctcaggccgcggcctccagcgccttcctcccggcccagggcgcagcttccagccccaggggctctcccagctgctttcctgggcgtcggctccacctgcgggtcgggctcaggccccctcccatctccttccaggtccaatggctccttgagcctcacgacgcaatccgtgtcctgctggataaccagactgtgacatttcagcctgaccatgaagacggcggaggtaggttggggagcgccggccgccccctccccgcaccgggagcagcgaggtgggcgagaagccgcgttgcggtgcagggccgggcgcgtggcggtgcagggccgggtgcgttgtggtgcagggccgggcgcgtggcggtgcagggccgggtgcgttgtggtgcagggccgggcgcgtggcggtgccgcgccgagtgcgttgcggtgcagggccgggtgcgttgcggtgcagggcccggtgcgtggcggtgcagggccgagtgcgttgtggtgccgggcccggtgcgtggcggtgcagggcccggtgcgtggcggtgcagggccgggtgcgtggcggtgcagggcccggtgcgttgcggtgcagggccgggtgcgttgcggtgcagggcccggtgcgtggcggtgcagggccgagtgcgttgtggtgccgggcccggtgcgtggcggtgcagggcccagtgcgtggcggtgcagggccaagagagcgcagcctctacccccgagcggggcgtgcagctcgccggcctcttctccgcctccagtgcagacccctcccggcttcagccccaggggcggggtgggggtggtgcgggcccggcagggcgcgggtttggtgcgggccgtggtgccgacctggcttcctctccgctgcctcccgatgctccaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggtgagggcggctcggacctgcctctgaggctccgcggagccagccggagctcggacccccacgccggcggcccgggcagccctgctcggcctccctttctccgcctccttggagcagaacccttggggcacagagcgggccgggagccgaggggcttctccagcctcccccgaggctcccttcctgtcctccgcccgctctaagggagcatcagggggggctgcggggaggcggggggcacagccatcctttctccctttcctcttgcctcccacatcctcccgccctcctccaccgctgcccgcgtttcctcccgcccctcccgaaggcagacgggcagggtgtgagggcccgtcctcccggctcccctggaggcctgacagcaggtgcaagagcagaggctgccaggccctggcctctccccactgcgtccgccggatgctccccaggaaggggacagccgcgtgcccagggtggccaacctcccactctgtccctcaggggtctggaataacaatccagaggacgacttcaggatgcccaatggctccaccattcccccagggagccctgaggagatgcttttccactttggaatgacctgtgagtctgggcagggtcctggggcagaggggcaggtgaggggagccggtatgtttatgtcgtccccctcggccctgtaggaagcagacctccatcctccctaaggtctgaggaatctgtgcccccccagggctgtccccaccaccaccagcccacctgcctctctctacctggaggagagaatgggggacgtggagtgtcctctctcactgcagcaggtgtttctagactcagaagctggaaaccgctctggccctgcactcccaccgccccgctccaagccatctaaagtgaggggtagaggtggacacagatggaataaggctgagtgccatgcctggtaccaccgcgctctgtgtgttacagggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcagtaagtggcccgaggcccggggaggccttttcagagtcgggagcagatgaggagctgcccttgcctgaccctgcttttccctgtgcatctgcattcactgagcagattcttccactcctggcattcctctgctcaaacccttcagagacttccctggctctctccatccttgcagtggccttcggcccagttcagcttctcagagctcttctcctagtgctggacgccttcccagccccctccgtccatcctagcgctggatgccttcccagcccccttcactccatactagcgctggacgccttcccagccccctccactccatcctagcgctggaccccttcccagccccctccatccatcctagcgctggatgccttcccagccccctccactccatcctagcgctggaccccttcccagctccctgcactccagccccgcaggctcctctgtgttcttcaaacacgctaggtgcgctcagctcccaggcttcacacgtgctgttctcttgcctggaatacccttccttccctggacagccacacgcttgcccctcacctcctttacgtcttcattccaatgtcccctccttggtgaggcctctcttggccgccctgtctaaaatgtcacattcgcccacacttcatgtttgccttccctgctttatttttttctccttagcatttataattactcaacatattttataattttcacaggtatctttttaattattcattcatgactgtatcctcaccacccagaacagtgccagccacttagctcaataaatgtttgttaaatgactgactgaatgaatgtgtgaagcaactatgaaatggaaatggcagggctccgagaaacagacccgtgaagaggttttactccctctctatttctggacaaatgcaatgtccctttagatgtgaccctccaggttttgtgcgtgtgtgtgtgtgtgtgcgtgcgtgcgtgtgtgtgtgtgtgttgacggagttttgctcttgttgcccaggctggagtgcagtgacgtgatctcggctcgtcgcaacctctgcctcccgggttcaagtgattcttctgtttcagcctcctgagtagctgagattacaggcacccgccaccatgcctgactaattttgtagttttagtagagacagggtttcaccatgttggtcaggctggtcgcgaactcctgacctcaggttatccaccggcctcggcctcccaaagtgctgggattacagacatgagacacccagcacccttcaggttttcagccctttgccaaaggtacaaccctttggtctaagggtacaaccctttgtaatggtccaaacaaatctgctctctaattcactttttgtcatacccagcatagcactgtgttcaggaaagaatctgaaaggagctctttttgaggaggtggggggagagaaagaggctaaagatttggctaggtgggcagtacagtcccagcctgctgtgcgtcagtcgagagcaggtacacagaataattccttcttccagaggtgggtcacagtcctgggaatgcctcacacatattagagttgagaaagagaggaggctgataaagcaggagactgtcctgcctcggaacccccattccctctttgtgtttcagatcagtacccgccctccatcaatggtggtcgtgtgattgaagcctacaaggggcagaccacgctgattcagtacaccagcaatgctgaggatgccaacttcacgctcagagacagctgcaccgacttggagctctttggtaggactatttggctggctggggagagtggggaggtgggtaggggatgaggtcagagtcaaatttgggaaattctgcattgctacacccagcaacacttgctgtcactctttcatttgaatatccaggaccggcatttccgaggagcgatatctataactcaaataggtgccccccagtaagtagtagtgacgggcttacggcggtttggccagatagctagagtgactctgggcacatagaactgattcaaggctgggcgtggtggctcatgcctgtcatcccagcgctttgggaggccgaggtgggcggatcatctgaggtcaggagttcgagaccagtctggccaacatggtgaaaccccgtctgtactaaaaatacaaaaaaaaaaaaaagccaggcatggtggtgcatgcctgtaatcccagctactcaggagactgaggcaggagaatcgcttgaacccaggaggcagatgttgcagtgagctgagatcgcgtcactgcactccagcctggtgacagagcgagactctgtctcaaaaaaaaaaaaaaaaaaaaagattcaaagatcatttaatctcaatctgatcatatatagtcatctttagtcattatgcattcaccaaattattagaataatcaagtgcaacatttaaaatgaccaatttacaacatttttatatctattaaaggaaggctctaatgtaggacaagatttaaagaaatatgaaaaatactttcgtttggtacctttcttgctctttttgtctggtaaccatgtttacctagccgtgtctctccttgtctggtttcctgggctaggacccagtagagtgccatcgctccctctccgtaaaggtgttagagaccccgagccctacatccatgatcagggccaaaggctccaagcacaagggacgctgctttcgtctgttgccagcactaattcaaagggtccaagggcatcaaagggatgccactttctgtctgttgccagcactaattctgagggtgactgttcttggctaaaccaaagccccggggggcatattttgcgttctctttgcctctctgcctgatgttctttttctccgtgtctcagaagggactgctttgcctgcatcccttttgccccacgtgcgtcctcccaggtgcgagacaatggcactgagaggttttcttctccacgggccccacccctgaaggacgatggtctggaaattacgttcgtctattctctgtcacttcctttcaatctgctgttttaaggagactttcctattttcttgaaaaatatcagtttgatctgaagatatgtagtagtgtttcactacagtctggtgtctgaagggggtgtctgggaaaggtccaggaagtggggggtgggtgagaaatcagggcaaaggatggggctgccgtgagagtgaagccagtttggccggcagcgcagcctggggaggtgtctggaggatcctggccttgatcctccatcccccaggatgtcccatcctggtgtgagcccagccagggctgccctttggggtttcttcaggaggaaactgctttcccctctgtggcgttccccgctacaatcagtatgttggactggtgccacgtccttccagctgggagcgtgaccaggatcacccccgataccagccttgctcaaaggaaatgaccaatgagatttgtctggggagggggagggtggcctgagaggggtgggggaagccccgtatcagcaatcagaccacagagctgaggagtctcccagctctcaacattctcatcttccccggggcagagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtgagtgttgggaggtgggggaggagtttctgtgccgaggggagaggaaatgggagtggaatggatgctgtgattctgcctgtcctgggtgtgtctgtgttgggagatgggtggagcagtggtaggtgagtagagcagattccagtctcaggccacaaactcacatgggaagaaagagaactttctggccgggtgcagtggctcacgcctttaatctcagcacttttggaggctgaggcaagcggatcacaaggtcaggagatcgagaccatcctgaccaacatggtgaaaccccatctctactaaaaatacaaaaattagctgggcgtggtggcaggcgcctgtagtcccagctactcgggaggctgcggcaggaaaatcgcttgcacccgggaggtggaggttacagtgagccaagattgcgccattgtactccagcctgggcaacagagtgagactctatgtcaaaaagaaagaaaagaaaagaaaagaaaagaaagaaagaaggagggaaagaaaggaaaggaaagaaaggaaaggaaagaaagggaaaggagaaaaagaaagaaagaaagaaactatattggagaaaaagaaggacgaaagaaagaaaaaggaaggaaggaaggaaagaggaaagaaccttactttattgcttatagttcaactggatttttatctcccacctccccttctgccaggttggcaagaaacttccacctccgtctttctcacagcgccccacagctctgcggcgaagcccagcagagggccctgcggtgtggggtggaaggtggttgtgggtccctgggcgtgagtccacacaggtttccatcacagctccgccccacttccccttcagacccagggagaggctctgctgcttctgtgccttgctcagacacaggacaccttttctgaggccgcttacagtcccgtctgcctagaagcaccccacagtcatttctccctaggatgtcatcatcacggtgctgggaagagagctgcgggtccctctatcttgacacctccaagcccctttgctttctcttttactatctccttccagctaaaagaaacatcttttccagtttggagaaactacttctccatgtttctagccaagatacttggcctaattccacgactcttgtcctatctgcttttttatttttatttttggttgtaaaggaagagccagaaaggaaagtgtttatctggcaacacaaaactacctccttcaccacttacacacacacgcatgcacacgcacacacagacacacacacacatccttctgaagcatgagcagagaatgggtactcgaaagggatagaggtagggacggttggtggggtagggggtagaaaagcataaaatacacaatgggaaaaagagattgaaatcaatatactattccacagatccccaaatatccactcttgggagtagcaagtgttagaggattccattttagggagattccccgagtcgcttcagtaagggagttagaaaggggagcgcagggagcttggtgaggtctcggcgccgcagcctttgctgagctgctgtactggctgctgtgttttctcacagtgctcagcagggaggctctgtcttcttggtttgggagtcagcaagggaggtcaatttcagcttatatgaaatccagtttgcaggccacataggagcctgaggcaggcggattgcttgagctcaggactttgagaccagcctgggcaatatggcaagaccctgtctctactaaaaatcaaaaaattagctgggcgtggtggcatatgcctgtaatctcaagtatttgggaggctgaggcacaagaattgctttaacttgggagggggacattgcagtgagccgagatcgagacactgcactgcagcgtgggaaacagaacgagactgtctcattaaaaaaaaaagcagaagaaaaatacaaaaattagtgggcgtggtggtgcatgcctgtagccccagctcctcgggaggctgaggtgggaggatggcttgaacctgggaggtggagtttgcagtgagccaagatcaagacattgcactccagcctgggcaaccgagtgggaccctgtctcaaaataaataaggaatccagttttcaagcaataggacatacatggatacatacacacatggatacatacacacatggatacacacacatggatacacacatggatacatacatacatgcatgacatacacatacatacatggatacacatacatacatggatacatacatcaatacatatctacatggatacatacatgatacatacacacatggatacatacatgcatacatgcatggatacacacatacatacatggataaatacatacatggatacatacatctatacatggatacattcattcattcattcatgcttcaatcattcatgcatcccccatcttactctagaaaggatttcaggcaaagagctagagtgtgagagggaagaggctgagatcctggtgcagggccaggcagggggtcagggtaaacaatgacccagggaggccagctgggcaggactaccgtgtggctttaggcagggccttgccgccccacggcctggtcaagaaggtgctcagcaggtgctggtggggctgagacatgactcagggtccacgggttctcaggccaaaggggtcagtcagaaacacccagaagcccttcccagtttggtctcctggccgcccgtgatcggcaaccctcctccaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcgggtgagccgggaacagggcctggagcaggcgcttctgggagcagctgatagctcaagggtgtagacagccaaaggcaaaccatttctctcctttttccagcagatctttagaatgctcaatctaggcaggtgtgggaaatctaggcaggtgtgggaaatcatctaggcaggtatgggaaatctaggcaggcctggaaagggggtggtggatggtgtggggctgaaggagaagaggttgtacaggcataggggaggggacggggctgggcatccctgagggcattgatggggggagccccgggcgaaagactgaagatggtttggggaggagacttcagcagccgccagagaaccgggcaagctgggtcctcgggatccctggggatcttcagagacacgaggctcaggatctctgcatctcacgagtcaggacgtttggaggggctggcgtggggatccggcagcaaaggtgcctgattttccctttgagtcctcccagccatctgttcctcccgctctgagtcaccagagtctgatgagggagatcacagcgaggcctttaccaagccccctaaggcacccaaataaaatctacagatcactgtgccttcagagccgaggccagagtgggtagaaccgcagcttttataaaggcagaaaaggagatggacgtgagaggggagggcgtgaggaaagccagctgggggcccctcctctgccagccttcggggtcctttctgaagcagagggtctgagaaacactccagtccctccacaaaagtggaagaatacctgtctggccggggaaaggggttgccctgcagagaaacgcctggaaaaggggggaaggatggtttggggttccgagtggcccgaagtggaacactgggggaaagcaagcctgtcccggagcgggtttccacgggctgggccgtccctctgctgccctgcgcgctgctgctgacctccctactcactctgcagctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctaggtaccgccagagaccccgccctctcacccccgcactcttcctgggccccaccctctcacccccgcactccgcccacctttggggaagatgaggaagctctggggtcacaggacagagctccagatttctctgggatggtgtaaggtgcgggctatgggagctggcgaggcaagttgtcacggcaaggaccacgggcctgtgtggcctatggaggaaggacggaggcagagacctcacagctggctcagtgagatgagcgctggggaggcccggagcatagtggagtgagccctagcgtgagggccacttctcccggtttcttcagcaaccttctgtcactgtggaatgtagggtgagggccacttctcccggtttgctcagcgaccttctgtcactgtggaatgtagggtgagggccacttctcccggtttcttcagcgaccttctgtcactgtggaatgtagggtgagggccacttctcccggtttcttcagtgaccttctgtcactggaatggagcagtcaacttgggctggcccgacagactttttgggtaagtctgggtaaaccgtggggtgatgatacatttgcttctcccatctccagaacttcccttaagagtcatccagctcttgctcagtgaagaggaaaatgcctccatggcagaggtcaacgcctcggtcagtgctgcaggccgcgctctgggtgggagggggcgcttggcgggttcaggccagggcggaaccatcgctgtgcggccttcatcttgtcatccatctggattcaactgccagaggaggccggagcctcttgccccatgggaggtgcagggcattaggaagtgaggaaggcccaagacagaaacctcgactcatcataagcagaggccagggtgccaagtcaccccagccgagacctctaagcatcttggttatgatctgaaagaaactaaaggacatttcacctcccgggagtcttccctgacttcccagagggaacgggcggctccctcttcttggctgccatgccatacctcagtcacaggcaaagtggcacaactgccgagtggttggggctgtagaatcctgcacacccagaatcagaatccctgctctgcccctcactagagcaggtgtgctaactagacacatcatataacaggtcatctgtaaacacagggacaatcatagcacctgagtcaacaggccgtatcaccgtttaaatgataacgcgtgtcaagcatttagtcccagtgcctgacacactggtgttcaaacatgatgactgctattatcactactgcgagcctagcactccccactccacactccacacggtaaaatctgttgacatttgtcacctgcgccagacaatgcactctttgagtttagactccacctaagtcaccttgacacccccagccccgaccatctcctaggtctaaacaacccatgttcaatatactggggaggaggtcatgagtcatgtgtcagaggcaaggtaggggccattcatgtcagattctctgctcgtcatatgaggctgagggggggacagaatggaaaacccttcactctcaacaaacattattaagcaaggacccatgacactcactgagctaggctagagtgcaagggtgcagagacaggtgaggaaggtgctggggtcctggggctcccgttccaggaggaaacagggatgaatacacccatcaaggtgggagggcgtctcccccccggatggggcctcacccccacccccatctgccatcctctaacctaggtggcatacagactggggaccctggacatgcgggcctttctccgcaacagccaagtggaacgaatgtaagtgggactgtgtccccctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttggataacctcctcattaaacagttgtgaacaggttgtctcatatattgtgtccacattcccatttgacatattataatggtatgtttgaatatagtgtcatattttaaaatacattataataatcattacccattgtttgagtgcttactgtgtgtccggcactgtactgagtactgtggacacattatctcatttaaatctcacagcagcataagtgctattatgatcatttccttttaaagataaggaaactgaagctgaaagagtgaaggaatgttccctgaattacacatctagtcactagcagagtttcagtttccacccaagtctggccaccttcaaagcatgtgctcttcaggaaagcattttccataggaacctttttccacaggaacctttttccctaggaaactttttccataggaagcaccatcccttggtaaggatgtgcagtagtttatttaaccagaccctacttctgaaacgttactattatccaccacgctgatctgaacgtccaggggcatatgtatctgtgcacttctccaattatttctcaggataaacacccgaaaaggaattcgtggctgaaaaggtattgatttagtgttcatcggttgctttctgtgttaatctgtgtccttcccgacagtgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcaggtgcatagggctgtggccaggaggtggaggacagtgctggggaacccaagctgggcaagacactgcaaggggtccaggaattaggatggctcgagagatcagagaccagggaagagaggacagtggaaaaggagagttgtgagtgcctgctctgtgtggagaataaaggcgctatattacaaactctgaaacccaaaagagccataggggggcttagaactatttcgaagatgagaaaactgcagcttagagatgacaaggaacctgccccaggacgcagtaggttaagcagcagggcatggtttccaaagccaaacattttttatatttttatgttttgagatggagtgtcatttgtcgcccaggctggagtgcagtggtgcgttctcggctcactgcaacgtccttctcccgcgttcaagcgattctcctgcctcagcctcccgagtagttgggactacaggcacgcaccaccacgcccagctgatttttgcatttttagtagagacggggtttcgccatgttggtcaggctggtctcgaactcctgacctcaggtgatccgtccaccttggcctcccaaagtgctgagattacaggcgtgagccaccgcgccagggcccaaagtcaaaccctcccacctgatctggctgctgcttccctgctgtctccttgtgggaaaagaacctgcagtcctgtgtctaggccagtcctgcccctcagtcaagcgaggcgcctttgcccctgccctcaccagcagtccccggggctccgctggttaacagcgcaggaagccgcggccccacgcagacctgggctccgggccctccgccagctgcagttccagatcccgccgaaggagggggcgggcggagcgcgggtggggcggggcccggctctccgggtgggcggggcggggcggggccgggctggggcgggggtgtgactgcgcatgcccacctgtggccggcatccctgctgcccaggtgcagctgactgcacgtgcagctgaattcacaccaggtttttgtttttgttttttgagacggagtcttgctctgtcccccaggctggagtgcagtgttgcaatctcggctcactgcaacctccacctcccaggttcaagcgattctgcctcagcctcctgagtagctgggattacaggtgcgcaccaccacgcctggctaattttgtatttttagtagagatggggtttcaccgtgttggccagtctggtctcgaacccctgacctcaagtgatgcgcccgcctcagcctctcaatgtgctgggattacaggcgtgagcccccgcgccggcccaggcccatgtttttaaagcccacacctgcctcctttgcccagtggtctcacttcagcacggcctcagggctgactcagtctctccggagagtggggcgagcccagcctctcctacagaacctcttcttccccagcagaagaggaggggctgggaggctgagctcccgcctctgaccgcctgtctgtctctcttggtcaccagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacacacgagttcataatgtggtgatggccctaagttaagcaaaatgcttctgcacacaaaactctctggtttacttcaaattaactctatttaaataaagtctctctgactttttgtgtcttcaaaaccaggaattccattcctgattttcttctggtggccgaagggctggacacagacttctcccaaccatcagagggcacagagtgtggaggttaagtgctgggcagcagtggagcattaggggcagctggatccagtcctaatcagccccgttacccatgctggaaaccctcagttgctccaccccaaccttgcttcatgctccacatcaccttcttcttcccccaccccagcacaggccaaagcttcgcccgctaaggaggagagcgaaagagataccccaagatggagtgccccagactctctcccaggacccctccctgcctgcctgtccatcagtttcacaaaagtcgtaaaaggatcaatgcacagtgtgtttacctgtctggtggctgtccccaccgcctgcgtttcatggaagagcgattaaaccatttcagctccctttccaggaaccaactcaagaaacatgccaccaccccacccttagatctggagggcccgacccctcatataccctctctgtcctttcccggaccccagatggagtcttctgaggttctccatcccacagcccttcacctctaccctgcctccacttgccccagcaacctgatcagcttccacagaatcctctcagcaggcgggacttttacacctatctggtgtaataactccaacacaattggtccacaattcctgtgtctagaaaatctcaattccaactttatgcagaaactaggtagctgcctcttagttctaaatcccaaatccctgaagagagaatctgactggtccaatttacatcagttgtttatgcctggtccaataaaatgtagtcatggggtcagaaaggaggtcacatggtgcaaagcaggtgttcaagctcattcttgcggatgggtaagtgctgttgaaggaagctcccaaaggaatatctttggttgggcacggtggctcacgcctgtaatcccaacattttgggaggccaaggcgggcagatcacttgaggccagcagtttgagaccagcctggccaacatagtgaaaccctgtctctactaaaatacaaaaattcgctgggcatggtggcacacgcctataatcccagctactcaggaggctgaggcaggagaatctcttgaacccaggaggcggaggttgcagtgagctgagattgtgccactgcactccagcctgggcaacagagcaagactctgtctcaaaaaaaaatatatacatatatatataaagaatatatatataatctttgtattagggttccctagagggtcaggactaataggatagatgtatatataaaggggagtttatgaaggagtatcgactcacacgatcacaaagtgaggtccacaataggctgtctgcaagctgagaagcagggaagctagtctgaatcccaagatctcaaaagtagggaagccgacagtgtaaccttaagtctgtggcagaaggcccaagagcccctgacaaaccaccagtgtaagtccaagagtccaaaagctgaagaactggaagtccgatgtttgagggcaggaagcatccagcacgggagaaagatgaaggctggaagacttagccagtgtaatccttccacattcctctgcctgctttattctggctatgctggcagctgattagattgtgtccacccagactgagagtgagcctgcctctcccagtccactgat

SEQ ID NO: 12385 - DNA, 25131 bp, Human
ggcacgatctcagctcactgcaacctccgcctcctgggttcaagtgattttcttgcctcagcctcctgagtaaccgggattactggcgcgtgccaccacgcccggctaatttttgtattttgagtagacacggggtttcaccatgttggccagactggtctccaactcctgacctcaagtgatccacccgcctcaacctcccaaggtgctgggattgataacaatcatgagccactgtgcccggacttggttcatattcttgatgggccctgaacctatatatagagttatttttttgaggacctctcataaaaaaaaaggttttcttttgcttcagggacaaactctggtattccactaaattgagaatgggctgggcgtggtagctcacgcctgtaagaccagcactttgggaggctgaggcaggaggatcacttgatcccagaagttggagaccagcctgggcgacacagggagacccctcccccatctccacaaaaataaaaataaaataagccaggcgtggtggcgtgcacctatagtcccagctacttgggaggcttaagtgggaggctcacttgagcccaggagttcgaggctgccgtgagctatgatagcaccactgcactccagcctgagcaacagagaagacccagtctccaaaaaaaaaaaaagcccaccaaaaaagtaaaaaaaagttgaaaatgatgacagaccctttattagcacctcttacatgcccgggcagtgaatttatatcatctttcacaaatagaaaaactgaagctcattcagattaggtaatttatctgaagacacagataaacccctctcagcgcctgactctcggcgcaatcgggatgtttcgcagcggggcaggggcagggcccggagccaccgccatcgcagcccggggaacaacggactcggggaagcccggcctggcccttcaagtcccgggcccagcaagggccaggaccctccctccctccctgcaatcggtcccaactcgctgaatgaagctcattcagtttaggtaatttatctgaagacacacggttagtaaaaggcagaacccaggtttgtattccgaagccctcgttctttccaccacattattatggccttcctaacggtaatccttacaattttaaatgaacatataccatagctcctctcctgaacaccgagggacgctggctcacggagtttagaaagttaacgcatctggccgggcgcgatggctcacgcctgtaatcccagcactttgggaggccgaggtgggcggatcacaaggtcaggagttcgagaccagcttgactaagatggtgaaaccccgtctttactaaaaatacaaaaattagctgggcatggtggcacaggcctgtaatcccagctactcgggaggctgaggcagaagaatcgcttgaacccgggaggtggagggtgcggtgagccgagatcgcgccactgcactccagcctgggtgacagagcgagactccgtctcaaaaaaaaaaaaaaaaaaaaggaagtttacgcaacccgctgcgtcccctccaccgccgcgcaccccgtctcgcagctggcgcggtgtttgctggtgacatgaactcaaccagcctccaccatctggggatcggggcgacatccttggtctggtttgcaagaggacccgcacgcctccagctggggcggaattggaagattcagaaaggaaagttggggaggcggggaaggaagggtgcaaaagtgacactgtgccagggtctccagggccgcggagctccgggacaggcagcgccttccgagctgcacaaacgcgtggggcggggcgtctctggatccggaagttgcctctgccctcaccaaagatggcggccccggcgccgctcgcccacctctcgtaaccaatggaaccgcggcgctcggccgattctcgcaggcgccctcagatctacgctctctgatgcaacgccggaatcgcggaaaccgccggtgcacgttggagtcataagacggcgtcggtgttgcagtctgtgtccttggaggtgaccagggccactgcaggcatggtgctaggtgggtgagactcagtgtatggcgcggtgttccctgcctggggcaggaactctgctccagtcgggtttcggcgctttccttagtgcctaccagagtgggcgccccgcgaatgtttggggaccgattgcagggagggagggagggagggtgctggcctttgctgggcccgggacttgaagggccaggccgggcttccccgagtccgtcgttcccccgggctgcgatggcggtggctccgggcccttcccctgccccgctgcgaaacctcccgattgcgctgagactcaggcgctgggacgggttcagacacagggtagcccctactcctgcagttcttcaaagtgatcgtcaggaaggggctttaggattctagttgtttttctcccaccctcatttttttattgaggtttccggggagaccatactgtgcagtaggaaaaaaaaaaaaaaaaagagagagacctggatggatgttaactgttcagacctactagttgtgaggccttctgaaattttctaacctcagagcttctgtttcctttaaagtccagagggagctggtgtttatttgccatctctacaaaaactggcactgggatatctgatttgtatgtgttattttatttcatcctcagcacagcctttcaagatggggattgtttttcctattttataggtaaagaaataagctcagaaaggttaagtaaattctccagagtcaccctgccttttaaggtacaaaatccaacattccagcgtatgtctgatcaacttcaaagcccatgttttatttttgggtgcccaattagatagaataaatatcacaaattaaaatgatcagagttcattttgaaaacctggattattaactaatgtttttatgagatggatgttattgaaatggagtggggaaataactaggatattaattacttatggacctcaatttttattaatcgatgcttgttctgtttacaaagataaggaatgaataaagtagtaaggtgactaatagttaatggccagaccataacttaccctcattttgtcaaacagcagagctgtacgtctctgaccgagagggaagcgatgccacgggagatggaaccaaggagaaaccatttaaaacaggtctaaaggtagagtctcttctcattaggaaaatgagactgcatttattaatgagttatgtcaattttcgtgtgacttgccaagaacttaatttcaaacactaggttccaaagagaattttcagaaaagggaaagtaaggaatgcatacagatatgtgactttaagattgttagatgatcaaagtctaaacttactttttaacattttgaaaaaaggtctcttctttcttaccacatggcattgcttcttggaatttttctctccattgagtcagattgctgggttttcaattcttgtaaagataaaagttacctttcctcagttacagtgagctcatgaccagggggctcctgagagggcttttggtgaatttaccacaatccagagtgtgatcctgagatttgactccaagaccaccaagaatggattcatttgtcagagctgactcatgagtctggagcttcaagctagaatgccaatttattaacattctgttaatgaattaacagtgctgttatttctcaggatctagaatccttgaatgagtttagctcattctcaaaggggtttgtcaagagcttggactcaggcctggtgtggtggctcacgcctataatctcaacactttgggaggccggggcaggtggattgcttcagcgcaggagtttgagaccagcttgggcaacttggtgaaatcctggctctacaaaaaacataaaaattagcccagcatggtggtgcgtgcctgtggtcccagctactccggagactgaggtgaggatttctttagcctggaaggtggaggttgcagtgagccaccattgcgccactgcactctagcctgagaccctgtctcagaagaaaaaacaaaaaaagggcttggactcacaacatgggtgttaggtagttgattatatcagagtaaagtgtggcctaagacaaccttcttaaaatagaccatggacttagctgttgaactcatatgctagaatccattggctataactgccacataaggaagatggttaaaagttccttccttgggtctgggctttggtgcctcacgtttgtaatcccagcactttgggaggctgaggctggaggactgcttgagcccaggagtttgagaacagcctgggcaacatgataagaccctcatctctacaaaaaatttaacttcttaaaaattttttaataaatttaatttaaaaaataaatagagacaggatattaaccctcccaaagtgctgggtttataggagtgagccatcacactcagccaactaccaaaaaaaaaaaaaaaaaaaaattagccaggcatggtggtatggtatgcacctgtggccccagctactcgggagactgagatagggggattacttgagcccaggaggttgaggctgcagtgagccgtgattgcatcactgctctgcagcctggacgacaacaacaaaaaagttccttctttgaactgtattaggaaaagcagtgccttgacactcctttttctgtgcatcccctttttttgttaactgtgttacaacatttatagttactatcaagtcctaatctgggagcattctcctctcttttaggtcataccatatggttataaactttggtgtgtcatacatgggtacttgtttttaatttaacttatttatttatttttctgagacaggatcttaatttgttgcccaggctggagtgcagtagcgcattcatggctcactgcagcttcaacctcctgggcttaagggatcctcccacctcagccttccaagtagctcggaccacaggggcatgtcaccacacgcggttaatttgtttcttatttgtagatacgagatctcattatgtttcccaggctggtcttaaactcctgggcttaagcaatcctgctgccttggcctcccaaagtgctggggctacaggtgtgagccgccactcctggctgggttttactttttaaccactcttaaggggaaatctttcatttctggattatcgggtgcctcgttttgcagctcctgaaaactgacaacaccgtttagatgaacgtttgcagaatgtcactgttaacaacagaatgtcactgttaacaaaagtgtagcattctgatttgggaactgatagtttggctctttcaatttcaatgatacaaaaggagggatcagtacagattgtcgggtaataagtgaattccgaacgacctacatgtattcatgggaccttctctcttggttttgcattttcatcaatggctatcttttttttttttttttttgagacagagttttgttcttgttgcccaggctggagtgcagtggcatgatctcggctcactgcaacctctgccttctgggttcaagcaattctccctgcctcagcgtcctgagtagctgggattataggcactcgccaccatgcctggctaatttcttttttttttttttatttctagtagagatggtgtttcaccgtgttggccaggctggtctcgaactcttgagctcaggtgatccactcacctcggcctcctaaagtgctgggattacaggcgtgtgccactgcgcctggcccctacatgtattcttacaatgtctagttgttaaaaggatgaactattgaatgttttcttttttttcttttttttttttttgaaaaggagtctcacactgtcacccaggctggagtgcagtggtgcaatctcagctcactgcaacctctgcctcccggattcaagagattcttctgcctcagcctcccgagtagctgggaccacaggcgtgtgccaccacacctggccaatttttgtatttttagtagagacagggtttcatcatattggccaggctggtctcgaactcctgacctcatgatccgcccacctcggcctcccaaagtgctaggattataggcgtgagccaccacgcccagcccttgaatgttttcaaaagatccagattccttccttctctatttttttttttttttttttttgagacggagtcttgctcttgtcacccaggctggagtgcagtggtgcgatctcggctcactgcaagctccgcctcccaggttcacgccattctcctgcctcagcctcctgagtagctgggactacaggtgcccgccaccacacccggctaattttttgtatttttagcggagacggggtttcaccatgttagccaggatggtctcgatctcctgacctcgtgatccgcccacctcggcctcacaaagtgctgggattacaggtgtgagccaccatgcccggcctcagattccctccttctctgcagcagtcgtagaactgagaaaaagtccgtttttgcaggctgcagatcttgcaacagagaataattcactgcatttcttgtttgattcaataacttggaagagattttgaaagattatttgaggctttaaaatattcatcttttatgtactttgaactattttttaaaaactacaaacaatacattttatcaaatgatatataacacagcaatgcttgatatgtcccattggggaaaagaggtattctacatgggggagtttttcagattaaatgagtttagctttttgtgctctttttttttttttttttttttttttttttgagacagagtctctctctgtcgcccaggctggagtgcagtggtgccatctcagctcactgcaagctctacaggcgcccgccaccacacccggctaattttttgtatttttagtagagacagggtttcactgtgttagccaggatggtctcgatctcctgacctggtgatcctccctcctcggccccccagaatgctgggattacaggcctgagccactgcacccggccgctttttgtgttcttaaccattgttttgttgaaagtttcaaaaatgtctgacacttctctgatttctcacagagaactaaccttttagatgtcacttgcagttgagttttgctgtcaggtgtctcttctgttgtccttgtacctgtgctggttgctacagccacttaagatctgttgcttatagtctgcttttcctggggaactgtatcgtgtatacccgaacttgctgtaattgtttgtgagaggacctcagagcttcagctttaaccagtgtgcttctttttttttttttttttctcttgagacagagtctcgctctgttgcccaggctggagtgcagtggcacgatcttggctcactgcaagctccgcctcccaggttcacgccattctcctgcctcagcctcccgagtagctgggactacaggtgcctgccaccacacctggctaatttttttgtatttttagtagagacggggtttcaccatgttagccaggatggtctcgatctcctgacctcacccacctcggccttccaaagtgctgggattacaggcgtgagccaccgcgcccagccaaccagtgtgcttcttaaatgttcaaccagtcactgtgccaatatcagcttttggctgttggggtctttatgcttagattgttccagttgccttatacttgagatgttattttgattttaagtattgtacaatgttcaagaactgtcttttctctcctccctacccaaggctttgatgacagtagggaaagaaccatttcctaccatttacgtagattcacaaaaagaaaatgagaggtggaatgttatttctaaatcacagttgaagaacattaaaaagatgtggcatagggaacaaatgaagagtgaatcccgggaaaagaaagaggtgagtcctgaccttgccatcgtgaacgttgttaaagttagaactctggcaaccatgttaacaaactgcttcatcattaaaattaggcagaagatagtttacgaagagaaaagaacctggaagaagcaaagaagattaccattaaaaatgatccaagtctcccagagccaaaatgtgtaagtttgtttatcttttcaaataccgtggacttggctacatcagatcattatttctgtgtatgaggggcatgtcacatggtttgttcctttacattttgtttttactttccatttatttatttatttatttatttttgagacggagtcttgctctgtcgcccaggctggagtgcagtggttcaatctcagctcactgcaagctccgcctcccgggttcacgccattctcctgcctcagcctcccgagtagctgggactacaggcgcccgccaccacgcccggctaatgttttgtatttttggtagagacggggtttcaccgtgttagccaggatggtcttgatctcccgatctcgtgatctgcccacctcgacctcccaaagtgctgggattacaggcgtgagccactgcgcccggcctactttccttttattttttatttcttaattttaaattttaatttatttattttgagacagggtcttgctctgttgctcaggctggagtgcagtggtgcagtttctgctcactgtaacctctgcctcctgggctctaacgatcctcccaagtaggggggaccacaggcatgcaccaccacacctggctaacttttatttatttttaatttttgtagaaacagtctcccatattgcccgggctggtttcaaactcctgggctcaagggatcctcccacctcagcctcccaaagtgctgggaatacaggcgtgagccaccatgcctggcctactttcctttcagaagggacatagagaaataatgttttagagttatgaggctagttctttaggggttcattttattacacagttgagtaaatgcatgttgaatgaattctgtcccaactgaatgccagcagatgggggacccaggcctggctacgcttcatgatgttggtcaagtgatttaaccctctctagtgtcagtttgcttataaaatgaagaggttgaaatctatgattttcatgttttatttaaatagagtaaaagtttgtgaattgtgaaattagattcactcttcttctgttctttctggaacccaaatagattgctggactatgaatgaaaatggtttgatttccagtagttcttattttattttattatttatttatttatgagacagagtttcactcttgtcacccaggctggagtgcagtggggagatctcagctcattgcaacctccgcctcccgggttcaagtgatcctcctgcctcagactcccaagtagctgggattacaggtgcctgccaccacgcctggctaatttttgtatttttagtagagatggggtttcaccgtgttggccagactagtctcaaactcctgacctcaggtgatctgccctccttagcctcctaaagtgctgggattacaggcttgagccaccacgcccagccagatttccagtagttcttattgctgatgaatttttgtattatttccttagtgatggagctggggttttttggccacatgcaacagccccttcctctactcatctcctctctccttcatcccccaaacaaaagctagccttttaagtaccatgttctggaaggtattgaagaactgtggggtcatggaaaaggcttcatgtggactgggattgttgctgttgtgggaagcaagtgctccacttatgacaaaggaattcatttattaattaattttatctagcaatatctgaaattcttctgggtgtttctcattatcagttttacactaagaaagaagacttggatttttttttgttttgttttaaaccatgccaatacagtgaaatgcgtttggttctgagctgcagtagaggggctgtctccagttttgcaccatttgtgatttttaacacttactaccgtctgcctaatattagtgaaaaagttggtgtgtataaatgacattattgaacaaatgttgtttatttcaatttgacaggtgaagattggtgcgttagaaggatatagaggccaaagagtaaaggtgtttggctgggtccacaggctgcgcaggcaaggtaaatggcaaagcttttccttctttttaatgtttaaatatccctgctcttagatgaagaaaaacatacaaagatttgcaggggtttttttctctccccctttttttcttagacacagtctcactttgttgcccaggctggagtgcagtggtgctatctcggctcactgcaacctccgcctctcaggttcaagcaattctcctgcctcagcctcctgagtagctgttatcacaggtacctgccaccacacctggctgatttttgtaattttagtagagacggtgtttcaccatgttggcccgtctgctctggaactcctggcctcaggtgatccactgtcttggcctcccaaagtgctgggattacaggtatgagccgctgcgcccggccctctttttttttttggtatgctggctagacttgaactccccccagccatcctcctgcctcagcctcctgagcagctgggattacaggcacatagcacctcacctggctttaaaggatagagtgatttatatcttaaatttgttcttgtttaaaatgactattgaaagtataaaaatttttaaatgctcttttaatggttagcaattatagtgatgaagatgcgtccagtaaatatttgtcaagttgagttttaattatttagtgaaaatcaagggatgttactataggaggttgacatctgagtctgaaacttggccatagttttgactcttataaacagtatatttgcattctcccttggttctgacattttgtttcctctttccccttttattatatattttataatatataaacatgtcacttttactatttattgtaagggattagcaaatctttcattgaaaagtgggacaggccaggtgcggtggctcacgcctataatcccagtacttcgggaggccaaggcgggtggatcgcctgaggtcaggagttcaagaccagcctggccaacatggtgaaacctcttctctaataaaaatacaaaaattagctgggtgtggttgtgagcacctgtaatcccagctactctagaggctgaggcaggagaagcacttgaacctgggaggcagaggttgcagtgagccgagatcatgccattgcactctagcctgggcgacaaaagtgaaactccatctgaaaaaaaagcgacggtggaggggacaaaaatacaaatgaaatgttttaagcggatttcagtaattggacctttaggacataaataagaaaaagtgattttgttcaagaacatttatgtatcaccgagtgcacagtactaccccaggcattgcaggggactcaagggtagataaggcataatcccttaactcatgttgccttctgtcctgctttcccctggttgtgtggatcttggggatcatgtaggatttgaaagtccaatacattgaaaataaaatattttacaaatactgagtagtggtattaccagtgggtacttcaggggcagggagccatgtgggaggtctgaacttgaatgtttaaccttggagtttcctttagataagattaagtcatggctgggtgcagtggctcacacctgtaatatcagcgctttgggaggctgaggtaggaggattgcttgagcccaggagcttgagaccagtctgggcaactcagtgagacccttgtcactacaaaataattagccaggtgtggtggcatgtgcctgtagtcccagctatctgggagggtaaggtgagaggtttgcttgagcccaggaggtagaggctgcagcgagctgtgattgtgccactgcactctagcctgggtgacgaagtgagaccctatctttaaaattatatatatatataaaatttaatgccttgagaacagtctgcctaaattattatttctcattttttaggaaagaatttaatgtttctggtgttgcgagatggtacaggttatcttcagtgtgtcttggcggatgagttggtaaatattttctcttatttatgcctgaaaattagatgttttcagtagattcctttattgttttgtatacatttatttaaaacatttattatgtcgacagtgaatgtcaatgaatcaaaacatcacattgtataccataaacatgcaatttttatttgtttattataccttaataaggctagagggagaaaacttttgtggaaaatttccagcacattacaaaatagaaccatataaaaaatcatcaaatgcccatcacccagcttctgtaaccacctatatatggctaatcctggtatgatactgcccctcagacatcatatcattttatttaattacacatgcttatgcatctctaagaaaaataatgtggctgggcatggtggctcatgcctgtaatctcggcactttgggaggctgaagtgggcagactgcttgagcccaggagtttgagaccagcctggcaacatggtgaaatcctatctctacaaaaaatacaaaaactagccaggtgtggtggtgcatatctgtagtctcagctactcaggaggctgaggtgggaggatctcttgagccagggaggcagaggttgcagtgagccaagatgatgccaccaccttccagcctgggcaacagagtgaaaccttgtctcaaaaaaaaaaaaaaaaaaagataatagtcacctactattatcacaccctccaccaaattaatacaactactaaatatcatctaatatccagattcttgttatcagttcgtactgcctttttatagttgattgatttgaacgaggattctgacaagactaacatgctgcgtttagtgatatgactttgaaattttctttataactctgctgctctctttgcattctctcttcttttgcaacccgccccctctccccacccattactatgtatttcttgggaaaaccctggtggattgtcctgtggaacttctcacattatggatttggttgtttgcatccttgtggtgtcctttagcatgttcttctagtgtctgcattttttataaattggaggttaggtctgattaggttcagttttttggcacaactacttcatgggcaaagctgtgttcttttagttgcatcacgtcaagaggcatgtaaggtgtggttgtctttttcttttttttatttgagacagagtctcgctctgtcacccatgctggagtgcagtggcgtgatctcagcttagtgcaacctctgcctcccagattcaagtgattctcttgcttcagcctcccgagtagctgggactacaggtgcatgccaccatacccagctaacttttgtatttttagtagagacaggtttttgccatgttggccaggctggtcttgaactcctgacctcaggtgatccacccgcctcggcctccgaaagtgctgggattacaggtgtgagccgccgtgcccggccagttgtcttttttatgactagtgggttcaggtgttggcagcctgacttcttccttttaaagttccccatcagttttttcctaatgactttagtaagaagtgattatagtgtagatgggctctgtatggttttgtttgtttgtttgttgttttgagacacagggtttctcagaaagagtacagtggcatcatcatagctcattgcagcctcgacttcccaggcccaagcaattctcccacctcagcctcccgagtagttaggactataggcaagaaccaccacacccagccaatttttattttatttatctctccctttgttgtccaggctggtcttgaactcctgggctccagtgagcctctcaacttagcctccttcatgggattacaggcatgaaccactgtgcctaacctgtatgttactttaatagtctagatttttaaaaataaataaataaactgtccagatatttttaagtgatgtgggtcagtgtcatttatccatgtatgtaaaatgtgtatttacatgtatatgtatatatttacatgtatatgtctatatatagataaacctctgtcttccacaaaaatatctattttaatattaagaatcagtggccatctcactctttattttactagtatttgatcagataacttgtttgtaaacaatccctttaactttctatatggtagaatttttaaatcaatgtgaataactaaatttgagctttgacctttttatagtgtcagtgctacaatggagttctcttgtccacggagagcagtgttgcagtgtatggaatgctaaatcttaccccaaagggcaagcaggtgagtggattgagtttcgcactgggtgaatgaatagtttatttattggtttgttttccagtgtctttgtttgtacatttggcatatgtattagggttcttcagagggacagaactagtaggatagatgtatatgtgaaagggagtttttaaggagaattggctcacaagatcacaagatgaagtcccacgataggccatctgcaagctgtggagcaaggaagccagtagtggctgagtccaagttcaaaagcctcaaaagtagggaagccgacagggcagccttcagtctgtggccaaaggcccaggagcccctgtcaaagaactggtgtaagtccaagagtccaaaagctgaggaacttggagtctgatgttcaatgacaggaagcatccagcaccggaggaagatgaaggctggaagacctagcaagtctgctcttccaccttcttcctcttgctttttctagccaggctggtagctgattgggtggtgcccacccacattgagggtgggtctgcctctcccagaccactgacttaaatgttaatcttctctggcaacacccagatacacccagaaaatactttgtatccttcattccaatcaggttgactcttaatattaaccatcacagcatataaatacaataaatgtgaagtacatgtcaaattcactatgccttttccagtgaaatatgtacattgtacaactcaggtgataaaaagaatacaatgatttccagccttacggaattcctgaatcatcctcatgggctataatatagccactgtgctgtagatatatgaattacttttcagccagatggaaataaaaacttaacaacccacctaaatatgttcagagaatttcttattagaatttgagcctgtttttattgttttttttttttttttttttttgagacggagtttcgctcttgttgcgcaggctggagtgcagtggtgcgatctccactcaccacaacctctgcctcccaggttcaagcgattctcctgagtagctgggactataggcgtgcgccaccatgcctggctaatatttttgtatttttagtagagatggggtttcaccttgttggccaggatggtcttgatttcctgacctcgttatccacccgcctcagtgagccaccgtgcccagacacaaatatcttttaaaaatggaaacgcacaggctgcgcatggtggctcatgcctgtaatcccagcactttgggaggccgaggcgggcggatcacgaggtcaggagatcgagaccagttttgccaacatggtgaaaccccgtctctactaaatatacaaaaattagccagacgtggtggtgggcgcctgtaatcccagctgctcgggaggctgaggtaggagaatcgcttgaacccaggaggcggaggttgctgtgagccaagattgcgtcactgcactccagcctgggcgacagagtgagactctgtctcaaaaaaaaaaaaaaaagatatttgtgtgtatgtgagtgtgtatttatccagaaagaacattggtaaaaatatcaatataaaactaaactaaagctgagaattaggaggttcttaaaaatctcagcttaccaaaactttgacataaattaaaatcctcaatactgttaattttttatttccttttccctctttctctggaccccacttttaaaaaatgcaggctccaggtggccatgagctgagttgtgacttctgggaactaattgggttggcccctgctggaggagctgacaacctgatcaatgaggagtctgacgttgatgtccagctcaacaacagacacatgatgatccgaggagaaaacatgtccaaaatcctaaaagcacgatccatggtcaccaggtgctttagagatcacttctttgatagggggtactatgaagtaagtatgcattcgtcagcttttgcaaagaatatgttttttgccgttttgaaacttgaatagtggtgctcacgatagcattgatttattccttctttgcatttgaacaggttactcctccaacattagtgcaaacacaagtagaaggtggtgccacactcttcaagcttgactattttggggaagaggcatttttgactcaatcctctcagttgtacttggagacctgcctcccagccctgggagatgttttttgtattgctcagtcataccgggcagagcagtccagaacacgaaggcacctggctgagtatgaagttgtctttttgttttatttctttctaggtaatatctttagagaagaaatcttagtgtaggtaaattatgtttatgttttaaaaaaaaccaactgatatattaagtggttaatggaagaacatataacaaagttttgccaccttagatcgtagctaagttctcttttttcactttgacttgatcttttatatataaaggagcaaacaagaaattgctactcagtggagaagaggggagtccacagctaatttgcaaagttgggaattggtagcattgttggcattttatggacagcttcccaatgttaaaagccttgctggataaaaaaccagtgcaggagaaaagcagtgctgagctattgtctcgttcttcaggtacactcacgtggaagctgagtgtcctttcctgacttttgacgacctcctgaaccggttggaggacttggtttgtgatgtggtagatcgaatattgaagtcacctgcagggagcatagtgcatgagctcaacccggtaggtgcagtgtttatggaaagaaaaagtcacagtccttttttggaagacaatgaagtcttcaccctcagtttttgtagatttgatggcttggtgagctgaaataagtgactaattattttgaagactagaatttgatgttagtcactgtcaataattttataatgttttcagttatataacaggctcatgttttccattttaggaatgtctacatagttttctagtctgaagttatatatatatatatatatatttttttttttttgagacagagtctcactctgtcgccaggctgaagtacagtggcgcgatctctgctcactgcaacctctgcctcccagcttcaagcgattctgcctcagcctcctgagtagctgggactacaggagcccaccaccacccccagctaattgttgtatttttagtagagatggggttttaccgtgttggccaggctggtcccaaactcctgacctcaagtgatctgcccacctcagcctcccaaaatgctgggattacaggcatgagccaccacacctcactgaagtaatactttataatagttttttaatggaaattttagtgttaatgtttatatttatgtatatatacacattatatttttcctttcttctgtagaactttcagccccccaaacggcctttcaaacggatgaactattcagatgctatcgtttggctaaaagaacatgatgtaaagaaagaagatggaactttctatgaatttggagaagtatgtatccctttctctcattgtttccaaggtgggattgggctccaattctcttcttctggttaatgaactagtaacatgggtggcatctgcctgtcctcaaataaatggtaacagcaggacctgcttcttgggttgcctgcagattcgctgagttaacagagtcagccttaggacagtgcctgttctgtaccacccagtaagcgtaagtgagtttctttttctttcttttttttttttttttttgagacggagtctcgctctgtcgcctacggagtgcagtggcatgatctcagatctcggctcactgcaacctccgcctcctggattcaagcgattctcctgcctcagcctcccgagtagctgggactacaggcgcacaccaccatgcccagctaatttttttatttttagtagagacagggtttcaccatgttggccaggatggtctcgatctcttgacctcgtgatctgcccacctcagcctcccaaagtgctgggattataggcgtgagccaccgcttctggccaagtgtgagtttctaagctgccttcatgtctcatgctttgcctcttccctcttccttcattgttcttccttggccacagcttataagctctctttatcattctctaggctggtaggagtgctttagaaggttgtgaagcctttgaaatcacatgcaaaatgttggtatatagatatatatatatatatttttttttttttttttttctggagaatgtatcttgtgcttttaaaaagaggttcatcccctcccccaaaacagtgatttaaaacttcttaatgtggaaggcgagaaagaagatagccattggttaaaaatgcaaaaccaagagagaaggtcttggagaaggtagcctagtgccccaggtaaacttagcatttcggttttgcctgagaaccactctcccagcatgcacttgggttgcaaattttctttatttgggacagcatctccatctgtcgtccaggctggaatgcattggtgcgatcatagctggctacaaccttgaactccagagttcaagtgttcctcctacatcagcctccaaaagtgctgggattacaggtgtgagccaccatgcccagctaattttttattatttgtagagatggcgtctccctatgttgcccgggctggtctcaaactccttggctcaagcagtcctcccaccccagctttccaaagtattgggattacaggcgtgagccactgcatctggctcaagtttccaagactatgctaggccctctttcctgtgcatttaaccattacttacataatatttgcacatctaattgttttacagttgaaatgtgtgtagatgctgctaactagttttgggttttagaaggaattaataggtgaaacaatatactgggtctatgtaaagcactcttgtttctgtgaattcagtttggttttttggttttttttttttaaagagatggaggtattgctgtgttgactgggctggtctcaaactcctggcctcgagcagtcctctcacctcggcctcccgagtgttgagattataggcatgagccacactgtgcccagcctatgaattcagtttatgatgtataatgacaaaattttgtattgagaacttgcatacttttagtgttcctaatacttagtaaaatagtgtagttgagtggaaagaacacaagctgtggagtcagaaggccccccaggtgggcttagctcccacctcttttcttttgtgctgtgtaactgaagaccagtgaccccctctcaggttccttatctctaccttggaagtaacatctgttttgcaagattgtggggactaccggagctaaatgcctaggcaggacaatggcagggggagcctgtcagcatttactatacattgctactgttccacacacatgaggacactagagtggatacatgaccctcaggctttggggggtatgaaataagacctgttttcccctaactaaatcttatgcagaaccccgctgtgtaaagcagatgcaagctgagagactagagctctcccactcatctcctgttacctctcggcgtctccgaggacgcaagggctccagagcctggagcttgaaaacaggtgtgctaggtgattgctacctccatttcccttcttcattaaacaaatctatgagtcttctccagttctctcaatccatttttactgggacgagagttgtcagttttaacttctgtgttaactttaatttatgtgtggtatagaaggatgttttgagagagaaactgatgcgcttaagtcatcatctaacattgtttgggtaactattccaggtgtgcttacacttaccagtttgacattggttatttgtcttatgattgtgtctgtcatcgaaggcataactgattgattacaacaggaaagaagggtagataacaggagagtttaaagataagtgtcattagtaatatactctgtgtgtagatcaatgatgttctggagcattcatgattaccgtatgccttacgggactaagtggacctcatttgcttcagagctagacaaaacgggccactgagaaaaatactgagctgtgtctagtcacagcttggggctggcttttgtttttgttttttttttgattttccttcatcaaacagcatggtgcttgagatatgctgtaaagggagacagatcttttatgcttcattaaataactgagttttaagaatatgtttatttctttttgaaagaaattattctttacacaaatgtgtatgggttaagggtaggtgtgtatcctctactctgttgaattgataggaggaaggactggtacagggtgaaggagctgcttctgtcttgttgcgatccaagttgtaaatgttaatgaagtcttgtttgacctcaggatatcccagaagctcctgagagactgatgacagacaccattaatgaaccaatcttgctgtgtcgatttcctgtggagatcaagtccttctacatgcagcgatgtcctgaggattcccgtcttactgaatctgtcagtttctgtttcaaagagtattaataattttgctttttaagggggtggggactgtcatctggaatcaggtacagctcatgccaaatatttcattctctatctagaataacaatatttaaagacgttgggttttttcaccctcccctgattgaagttgacatgctttgttaaattagagaaatgtaaacatttgaatattacatgatcatagtggctcctttagcccttggagcttaattgtaattttcatttaaactctagggcagtgctgtgtctgatcgcttgatagtaattgtgtatcttctttcacttatatttaaaggtcgacgtgttgatgcccaatgttggtgagattgtgggaggctcaatgcgtatctttgatagtgaagaaatactggcaggttataaaagggaagggattgaccccactccctattactggtatacggatcaggtaaaaccaattttttaagtactcaacatttttttccactgtaatcgttctgtatatattgaaatttttaaaaggggagaattcagggtagtactttggtatttgaatgagctatattcagtttgcaggttataatgtggtgtgtgaatattgccagctttgttttggccaagttatatgttaatttcatttgaaaacctgtttaacggccggcttgttgattgcaactgagttttaaaaaattgatcctaccagtatctagtacccttcttcattttcctcttataaatagacattgacttattttaaaagtttttaaaaatctcttctttccagggtagtacttattccctggttgattttttcataccaaattatttctttatgcatggttcatgaaggcatagagattaagtgctgggattacaggcacgagccactgaatctggccatagttgaattcttaaccacagtgagctaactcctttcatggtggaaaattttaactgtcttagatgaaagttttaacttaagtatttactcctctttctttctttctttttttaaacagagaaaatacggtacatgtccccatggaggatatggcttgggcttggaacgattcttaacgtggattctgaataggtatcacatccgagacgtgtgcttataccctcgatttgtccagcgttgcacgccataaccattttctccagaagcgtggaggaaagattatgaaaggaacaggctctttaaaaaagaaaacaaaaagccagaatcttcctttttttgtttcattggggtttctctttctgtttttctttctactaccataaaaactatctcaaatcacctgaacatcaagtgatattaaggttgtcatcttaagaaaaaatatccatttttttcttaagttcgggaaacaaagttcggggaaaatacctggcatgaaactgtagttagggatacatttcagcattttactcactttatccaagttattcattttattcaagttatatgtatgtataattcaacaattttagattatggtgtaagatactccagtaacttatctttctgtccttttaagtgtaccttgaattctttgatttattttattgcatcaatgaattaaaacaaaaatcttgggggaagaaattggcaatatcgtataaaaatctgctcatattagaacacagtataattcagcagtaaacactagaatcaaatgaatagccttttgtatcagttattaatcttttctaactctgcttagctgctaataatcctgaggcatagaaattgaagaatttgtaaaaatagaattgccttaaaggatttgaagtaagaacataattttggggagagttttttagtgattcacagtatccctcttagcattaatttaaggtaaagaggcagattgattttccctctttcctggtaattcctaagtaattaagaataaataagttccaaaagaaattgtagctggaatcttaataacaattgtgagtggctgtttgagttgcccccaccatgtccttagatctaatctgtgctaccttattaactcacagcaggcttactgaatggcttcatttcagatttagttgatttctccaccaaatgcatgtcatgtattctcaataggctgtattcccagcagtcaataaatgaacacccgtaaaaactctttgctggcttaattttcttaaagctaaacatctctttgtcacattcgttcatgcttttgcaattattttatcttttttatgatgtatatatgtgaaattaagtactactaaatttagtagatattgctaacgttatatggtaatgagaacgaatgattttttaacgttagatatgtgggtcatggttaaatcttttttgtaatcttttttgtgttactgttggacacattagattttatcctgttttgcaattaagtgaaatgacaggtcaaaatgaggcatttaggctgggtgcagtggctcacacctgtaatccctccactttgggagaccgaggcgggcagatcatctgaagtcaggagttcaagaccagcctgagcaacatggtaaaaccccatctctacaaaaataaaaaagttagccaggcatgatggcaggtgcctgtaatcccagctacccaggaggctgaggcaagagaattgcttgaaccccggaggcagaggttgcagtgagccaagattgcaccattgcactccagcctgggctatagagcgagactgtctcaaaaaaaaaaaaaaaacaaaggaagaaatgatgcatttataatctattcagcctgcatctttaaataaaaaatacttggaagagtgtgaatgagctgtagatgacttcaactaagcaattcattttatcagaattaaagtgaagaggttaggctcagttagccttaattttaatggtgtaaacaggtcaaagttttaaaatattaaaggagagccaggatatggataagggagttaaggtggtgacctcaggccgagagactgagcacggtgagcagcaaacctcacgcgtgtggacttcactcccttcgctgtgtagttactaccctaattcaggtgtcacagatgccatcccgcattcccatggctagctcacaaacacccctgccctctcaggacttccatcacgtgactttctcctccctgaaactctctgcttttcataccaaaaacccctccacctttggcacttgtgtgacctgctcagttttggagacaaacaggaggctaattcaattgcttaaatatcaacttgccctcttaaatgtccttcagccatttcaagcgacccagtttcccaccttgccgttcagcccctgccaccttgctgcctcgtaatggttcctaaaaatgttgtccttaatacgtagagtagttcaactctgtgaaaagcaatcttggcagcacagtgggatcatttggggaccttaaaaataatggtgtttgggccttaccccaggccagttgaatctgaatttcagaaatgggaccagggtattttttaaaagctccccaggggaggttgttgcacagtgaggttgacagtcgccaggtggcttcctcctacttctaaactcaaccttaagcctctcttattattgctgtaggttctctattgattttgtattaatctctgtagttgaaatgggaacactgagggctgagaaacttcaaagcttgaattttgaattgccatagaataagtatatttcatccagcccttctgggaaaaaagggatgtcatgatatacaaatactgcaatttctagtatttggaaattgctggttaatgactcagtttcttatgctgaaaagtttccttctgccttatggatcataaccaatgtgatgatcaggtgaagaacatctttgaagagatattgataaactttgtttgtgggacaaagactagtttctacagtcaaaatcaagtttgtattggataaaacttgtcttagtaccccaacttacagaaatgaaggtgttcaaaagttttagctttttttcagtatttacctccaaattgctaaataacatgcttatattactttattgatttttcagttttaggcgttatttattgcccttctctggcatataaggatttcatttcttccttttcctatccccaccattcgtgttcacccttctca

SEQ ID NO: 12386 - DNA, 263693 bp, Human
atatatttgaacatttattgagcctctataatatcacaaccattctctgagtattggtaaattatgaataaaaataggacccaggaaagtcatgtagaccctgcccaagttttccagagaggtttctggaaaggaggaaggaatttaacaatttaaggtggagactgtgaggaaacatattttaaagagcttaaacagcataattaccagggttttatttatttattttttttggtaaatattttgttgcttcctcctgttctttattacacattttatttctttaaatactttcaatgtagttgtgttatattcttagtctaaaaattatgttagttgaaatctcatgggtttatttctcctatttgctgtttcagctgactcctgcttacaggccttatttcaccatgtgttttataatgtcagactacacccccagattgaagacagcctcatttatacaactattggccagtatgagcctatgatatggttcttctgaatggtttttgtgattgcttttgccacttagctgtgagccctacacgtgagactgctttttagtttttccaggttgaagttttccaaagaacacgtttataattaaaatcccaaacatgggatatggcaaaacttctggtttatctaatgagaaacattttcccccttcccagcttgggggaggcaagtttccttgtaatctcccttcaccattgggttgactgattttataccctcctttgatggtaaatcttattccagtccagtgttatctggtgttcttttttgtttttgttttctgagacagagtttcactcttgttgccaggctggattgcagtcgtgcgatctcggctcactgcaacctccgccttccagtttcaagcaattctcctgcctcaggctcccgagtagctgggattacaggcttctgccaccacacccagctaatttttgcatttttagtagagacggggtttcaccatgtttgccaggctggtctcaaactcctgaccttgtgatctgccggccttggcctcccaaagtgctgggattacaggcgtggtcgttatctggtgttctatcacagcctgttgttctgggaaaacttggatcctatctgtgtgtagtctgtgttcactgaaataagcattttggttactatgatcaataaattcccagtgcaggttcgtactctagtttcagatcttccttgattgacctcttgcagctttgtcactttaccaaaagctcaagtacgtgcatttgagcacgtggaaggtgagacggagtttggaaagtggtcatgctctcttttctaccatattgttagaaatatgtcaattcatattaaaataacactttgcttatcttctaaacttctagatattcaagtattttatttcaaatttcacaaaaaaattatttaaaatatcaggcatctcctctcttttattgtcctgggtccttcacttaactttctgatcttgtgaaaatcagtgctgcttcatcttactctgtgcagtgctttctttcctttgtatgcctgccttcacagacaatttttagtaggtgtctacatgtagttaatttgcgtgtgtgtgtgtgtgtgtgtagttgttgtaatgataatataggatttatacaactgttgggcaaacatcttttttttagctattgcccaatgtggtcacacatataagacctaatctctgaataaggaacagattgtctgagtgtgaatttgttcatttacttgactaacagaatttcagactatcagcttgaagaagtgctgtatttagtctgatggttaaatgcataataaagtaatatgtataatggtagatcatgttttacaaaactttcatttttctttataggtaataaaaaattggggggaaataatcagcgtttggaccatgtggtttagacatcatgcattaaaatcttagaaatcacgcttaaaaatcaccattaattgtttcccaattttttttcagctcttcttcaagtgacaatttcacttagcaaagtagagcttagtgttggagaatctaaattcttcacatgtacaggtacgtatttctgtaaataccttcagataacgtggtttctgttaaaatattaataaaatgtgttggctaaatttaactagttaaaaactcagttctctaacaataacatcttacagttggttttttgtttttgtttttgttgtttttgagacagagcctcgctctgtctcccagactggagggcggtagtgtgatctcggctcactgcaatctccccctcctgggttcaagccgttctcctgcctcagcctcttcagtagctggactacaggtgctcaccaccatgcctggctaatttttgtctttttgtgtttttgtagtagagacggggtttcaccatgttggccaggctggtctcaaacttctgacctcaagtgatccgcccgccttggcctcctgaagtgctgggattacaggtgtgagccatcatacctggccattgttgggcttataatgattggaaaagtgttaatagccataacttgcatataaaatgatattaattttatttttgttaatttgttaatttagactgctaatctagatcatttattttgaaaataccttatgcttgcattatatctgataataacttaaatcaatttaaatatttctgtctaaacagtaatattaggatgaatataaagattataactgaaccatttttgtaaatatgcaatgaataaatttggtatggcacactgcactatagttatacttgaatgaaaatattaggccaaaaatttattctaatattcattgaagaaatagttatttagtcaggaaagctttgactagatttttatgacaatggaaagaatcatatgtcatcatgcctatggcatattttatgggcctcattcagaataataatatacatatggttttctttccaaagaaatttaaatatttcagcatcaaagtttaatcaaacatattatagaactgacaaatgaatgcattatttatttaggtacaatatattcatttttacaaatacaagtcttcatatccaaactatgatatacctaaataattttttaaaccttagtgctaaaattagttgagactattttagaattgtttctaatcttgattacactaaatcaacttaaaactggattaaaatagacactagaaacataaaatgcattataaaaattgtcttgagaatgacatgatttatttaaaccaagattcaaatttataaatatagagatataatattttataaataaaagatatagttataacattttataaatcatattcagagcatatatgtataacatgtcacattttataggaatattaatagagcccatgattctttatacattttccttcttaaagatgtcagttgatagttatgttaatacaagtatttgtatattgacaaatgaaaaaatcagagagtgtggaagagattgattcagcatcatatattatgtcagcagaaatttgacacaagcatataggttactgtttctaaatcccatccatattttattaatatcctcataaattagaacacacgaattgtatcacataaaggtagaataacaaaatagttaaaaaatcaattttgaaaatacaatgaaattgttgtacttttatggatttgtatattactatgaaatatattgcacagactaatttgcctgtatgtattgcatagctcaaattaagacatactttaaagtgaattaaggccattcattggtgatgagttttgctcttaataagaatgtaaactaagtaagcatttattttcttttatataaagatgtatcacctagagcttttctatagtactggaagtagtcttatttatattaaatatagtagtaaaacaagattctaaaaataaagatattggaaaaccatgcaagccactctgcttgtatgtatttttctactacaatgctgacaatctagatactcctccaacatttccagacgccttaaaaatacaaaatctaaaactcaataaaataaatatcttaaatttaaactagaaggatgttacaccctcaaagagctaaagaagtgtcatacagaaaattgttataactacatttaagaaaataaagtttaatgctatttataaataatctgtacgtacaaatagtccagccttatcaaaatggaaaattttgatagaaattatttgttagagatgcctgaaagaaaacaattataacagctttatgaaaatctgcaataaactgttaatgaaaatgaaatgttctattatattaagaatgaaaagactcaaaatatttatcagaatatcctatttaacttactatataaaatattattttgtattattcaaatgtaaagagatgaatgtttaaattattttttgtgacttctccatagatggaggaattaaataaaacacatccctcctcttcaaatgcattactctgtaacaactatggttttatgatttgtttagaaaaagatgaagataatgtaactgagatctttttaagattcactaaactttctttcatacttttactcaagcatgtctaatttcttatagaaaggaggataatttgtttctaaaaccatttcttcggaaaaatgagaaggaataattttcttcaaagaggtcctgcagatgttagttgacttcatgcatttccacatcgatacttttgagttaatagtgtctgctgcttccataaatgatatctgaagtaattaggtgaaatacatccttttggtgactaaaagcagacacagaaatcttcagctttaatgaaaggatagtaacctagattctgaattggaaaacttaaataaatgtttaccctgtaatgatttggttgtaattacctagataagtatcatttcaatgcattgaaattatcatatgaataaatagttaacagttttagattaaaataatgaaactacttatttctcttgggaaaagagattaggacatcattataaaaacggtcgttggccttatctattcaaatttagcaactagggaaattaatttcaaatttagtattatcaaaggccaaagttggttttgtgaaagatttacatttttgtaagctcgacattttcagagatttaagtgctatctcctgaccctagcaaagaccactgagcagatgaaatcatattagtaattgtggttctgttcagatattatctataagtgggttgtatgtctggctcagcagtcaaggaagtttcagaacttaaatgtaataatccattgattaccaagggaaaatttcaacaatcatagcttaaatactgtacaagaagtttgctgtgaaacttttaggtattgcttactcaagcgtgaatcttccatgttggataaacaaaggtgaacatttgcactaacatttgtgtttactttaagttttgtaagattctcagatttccagtctgttacataatttttttctaaatggttaatattattacataatagtaaatgccaatgttcaaacaaatatttttaacaattttcaaacctttattttccatggctctttgcagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccgtaagtaatgtatttatatgttttagtttattcaatttcagttgcttataaataaccgaaaaaataaaatgtttgataacacttattaagaactatgtgctttgaaaataaatatcagtttatttatgctttaccagagtgtatcttagaatagaatagctaacagataataagtggttataaacatatatagggcatcaattatattaaataatattaataaaaatgttttcattttctcaagccattaagaattcactgggtatatagagaatagtggtttatttagtggtatgatatttattcagcattttttttttcactgtaaaatagaaggtcatgattagaataaatgaaaatgtgtgacagcactgaccattgtagaatgagaatctggggaagggtcagtgaacaagagtagtcagaaagttgaaactgatctagtagccaataatattgagtcaggattctttaccactaagtgtttttattagcaaagctttccacatttgcacttcattttatgtcctgggatggatttcttcctatgttcctttctcctccttatatttaagaaccattaacctgtttaggaacattgaaatctgttgactcctgcattttaaagcaagctatcccaattactttcgtgaccttgagcaaatcatgtaacctctctgtctttagtttcctcatatataaactgaggataataatggtacctatgtgatatatggagtttgagtactaccttaaattatattgcataaagtacttacaacaatgccttacgattaataggtagttagcatttctaccaatggtaaattatatatatattaggaatgcaagcccttaaatcatctcatatctgtagctttgtgttttgtttgttattctagaaataggatatgaaaaacaaagtcggaacattcctacagtaggacttcctgtttgatgaccaatgcaatttgtgggcacattgttgctcttgtgtttcctgatttggaatttttccctcccatttgattctgagcttccgaagaaatgatattttcctaatttatgtaaccccctagagtatctatttcacaatagcaaataattaaattgaaatggtcattttatagatataatgtttggaaatacttttttattttaaatgatgcaaaagaagaattgtgacatttgcaaaggtaaaaaaaatttttgcaagaacaattcattacttctgtgagaatttctcatcaagcataaatatccatgttcactcattcattcattcattcattaaagacacttattaggtgtgtatccactataattctgagtcctagccagagacagacagacaataaataaactgaaacagatacatagatgctagctaaacatgctatggaatcctatggaaaataaattacctggggtagagagatagagaaccttgaaatggaaaggaatattgctattttatataggcaggttggataagaatctgaatgaattgaaggcggtgcaaatgccctgtggtgagaacaaacttggaatgttcaaggaacctccaagaagacagttttcctgagtgacaaggaagagagaggagaaattgagattggagttgaggagatacactccagtttatacagaacctcatatggcattgaaagatctttggattttattctcagtgagataggaaggtattagggagaagtagattatctagtttaagattttaaagtatctaggtttccctaattattttattatagtatcaatagagtctggattatgttattgggagaaataagcaatgatacttttgtgatttgtgatttgtgatttgttttactttgttgatacagaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacagttagtattttggtaactccctaagttatatgttctaatactattgcagtttttaaaaatctgaatctatgtgtctagttgtagaaatttgaatttttgaccccaaatattcaacaactattttgagaacctgtaagctctacattaggattttgcaatctagggatctcagggcaaattcactgccctttacccctatgttgtaatcaaaacacagttatgcccgttcaccacatactgtctgtggcagctttggaggcatagttgagaagctgtggctaaaaaaaatatacaatcattagcctaaaaaaatgtacaatcgttagcctaaaaaaaatacaatcattagtacctggagatttacagaaaaggtttgcagacctttgctctagtgtcaagaaaagatgaatacattataagcagtactaagtaaatgaaggagtacatcctgctgtattcaaattctgtataatttatacatgattctatggtatcactatatgtaaacttagtattgatgtgaattatgtttattattctggggcagtacgttcaaggttatctacaagttctaaatattatggaaagatccatatagataatagaaaagtactttcattcaaattgtcttcatgattttgatttagactgtgctaaaatttcagaataatatgacatctgaaatcgaatgtataatttgcttacattatgttcctttaccatgttcatagggagcattttcaatttagaattttttcaatgcacctgcacagcagagaggtacaaaataattgaatcttttaaagtagtttccatcttcgatgattctgatttgtgtccaagggatgaagattctacagcataaagaagagacagaaaataatatctatttttgaatatgtggggagaatgtatgataatcatgttcaatagtcacttttttaattttgaaagaatttttctgagcttagcatgttcaatgcttgtcagtttccattataatacattaatgagaaataacactttatttcctcttgttctgtttcagcataactctgtacagtgtattaacaagtcacatgagtaaatgggttgatgtatttttagctcttttcccctcaataataaagaaaaagcagtccttttgtaacggtggaatgacaatgtctaaatattttcagactgtctaatcttacacctcaagtgtaggtttattgtaaaactttattagtagaatattttgaagtaaattttatttttaaaagtcaaatagagcaaagcctcaaagcaaagactgatgacaacgggtagtggtgatggagaagtgatatttccatgctagagctcatacgtatttccccagcatcccaggactaaatgacgtacagccagatttccattttggctttcctcctttccttggccctgaagctttgaacatcttttctaaatgttctgtgcctaaatcagactctttatctgtaaaacacagatgattgccttcatttaaaataatggctttgtgtcataaatgagactttagacataaagtcctttcttgacatctatgggtgatttgttccaggacctcccacagataccaaaataagccgatgccaaagtctcttatataaaaagcatagtatttggtataacctatgtacatcctcccatatattctaaattacatctggattatccataatatcaaatacaacataaagactatgtacatggttgctatacagtattatttgggaaataaggaatagcctgtacatgttcaataaagatgcagtttttaaaaaatatatttttcatcagcagttgtttgaatccacgaatgtggaatccatggatatggggggtcagctatacttcatttgttaagtgaatgaataaaatatatggctatatattagattcttaataaatgacatgtatcgctctcattccttctctatgagtttttaaatcttggaatcagttttgctaaaattacatgtgtttaggttatatctagaaccagaaaatccaatgtagaagaaatgggtatagtttaacgtgaaacataacactaagttgtgtggcaggtgaaaaataaaaataaaataaaatcatatttttaactatagaatttaaagtattcaagtaaattatcaggaaggacacacttttctaaccttgaaatagtgtagaaacttatcacataaatcattattgaacaatttgtacatttataatagacttatatgaaataatattattcactgcttatacctcatatagtcctttattaaagctgatgaaataagatcaagattacaattatgtatgaggatttagaataatgccacggacccagatatatttattttgccataatctgattcaaaagtaaaatatagatattccagaggaaataatgaaagcttggaaatgctcatcttattagctatgcttttgattgtagctgcgtggcagatattcagaattaaacttcctgcagaaaagcagtggagattttccatgttgctcatagaaaggagatccgtatgctaaaggatccaagcattgtgggagtaaaggtgacattttattatacaagttgaatatctgtcatcgtgatggagggatatgctatttgctgatatccattcaatcttggccagtttggaaattctctcttaaactttttaaatgctttggccaacacctaattgatatactccttctgcattaaaaaaactgattaaaattaccttgttcaatacaatttttatataacctacttctagtataaaagattaattcaacaattatggaatacacaggatctatgctgtagtgtaccagatgattatgattcatggtaagcaagataagttcactgccttcaaaatactaagaatctagagggaaagataaataggtaaatcagtgtgagaacaagacacattgagtctatgataacgaaattgtggtaataaaggatgataaaataaatgtaaactacgtaggataagagagagtgtcaaagatgcctgccaggaggaaaaagttacctttaaatatacacacgtattagccaggcaaacgtcggtgcggaattttcaggaagagggaagaccatgtgcaatggcccagaggtgaaaagcagcatgaaagcatatttctgaaactggaataagtttattattactagaacttattaataagtgcaacttagatacttttacaaatgagtaaatctaactaggatttttaaacaaaggactaataagaaaggaagctgaagaaggaggtcaaaccaagtcagcacagccttgatatctgctactacggagtttgtaatttattcaaagggggcatcattaaagggatttaatcaatgcagtgacataagctaatatacagttgagaagaatatttgtatgtcagtgaaaacaacaaattagatgggagtcaaggcaaaactcctgagactcagaatagttcaggtcctaatgaaatattgctgagggagaagaagacttaaattaaataacgataaacagagaagtgatgagacatggagtctgattgggtctgcagactcagagagatgaagatgtcaagaatgactcgtggaatttgccttccatggagttccatcacttatggaatattcctttggcaactagttccatgtaaaggcatgtgaagacagaactggagaatgccaggtgataaatttcaggtggagatgttgagctaaattttaaatatatttttcctaattcacattaaatataatcagtaaaaatcattataggtgaaggatgataggtattttagaaagttagaaaatgcagtaatacaatgatctaagtatgatagtgttcctcttcattttaaattttatttatttataattgcctctcatctaaatttctgaacacacactttaagagaggatttttaattgactttgaaactttatgaagtttcaggagtttctggttatttcaggaccacttatgagttatcttctaacatttcttgtggattggttttctttctccccagtctttcttttgatgagggcatttcatgtttgtgctttaatttaccaggggaaagaatctgaataaacatttttgtctctcttcttaggttcaacctaaggaaaaagtgagcattatggaaaagtttacacctcatgggctgcaaatcatgtggccgtagcattagaatcactattttcactttgggggagcctctgaatctgtgcattttcacccctgattagttacctcttaaacaaaaagcaactacaggcttgtccgtttaatgagtatctatgccctgatgactcttctatttgttatttctagccccgacttctcccctctcattaaggaacggctatgacaaatttgcccccaaattggagtggcctactaccctagcagtttatggctcactcatgcaaagtccagttggcagcagaggtataggcaggatcctaccatatcctttccacgatcaggctgatggagactctgcctttttcacatgtggcttcaagtggttttcctaacctcattatcaagccaacagatagggaaaaaagcagtacacattggaacaggcccaaagagtaaacaatagactgtagatatgttagaggctgggtaccttaaaataatcacctttctacctgatcaaaaatcccaaagggatagaggcggggtgtctcttattcatcaaagtgtcttatatacagtatccagcaaacagataatagtcaatgagatctatggatgtgttaattaaggaaattttagatattgcctgtacaaagagtttcaaaattggactatatgtaaaagcattctttgaatgataaggagagaaaaggttttagcatggcagcaagattgagatgcttataaaatcagggcagacacaaaaaataatgccaggctgagatgctgcttaggtgtcacagattactgtagcagattactttacacaatcagtgaatgcaggctgtataccagcttatttttttatatatgcatgtgcacacacacacacacacacaaatggaatcttgaaataaaataacaaaatctaatctatttattcctaatacagattatcttattagccaaaaaaatcccttgaataaatttgagatataatcttttttatatcctttatatgacttgaatattattatatcatttagttgcctccacagagacgcaaaattttttgtttaattattgtatgaagaaggatgttcaataaattttctagcccttttccacccatgttgccgcatatttgcagtcaaaagtttgcacatctgtgatacctaatctctctgcattgttcttttgtgtatcatttctgcatccaaagtaccaaggggaaataatagcctaaccattttatgtggatataaagtcttgaatgtattttattttattcttttaggaaaaaaaaaaaggtgtaacaaagcagtgtagagtggaaaaattgaagtcatgaaattacattttactttcaaatttgaatttgtttgctgatgaaaagcttgatagtgtcagacagtgccatattttaactcttaacaatttagagcactctggacttagccttcaattactgataccattttctcccctttgctttctttccagatcggttcgctatgttagcaaacaataacctgcagattctcaacatcaataaaagtgatgaaggtatatacagatgtgaaggaagagtggaggccaggggagaaattgacttccgtgatatcattgttattgttaatggtaagcagtaaataatttgtacatgttttatggattcattttagcaatgttttttattaaatggcaaccatgtgaactcaaaatacaagtcttatctaataaacctcttctataccaggaagaaatctttccatctttattatggcatctgtaacattgtattacagcctcaaggcaggatccatgacttatgttacattgtcattctcataacccttttcaaataggctatatgtgagtaattgccttttgctggaattgtagttgttgaaagaatatcaaataaacatagtacagtatcatactaaatgttacttttaaattacatgaattatttttgcttaaatttacatattttactctacatgtttctcaaatttaataattaaatttttaaggttatatttacaagtattaatggacattagtgactggttttatgaaatcatgatgaaatctcttcctccaaagttgcttctcctatatagttccttcctgtgttaacatgatattctatggagctggaaaatacattacagttatcttggctgtctcctgtactagcccattttcacactgctataaagaatactcgagactgagtaatttataaagaaaggagatttaattgactcacagttccaagtgactggggaggcctcaagacacaatcatggcagaaggcagaggagaagcaaaggcatgtcttacatgacagcaggcaagagtgcgtgagaaagactgaagaaatgccacacttaaaaccatcagctctcatgagaactccctcgctgtcacaagaagagcatggggaaaaccgcctccatgatccagtcacctcccaccagttccttccctgggatacctgggaattattaatacaacatgggatgaaattttgttgaagacacagattttgttgaacaatttcatctccattttggcagtctaatctgttatgaagacatatccattgtatattttaacatctctcaaacatactctattttctctatcatgttgttttccatgagagtggtgatctaatttttttttcttgaattcatacaacttggtttctctacacttaatctcacaattctacctttctctccaccaagactttcaactgtaataattcttcagtgtttctcactactgtcaagacaaaatcaaaacgacttttcatggcatagaaaacccattatgatccaccccttccctaagcattctgccattagatgtcagtcatagggaaactgggtccttagaggagatctagtatttttcaatggtctttctagaagtacagagtccgatatttattaagggtgccataatcagtggagtagttaaccttcagtgcgggaggaagatttcagtgcataaaggataggtttaaatagggagatgtctgtatctaacctttatctatatcaatatgtaactctttctctttattgtatacaataaacaagggtaataaatatatagtggctatttagtttgttaattattgaattgtctaccatactttgtatccaaaaagatttatgatgaaatatgtaagtgtatttcatcatgagcagtctttgtgttaagtacgtacttatgaaaaagggaattataataaaaattaatatatgtaaaattctttaaaattggttaagtttataggaaacagtatataagtatttcctattattgttattatatatacatataattacactaaaatattaattcaagtttgatattaaaatgaaatttatccagcaggcatagtaaccctttgttattcattctgctattgtagtttctactttaatatgtggttggtgcaaaagtaattgtggtgtttatcattacttttaatgacagacaccgcaattatttttgcaccaacctaatattttctttaatatatttatagcatgttgtaatctttttccctactagattatctgtgattattatgattacattcattttaaagaaatgattattcaggtatgaatattcttttaataaagtgtgaatcttcatgcccatcatggtctgcatttcaactggaatatttagttttatatttctatacttatttatttcaggatgtataaggagacaaatataggaatatgtttttatgtgccatttctgatcaatcatgcaaataattcctgttttgtctgtatcagttggaccctcccaaaagtaaattcttctcctctgtctcccactttcctctaacagaatcaaccatagattctaatatgaacatctttgctcggacattgataattagtctcatttttccctttaggatcacaaactcgcgtagcttaaaattcctggaatctcttttattttaaataacagtgttcataaaatcaggtatcaattgatttccgtctggaggatgcagttggacactgctgagagaatgcattgactaatgccatcagacgcctgtgcttttctctcacattttgccttaagacagaaaaatcattttactccagtcttattgactttcaccctgcttactggctccttttaaatatcgaggtttttttttttgaaagttttcccttattatgcctcttttataaaactgcttaaagatgtttcagtgaaaattttgaggctgcaaaaaataataccaataaaataaaagtgctacttttattcatattatttgatctttaattactttgactttgactgctgccctattctgttcctctcagtttacattcccagccctctcacttaattgctactaatttttatctttaccaatttgacatttattctggtcctctttcattcatcttcttccacctcaagtataccgaagtcctacccaaatgccccagtcaaatgttttttcacatgcagcgcttccttgtcaaatcttggccttgtaggaggacctgccctttattctacgttttgttctttgcaaacttttccatcacatttctatcctaccaattcatactcttttgtttcaacaattagttgaaagatatccttgctggcttcctctgtagtaccagcaataatacatgtttaggatcttattacttactttattttttcttacctccctctgtgactttcttaatgtgtttttcaatgcctgggtattgtttttcacaaatattcttcccctcccttgaagaagattatacaccaatgcctttgatatgtgaagtatggcgcctccaaaggaaggattatgcatcttcacccagtcgatcatgtgacttgctctagccagtgacttagaagcaaacaaaatacacaccatgactgaaatcaaacttcaagaaaacatcacatattttctctttttctcttgtttttttccttccgccatgaaaagagcatgacccaaatagggacttacccttcatcctgggcaccttgatgaacacaggaggagcagattacagttgatctgcaagtgcagacaacataacatgagtacaaaataaagtatatttttaagcactgagattttaaagttgttatcatacacacacacacaaaaacagacaaatgcaaaactagtgcttttgtctgtttctctctctctctctctctctgtctttaaacaatcaatttaagcaccatctgacctaggtgtacttttgaaattacttaccttggtgtcccttttcactttccctgatggtgatcatttatgacaaatttttgtcaccttattgaggtattgaaaatttagctgaagagtttttactgtcatttcaaaattattttatattgttttcatatatttattcaacaggtatatacaaagtgctggctatatgttttacactatattgtgcttggactactaaaaggcctaacacagcatcatttccctttagacacttagagttgtagctcaacaatctgtaagaatcaactttactaaagtcctttattgtttatggggtagctggattcaaaagcatttaacaaatgcagttttcctagatattcacagactattttttgagaatggaaacccaatgcagctgaagacaggagagtaccttggtattaaagataaatataatgaaggaaaactgttatttaggagaatagggcaataatatgttgcagacagaaagaccaacacttgtaaaacaaacaagagcataagttgtgaaaaaatccaagcacctaactgtgattgaaatatactgttttttgacaggaataagaacaatggtgtgttggttggtttggagattaggtggaggtgcagctgaaaagcaggtagcagtcaatcatggatgaccatcgatgctttattaaaaacctgatttatgggacaaggaagagctgccattgagaagcaagtaatccagagagcaagggagttgacacaaggatattggcagggagaaaaagtgagttcatgtgagagataattggggcctttactaaagggcaaggaaatgaagaggaaggcgtacaataaaactagatttcaaagcaaaatcatcatgttatacctgtgtcacagaggcaagaggaatcaagggtaattttaagacttctagtgtgggttttagggcttccagttatccatgcaagcaaaaatgaccaatacagtgtgcacaaaaataagtgtgctgaatttagagattatgaggttgcaagagacattatggtagatgatactgcttatgttctctgtgttaaattcagattacaaggacttgaagcataaaggtacacatatattttttaaaggatgaaagctaaaaaaaagttaaagacctgctacctaaggtttttggacttagctattaaatggggaacatcacaaagttgagttaatgactataggatgttgttgaggctttaggacaatattaaggaatattaccttgaacataaggagaatatattttatattgagcctggaggaaatgagttaaaaaatgagtaaggacgtgcataaattcataggtagatttggtcaataatttgagagaaatcctgctacatgacttcagtattctattttcagttagctggttgccctcaccgaacaaacattgatataatcttgatagtcataaaaaaattttacttgcttatattaaactttttattggatcttcaggtaagctctccaacctgcctaaaacctttctgttcatgaacctctgagtaaatgctttcctcatatcatcataccttgtttcactctgacatactatgtgaaatcttttaaaaacagattaacagagacattgactgaattgattggctaccttttccataaattcatattcttttaactagataattgtgctatacatatacacaaacatgcccacttacacatcatggatacgcttttctaaaagaggattaatattgtctctcttactttaacccacatatattctcccaccatctgattcctaggctttagttaaataatacacactgtactactcaaaaaaaaaggctcatatagatgaaagacctggaaataacttttaaacttaaaatacagtcagtagagtgttcattttataaaatgttcttctaacgtatagtgatttattattttatgaatattttgtaaatttgtaaagagtgattcactaactgcaggttcaaattggggtaatggaggcaggaacaattgagattggataaaaaacacctagtaatgcaattgtaaagcaattgtttctttagtcgatctttgaacagtaaaatcaacagtgggtgataatggccagagatgtccgtacaaatgagtgtctgaatgtatagtgcactttgttatctcagtaacccccaggcagtaatttttgtattcctacctatttcttgcaatttcttgaagtcatgaaaatgaggcaaaaaaacttttctatttataaaaaatgaaaagttaagtcaaaattttctctttaagttgtatgcagtgttttagaatgtaaagcatatacaagtatgaaagagtgaatttgtctcttgtagttgaatcatgtaattgaatcaaccatgcagacagctattttaagtcagtttaatgagtgcaaattatgagggaatttgtagtttgtaacaatgttatataatatacaatatataatttacccaaatcaataaatatttacccaaaccagagtattttatagttttattaattgtgtatccctaatgattttattaaatttcaagaataggcaatctgggaacacaagaaaagaaaagtatatctttttctccttatctcttatataactgttacttcagaaatttttagtttatataaactagagaaatgatagatacagatagatagatagatagatagatagatagatagatagatagatgatagatagagataatctgcacagatctaggcacatctttctttgcttttctcttccatataagtaattgatttgagtatttaatacagttcttttccttaagtctctatttctcttttactcagattttctaagtacacttagtgtcataatatcatatttgaaaagctgtagaaaagcatgtattgatttttcaacattgtacttttaatccctgattaaatatatggcagaattttctcattgtttgaattggattcccattctgaatttatctgtttcaagtgtaacagtcttctgcttgttgattaggggctgacctttgtatgttgttctctaaaatttatttgatgagtacagaagtgaatcctatcatttgtgaaaccacaacttatagaaatctatagggatcacaagatactgcaataatgcaaatttttatcatttcatagaatcaatcagtaaaataaaagtcaccatcaagatgccatctgacattgtggagatgaatggcattcaggaaaattaatgtctaaataactttggagagacattcatgggtcctgttcctcaaaatgtgctgcactagaggataacctatgaaaccatatcagtattttattcacactgaaattcacaaatgaccagtatcaccactatctcttgccttttttttttttgcttgtgtcatatcctatggcttttaataaaagcataggtattcggataatgtctgtttctgatggtgaaagtaataaagcagagagaattcaactcacgttacataaaaatgaaataaccactcagttataagtaaaactagttccatgtgctacatcatcttcttaagcatagtttgtttttctttttatgcagatatgcttaatttctctaggatgagatttcacaatctccgtctaaaatgtgattctctctctctctctctttctctccttccctccttccctccctccctccctttttagccagactgattgctatttgtcttataaaacttagtccaagcatcatttctagaactagaaagcaattctaaatatgacctgccttattgcaagatttcttcccatgagatctcatagtactaggtccactctgtaaacttttcaacgcttaagtatttgaaaggactcagcaggcttcacaaagtacagttgttccttggtatctatgggaagttggttgtaggaccaacatccatgggataccaaatccatgaatgctcaagtccctttatgtaaaaaggcatagtatttgcatatagcctacacacattcttcccatatactttaaatcagctctagattagttataatacttaatacattgtagatgctgtgtaaatagtgttacactgtattttaaaaaaattgttctatttttattgctgtattggtattttaaatgatttttaaaaatatttttgatccctgcttcgttgagtcctcagatgcagaacctggggatacagagggctgactgtatagtcatgtaaatgccctattcttaaaaaaaaggatatggtgcagccagaaaaagaatgcaaagtgtcagacctgtgagagacaatcccctgcacaagatttccaggggccctatttgcaaacaagatgatgtgtatgttcaccttgaaccacgaagatccaaatgaggcacctcaaagagactctcaggtagagttctttaagtaatttagccaagcttcacaaattgtttaggttgagtccaaactatcagtgcagaaaatgactttggaggttgccaggaaactttctggtccatcataaattccaatgtccttaccttggccaaaagtcatccacgtatctttgaagatattgatagaacttttccagctgatccagaaaccaactccattccaacagcctctttaacaatgtacctttcacactgacttgaaattatccatttatgtgtgacattatctcacagataacaccattaatccttcaaggaaaaaggtgatattttataaccttaaggtatactgtagagatttgcatacaggaggcggtctataacttctggaaagatttctttaatttttaattattttgtgcaaatatgtgattatctcaatcacaaagatattttatttcataattattactacttagtttttttctctatccctttagattatataatccaagttattttactattatcttgagaacatttcctcctcaaactatcaatctagtaatgcacttccagatatcttgcatgtattttaagtttgtcatgtacaataatctgcatagatttaaaatttcaacatatatttattaatgtatgtgtatatatagatatgcgtttgtgtgtcggaaaaataatcaccacggatagtgaatatatcttcttttgagaagtatttgttcgagtcctttgcccatttctttaaatgggattgtttgttttttgcttgatgatctgtttaagtcccttagaggctctagatattagatctttgttggaggcatactttgtgaatatttcctcccattctgtaaattgtctgtttattctattgattgcttcttttgctgtgcaagagctctttagtttatttgggtccaacttgtcagtttttattttgttgcagttgtttctggggactcagccaaaaattatttgcgaaattggatgtctagaagggtatttcttaggttttcttttaggatttttatagtttggggtctttttttttttctattttttttttttaattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtaacaaatttacaagaaaaaaacaaacaaccccatcaaaaagtgggcgaaggacatgaacagacacttctcaaaagaagacatttatgcagccaaaaaatacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattagtgggtatatacccaaaggactataaatcatgctgctataaagacacatgcacacgtatgtttattgcggcattattcacaatagcaaagacttggaaccaacccaaatgtccaacaatgatagactggattaagtttggggtcttttatttgaatctttaaaccatcttgagttaatttttgtatctgatgaaaggtaagggtccagtttcaatcttctgcgtatgaccagccagttatcccagcactatttaatgaatagggagttctttccccaatgcttgtttttttggccttgttgaagctgaaatgattctaagtgtatgatttttctattctgttccattgaactatgtgtctgttttttctgtaccagtaccacattgttttggttatgcttatcatcactaatcatcagatagatgcaaatcaaaaccacaatgagatactgtctcacaccactcagaaggctattattaaaaagtcaaaaaagcaacagatgttgaaggctgcagagaaaagggaatgtatataactattgttggaaatgtaagtcagttcagccactgtggaaagcagtttggagacttcttaagaaacttaaaacagatatactattcaacccagcaatctctttactgggtatatacccaaaggaatatagatcattataccaaaaaggcatagagacgtgtatgttcatcactgcactattcacaatagtacacacatggaatcaacctagattcccatcaatattggattggataaataaaatgtattacatatgcaacatgaaatactatgcagccataaaaagaatgaagtcatgtcctttgcagtgacatggatgaagctggagaccataatcgtaagtgatctagtgcaagaactgaaaaccaataccacatattttcacttgcaagtaagggctaatccttgaacacacatgaacctccgcatgggaaccatagacactgcagaatactagagcagggagggagaaagggaggcgtgggctgaagaacgaccttttgggtactatgcaaactgcttgggtgtaatgtgcccatgtgacaaacctgcacatgtacccctgtatctaaagttgaaaaaaaaaagaatataaagctttaaaaagaagtcagaagtggaaatgaaaacatagtaaactttatgaaatgctaaaaaagatagtgactatagtgaatgtatctattatccataataatttctaaaaatgtcatataaccgtgcaatatgtattttcttttaagtggattcttacccttttttcactcaaaaattattttgagattcatttatgttatcccatgccataatatgtcatctctttttattgctattagtattcaattttaagaagatttcacaattttcttacccattcaccaaaatggcttttgggaagtttcagatttttggcttacaaatatatacatatttatatattatcttggtatgggcatgtttttatatctcttggttaaatacctgtgagaggtaatggctggatcacatgccaagtgtatgtttatcacttttaaaaaacacttcctaaaagttttccaaagtgattgtactattttaccttccccaaagcagtgtacgggtatttcgggtatttcacttgctccacatcctcaccaaaacttgacatactcaggactttatgtttagacatcctaatacatgtttagtggtttcatgttgtggatttaatttgcatttccctaatgcctcaggatgttaaacatcttctcatatacaactcagcattgatcatttttggtaaaatgtcttttcaaatatttaacgtagttttaactgggctgttttcttattattgagtttactgaattctttatgtatttggaatgtaatccacttaccaaatatgtgatttagaaatatttttatccaatctgtggcttgtttttctattttttaaccactgcctttcagtgggtgaaagatgttgatgaggtttaatttttcttttttcatatgaatcatgcttattgtttcaaatctacgaatgtattgtgtaaaacaaatatgttaatactaagattttccccaattcttctttctagaagttttgtagttgttgtttttaagtttagatttatgataattttttcttaatttcttacgatattgtgacaaattggcgaaaggttttgtttggtttgttgtattttttttttggcatgtgaatgtccgatttttcatcattggctaaaaacaccgtactttagcaacagaattgccttttcattatttaaaatatattttaatatatgtgttttagggaatctattctgttccattgatctatttatttgtccctttacaccaacaaaagccgttatgataagttggaataatgtattataagtcctccaactttgttcatcttttcaaagtagttttaatatagaataaaatactctaggttctgttcatttccatattaattttagaatcaagctttcaatttttacatatacatatgcactaacacacacatacacatccactaccataactttgattagaattgtgttgaagctatagatcactttgagaataattgtcttcttgacattattgatccttctgttccagaaacagaaaatctctgtatattcaggtctctttaatttctctcagcagtgttcttaagtgttttttatacagtcctaactcatcttttggcagatttatctctaattattccatatattttgatgctattataaaccacattttaattgttaattgtagcatcatatataaagatagataatatattctgaaatgtactaaattcatttattatagtagttcataattagcttatggttccgtagaattctctacataaatgataatatcactgtgggtcaggcacagtggctcacgcctgtaatcccagcactttggaaggccaaggcaggtggatcacctgaggtcaggagttcaagaccagcctggtcaacatggtgtaatcccgtctctattaaaaatacaaaaattagctgagcttggtggtgggcacctgtaatcccagatactcgggaggctgaggcatgagaattgcttgaacacgggaggtggaggttgcggtgagccaagattataccgatgcactccagcctgggcgatagagcaagactttgtctcaaataataataataataacaataaaaataataatatcactatgaataaagacacttttacttattcctttccaatctgtatgtttttccactttcgcttattatactgggtagacagactctcctggtgaatagaaatgatacaattgaacacacttggccttgtccataaactttgggagacagggcattcattcttttaatatcaaatgtttttagatataggcttttcagggatttttaaaatcaggttgagaaactgaccttttcctaaattactgagtttttttatcaataatgaatttttctctgtctgcctcctttctgatcagactggatagagttttattagttatattgatctctcaaagaaacagcttttggtttttcttgattttatatttgtttttccttttcctattttatcagcgtgccatctgatctttattattttatctttctggcttatttggaggtatattgatctttttttctgttttctcaaggttaaacctgataatactgatttgaaatctttcttgtcttctaatgcatgtatttagtgctgaataattccctatatgtctacttcaactttatttcacaagttttgatatattgcatatacattgccattcattttaaaatgttttgtaatttcccttttgacttattatttatcccatgaaacatttagaagtatgcacttagcttccaattatatgtggattttccagagatagttctgtcatgaatttctaatttgattctaatgaggtcagagaacatactatgatttagatcaagtatattcctgatgcacttaaaaagaatgtgtattttgttgatgttagttaatgttttggtaattatcagttaggttacagtcaattggtaatgttaatcaagtcttctgtatctttttaacctacttgctctattagttattgagaaatagctgtttaaactctaataaaattaagaatttgtctatttcttttcacagttctgtcagtttattctccatgtattttaagctctcttattatatagataaaagtttagaatcatgatgtcctcctgatgaattgacgtctttctcattaggaattgattctgtttattccggataatatttgctccaatacctgagtgttagcaatatagctaccccagcattttttgcattaaggattacatggtgtatcttttttcctttcttttaattttaacatattttaattttgagggaacatagtaggcatatatatttatggggtacatgagattttctgatacaaggatgcaatgtgaaagaagcacattcacatgagaatggggtatctatctcctcaagtgtttttcctttgagttacaaacaatccagttacactctaagagattttaaaatgtgcaattgcattgttattgactatagtcaccctgttatggtatcaaatagtaagtcttattgattctttctatttttgtacccatttaccatccccacctcctcccccaaccccctactacaattcccagcccctgttaattatccttgtactctctgttccctgaattcaattgctttgatgtttagatcctacaaataagtgagagtatgcaatgtttgctcttctgtgcctggcttatttcacttaacgtaatgatctgcagttctatccatgtggttgcaaataagcatttacctatacttaaagtgggtttttgtaggatgtgtacagttgtggtttttttaatccattctgacagtctctacctttgaattagagtgccacacattgaatatattactgatgtaattgggtttaagcctattacatcttgctatgtattgtctgatatctgttcatagttttatttttcttctgtttcttcatttttgaatattttaatgaatcaattaatttcctattttgtcttgttaactataactcgttcttattttagtacgtggttttcagtcttttttcaaatgatgttgcactacttcacatataatgtaaaaaataccccctccagcctttgtgctaagtttatcagatatttttacattaatcataaaactcataatagttttctatttctgctccaacaaattacaacaaattttgtggctcaaaacagcagaaattaataattaggtcagaagtccacataggctctgctgggatctgctcagtatattataagatcacgatccaggggtcagcaagactatgatcttttctggaggctctgaggcagaatccttcctaatgtcattcaggtttttggcagaatccagcctctttcttctgttggactgaggtcctgttggcttgcttgaagtcacctgcaggagggtgcctttacctttgagcaattcccttctgaaccttgaatgggaatctctaaagctctgtagcagcagtatgttaaatccaacccatacttggaatatttctgacacatctctcttctgctgcatctcttctgccttcctcttcttcttacagctgaagagaaatctctgcttttaatatcagatgaaaaggggatcatgtgattggtctcgcctagataattcatgataatttcctcacttaatgtctgtaactttaaaaaacacctgcaaagtctttttaaatcatgatatttaatgtgttcatagatggccaggtgttagggcattgacatctttgggaagagacattattcttcccccaacaactgtgctatgcatacacacatacacacacacacacacgtacacacactatgtatagattcaaacttccaattagctcatattcataaattattacattaaaattaatgttaaagttattagaaaaaagtattttatatttatctacatagttactattcacaaggcttttcaatactttgtgtaaatccagatttctatctggtataagttcccagatgcttgaatgacttcctttagcatttcttgtagtgcacttctgttgttaatgattcagttcacctactgtatgtctgagaaaacctttttttacttttatatataaaatacatttttgctggatatagaattctaaatgaacagattttattttttcagtactataaacattatgaatcattatgtttgcctgagtttttttagatacaaactcctctgacattttgttcctctgtacataaagtatcccatccaaccagtcacccccagattcttagagatttttgctttatcgcttttcttaagcagtgtggatacattataccttggtgaagctttcttcatcatacttgtacccaggttttggtgatgaccttgattgatcatttttaacaaatttagaaaagttttagtcattagatgttcacatattgttctctgtcccacattcctttgggactccaatttcacatatataggctacttgaatgttccaactgatcttgatcttatctttcattttccggataattttcagaaaataatcttatctttcatttttgatcattttctttcctttttttcctttttgtattaatttttggatattctctcttattacatgttctagtttactaatcttttctttggcaatgtttaatccactgttcattctgctgaaggcttcatctcaggcactttagcttttaatatgtagacacatgatttttaaaatacctaccccagaactgaaaatgaaaataaaaataagttaaatttctgtgaagtcttcaacatgatcagtctttcatctagatttttggttgcatggaatgccatcataataactgatttaatgttattgtgtactatcatctgttattcctgggttagtttttggccaattatattttatcctcattatatcttatatttcctgcttcttttcataataattttagcatggatgctagatgttataaatgttacctctttatctgctgtttttttgttttgttgttcttttcaatattttagaccttttttttctagaaatacagatgaactacttggaaacagtttaatccttcagtctgtgcctttaagctttgttaagtttgatcagaatagctctggactttctttgccccacccatgagataagaatgtttctgaattctttatctgtcatgcattaggagttgattttattctggctcatgagagtatgaacttttgtttgctctgtttgagcttggaagttgttccttccaattcttttgcacagttctttccctggcctcagttactttcctctcatgggtgcactcatcagtactcatctggaggctccagggttaatcactgcaaatctcagggaatcctcactttgccattaagtcctgtctggcactgtggcctgtgaactatagccaatatccacttctctgtactattagcactacctccgcactcagagagacctctaaactccaactgagatcctcattcctgtgctgcaatctagaaactctctctagacagtaagctgagacacagcaggactcacctcatttccccccatattttaggaatttctattgaatgatttcattgactgattcacaaagtcttgaaaaacagttgttttatacaatgtttctgacatttttagctgtttcaggtgctaagataaattgggtatacgtttctgcatcttggttggaaactgatatttttagatatatgtttcagtacagcaaacaaaatttcagtgttctaaggttttgaaaaatgtatcctagtaataggaagacctgacttctaaatattttaatctctcattctgtactaaactcaaagcaatttcagatagctatgtctgaatttcactttcttcctactttatccatacatcttgttctataataaattatttttattaattaattactttaattctccctcaggtttgccagtgaatttttaacagcagggtatcacaatggttttttcaaaatatgtagcactatgaactgaaacatggcccacattttaggtgtctcaggaacatgaagaatatacaaccagtgcaatctgaagttcataacaaagacaaacagtaggaagtgaaggaatcttcagaatactttgggtagatcagagcaatgatttaaagaaagagaagagtctgatgaactgaagtagaaacaggcattccttgaagaagagtcatgattccctcaaataggcagaattaaaaatgtttttctgctttagatcaggaactgacttctccaggaggatgggctgtttcagagtatcagcttattgaatctgattgtaactgttacaaaacacaatgacaattttttaactatcaatatgatttttaatatttgcatgtttgttttcaagttaacatacagtaaaattcacttttttaattgtagaattctatgaattttaacgtatacatagattcatcttggctctactacagtcagtatacagaattgttctttcaccccaaatcactctctaatccctttatagtcacttcctctttcaacctctaaactctgacaaccaccacttctttccctgccattataattttatcttttccagagtgccatattagcacagctttagaacagctttatagtaagtcccacagttgagacctacttctcaggaaatatttctttcaaaatatcacagtgcactggcaatgcacttaaaatcaggtagtatcatttatccaactgttcttttacaaaaggttctagaaattataatttatttgccttccattgaaagtttcacaacaatttgtctacacaaacatatcaagctgggattttaatcacaattgtaaaggagctttatattagttttaaaagaattttactttttttctatcttgagtctacaaatatattaacatggtatatatttttgttgttgttgttggcctagtgtttgggacatcaatatgcttttgttaaatgaatgaacgaataacaaaaatgactttatgcaaaagatggttacaaatatggggcatttttttttttttttttttttttgagacggagtctcactctgtggcccaggctggagtgcaatgatgcaatctccgctcactgcaagctctgcctgctgggttcacgccattctccttcctcagcctcctgagtcgctgggactacaggcacccgccaccacgcccagctaatttttttgtatttttagtggagacggggtttcaccgtgttagccaggagggtctcgatctcctgacctcgtgatccacccacctcagcctcccaaagttctgggattacaggcgtgatccactgcgcccggcccatggtatgacttcttatttactaaagtcttcttttgtttccgttatcagatccttgtagttttcaacattcagatatcatacataaattttgcttgattggtacctaagtgtgatagttttggagctgttgtacatttttttaaaaaaaattttggtttccaaatgtttattgctaatatgcatatgagatttgatttggggtgtttttctttaatcctttgactgtgttacactcaacaattagttctagcaatatttttgaaggttccttgagtttatattgtatataacaatctatttctaatttctgcaaattggaaaagatttctttcttttctgactgtacgtcttaaatctatttttacttgagtgctgtgttgttctttcagcatgaggtttaataggagagctgacagcgaatttccttacttgctcccagtcttacagataaagtattcacttctttacctatatatcaatgttaggtctaaattttttggcaggtgtttttcatcatgataaggaagtcttcctttattcatagtttgctcagagattttatcatgagtggatgaggaattttgttgtttttttgttttagcatcaactcatgttattacatgattttttctttaaactgttaagttggataaattaattgagtattgattaatatgcttaatatagttaatataatttaataatactcaatatacttaatataatttaattatcttcaattaatttatccacctaacagtttaaagaacaattatttaataatattaggttcagaggtttctgaagctctattcattaatgtcatataattaaattatattaatactcaattaatctatccaacctaacactttaaagaaactgtttgctgataacagtattgtgtcagccttatattcacaggaaaaagaaaaaaaaacttaatgttgatatatttcctatttacagctagattttttttctaattttttaataaaagcacctattttccatgaaatattggtatgtaggtttattttcttgtaccatatatgacatgttaaattatcagcataatgctgtgttcataaaaatgggttgaaaaacattccctcctcttatattttctgaaagagattttacagaaatgctattgtttcttctttaaatattttttaaattcaacagataaactgagtctgaacatttcctttcaggagacttttgatttatctttaaataaatgtattttttatatttctttaataattataggattgtttttgttatatattttattttgagtaactttgtggtttctgattttcaaggatgtggttcgtattttcaacattgataagtttgtgtgcataatgttatctggattttttaaaatatttttattagctgtacaatctgtgctgatatctcttctttcaatcctgatattggcaatatgtgtcatctctccttttttcatcctgagtcttgctggaggtttaatcattgtattcttattccaaataaacttcatttaaaaaaattttctctattttgttctgttttcaatttcattattatccttttattttatattgttttcttcctcctgcttaatttttgcttattttgctcttgtttatctagtttattaggctatcccaaagagtaattgtgaatttgttccaattttttttgtctgtcagattttgctttatatattttgaagcactttttcaagttgaatgcacatgtaggattgtcatattttcctgcttaattggcctttttatcattatgtaatattctattttacatcttttaatttcatttgttctgaaacctacattttctgatattgacatagccactgcagctttcttttgattagcatttgaatggcatattttttctattgtttttattttattctagttttatcattacatttcaagtgatttcttatagacagcatatagttaggttatattttattcattatgccagtttctgtgtttttattcatgaaattaagccatttacacttcattcagatttacacatcattcatttaaaatgttattttagtctgttctttttgtctttcattcttctattttccctgctctaaattcttgattattgaacattatttagaattgtattttactgtatctataatgtttctggctatatctgttttcacaatttgtggggagggggtgttgccgttgtaattcaatgtccctatttaagttagaatcaatgtttaccatttcaatttgaatgtagaaagtatagcatcatataggtccctacatcttctctttatatcatacttttcctgtgtattatacctccattcattgaaaattccatcagagaatttgttttattctttcaaccattaaattactttaaataacttaaaaagtgaatagtgtgacatatttctcagatatttaccgtttgtaactcacgttttatttctggagtttgatgtttcctttgatttaatttcttttctcttttagaaggcgccttgagcaattcttttgtatcaggtctgctggtagaaattgtaatagttttcctttaccttcatgtctgaaggggattttgctgaacatagaccttgctttgacaggtgtgttctttcagaactttataaattttgtttcatttccttttggccttaatgatttctggtcaaaaaattcagtcatgtgaatcattcttctcctataactattgcatattttggtgtttgtatatttttggtttttagaagtttgattatgatgtgcctcaacatgaactgttttgggtttttcttgggttcgatgctgttggcctatttgagaagttttcagatgtcagatgcattgatacatatacatatgtacacgtatatacctacattattttgtcctggtcgtctttctcttttccttcttggatttcatgacattttggtagtgtctaagaagttcctgaagtctattcactttttcctttaatatgtttccttttgttttcaaaattggataacttccatttgtaattctttatgtttgataactctctctgtcaatcaattcagcacatccatgaattttgttgttgttgttgttgttaacataagtagaatgctaatatttatttggggttttaaaaatatatcgtatgtctttggagagactttctatatttccatttatttcacctaattatttagaacatgttttaaacagttgctttaaaatagcttttagataatccaacatgtgtcagcatgccattggcatttccaatgacatgattttcctagttcttaacaggtaaaacaatagattatctttaggactttgaatattacataatcagactctggatcttatttcagtattacggaaaatgctcactttttttgttgtttttgtaggcaatcagtttgtttagatcagacaacaaattctgaccatctttcttggttttatattcagacgccattttcattacctttcagtgactgtcagatctgtcctgcatgtgtaccaatggccattccaggacccatatggaggtttaccttttagttaaattcacaaaatcttagcaatgtttagaatccgattcaataagcacaggtcaggacagagctcaagatttcctaaagaacttgctgtggatgccttcctaagaccttcctactctatgatctctgacatactttcctatttcttaggtcaccactttttagtcccctggccagaaagctgcgatcttatttatctctctctgccccaactatggccttattctggttcaactgatgagattaatgaggaggataaaagcaatgggagattttgctcttaggactacagtttatctgattgaagaagaatgtcatctctcagagaattgggtgtttgcagctttcctctgttgacattgtcactgccagatttccttcctgcttcctgagtctgaactggaaggcttctctttcttggacatttctagagcagtgttgatgacaacttctgggttttgtgatgccttcaatccaggccatggaattctgaaaagaaaattgttatctcacagtttgtctggtgatattttaaattctgttatatttcttaatagcaatatgtctgctgcgatttacttttaagagtcttcaaatagatgacatacatattctatccaaatatattggtcatattaagtggggagataggacactgcaagatgtctcgaattaatccagaactggaattctgtgattacttttaaacttgttgacatatatatgatcagagccttatttaaacaataaggaattaatatatatattaacaaagtgattttcagatgcttacttttttattgatatttaattgatcacttcagtgtgactttgaacatttagcccacactttaggattcttactgccttttgaaagctgtgtatttaaagccatacttttcttagttaatgggataaaaagtaaaagatttataggggagaaaaatgaaagtagttccaattatttctttctggcagtttatcaaaggtggaaataatgctgttcttacaaaatttgttattttatttacttttttattattatactttaagttctagggtacatgtgcacaacgtgtaggtttgttacatatgtttacatgtgccatgttggtgtgctgcacccattaacttactttaaaaacatgcaataataacttgccaaaattgaaacaccagatcatatatttattttttgtattattaagatgttacagtaaaatgaccagttttaaaaaccaagatgaccctttctccaacatctccatcatcttccaattttatcttttattcttttttttttttttttttttgagacagagtctcactctgttgcccatgttggagtgcaatggtgtgatctcggctcactacaaccctacaacctctgcctcccaggttcaagtgattctcctgcctcagcctcccaagttgctggcattacaggtgcctaccaccacgctcagctaatttttgtacttttagtagagacagggtttcaccttcttggccaggctggtctcaaactcctgacctcaggcgatctgcctgcctcagcctcccaaagtgctgggattacaggcgttagccaccgcgcccggccatatttattcttgatatataaataaaacaaatatagcccctgtatattggtccttggaccattagcacataaaccccccggtgccaaattcaaaaatttacacatccgactgttttaaattaccctgcataagcctattttaaacatttacaatcagcctgctttggaaactgcaaaactgcacctaacttctgctagccatacacaaactccaagggcaatacaagacaccaagcccacagctgcccttctaccttctgagagagtctgagagacgctgctgtactgctgagtgacatcacgtggacacattatccccctctcagattcttcactcttccaggagtttccttccccttctcccactctctgagtggtgactggacatggtgtctttaaacagcctcctgctatcaggaacttccaatgtcaagcaacttgtatgagtagcacctaagtcaaactcattatgtgttaatgcctcctatcatcataagtttttccttgatgagtcctgaaatcttcacacttacttatactttccaacagattattttctgcagaattttgcaaaaatgagtactaccaactctaaaaatacgttctgaaatcttacacctttagattacttttaaatatacatcatgacttttattatacattatttttcttataagttttatatgattcttaaaattaattaattattttttttgagatagagtcttgctctgttgaccaggcagtgacacaatcacaggtcactacaacctcgacttcccaggctcaagctatcctcccatctcagcctcttaaatagctgggagtacaggcacacaccatcctatcctgctaattttttctatttttttgtagcgacaggctctcattatgtttctcaggctcatctcaatctcctgggctcaggtgattctcctgcctcagcctcccagatcgctgggattacaggtgcgagccaccaggccttgacttctttttaaacttgaattaccaacttgtattctagtccattttgtaccccaggtggtcccaaaacttttctttaatgtataggttgacataaaacaggtgaattctcagatcagtttctgcaatcagtctttcctgatatattttagaacctgagaaagacttttggataaggagataattgaactttttctccattagcacaatccaatagctgactttctcaaaagaaaatccatctgcacacagatacatggttggaaaaggggtgacccaagagagtttctgaaaggtgtttgggacctcaaggtttcttgaaatactctgagggcctttcatgtagaatattgttaactgtagaatatacgctgaaagaatataaaaattgccatgtttagtggtgaaattaactttcaagaattaaaggaacattcaagcttgaatttatttatttatatatttattgacttgagagatcttccatattaactatggccttttatttaattattatctcatactgtggaaagacttcttttgacaaaaataaagtcacagtaatgttttacctcctttcaactgtaacttttcacttagattttatttaataagccctttagattggtggtaaaatgtcgtagacatctagtgatggattagctttagtaaattgtattaaaaaatctattaacatttttatttttatgttttttaatttgttcatttatacttctctgattataaaaataatccaatgttagtatagaaaattgtataatgtctactgaggacatttcaaaagagctgattatattcttaaatcaacatattaaatattcatttaccactttacctatgaatttcaattatggttaattaaatatagaatttattatgtaaacaaatgctgtaatagatatgtatctggtcatatttggccaggtgacttatacttgcccaatagtgtatccacagggtttggaatactgatcagtttgagtaagagtgaagacttatttatatattgacataaatatgtctcttacatgtaatgtcagcttgataaaagaaacagaatacagaagcaggcgtatttttaaaagaaagaaaaaatattgaaatattaatcaatatttgcataaataaatgcatatgctggccaggctctgtgagacactcctgaggcaggagtactgcttgagcccaagagttggagactgcagtgagaggctatgatcacaccactgcatgtcagcttgggtgacagagggagaccctgtatcaaaaagaaaaacaaacaaaaaaaaatgcaagcacagtcagctcttcatattcgtggtcttacactggtgttttcaaccaatttggatggaaaatattttttaaaatagcaataaaattaacaatacaaaaatgaaaacatacaaataaagaacaatatagtataacaactatctgagggagttcctagaatcaatcctctgtgaatacgagttaacaactgtaattaataaaaataactaaccaaggccagtgcagtggctcacgcctgtaatcccagcactttgggaggccaacacaggtggatcacgaggtcaagagtttgagaccagcctggccaacatggtgaaaccccatctctactaaaaacacaaaaattagctgggcatgatggcgcgtgcctgtagtcccagctgctcaggaggctgaggcaggagaatcacttgaacccaggaggcagaggttgcagtgagctgagatcataccactgcactccagcctgtccgacagagtgagactccataagaacaaaaaataaacaataataactaaccaggaaaatgaaaaggtcaataattttagttgcctcttattttttttttatttttgatcttgtacatatgatctacgcaaaaagccaatttaaaagaaacataataatcaggttcctttggcaaataattagaaaatggagaaaagcgtaattatgaaaatgcaacaaagcatcagttaacaatttttcattgtttttgtacttgctgtctaaggaaggaaatacttatttgattaaactgctgattcctcttatattaactttcactaagaatgtaatcgtaaatgccaatggaacctttttttgatttttcttaaaccaacttaatgagccaaatttgatcctcacgcttctacagtctgatggtactatataaagcctttactgtgttgttcagataggtttgattttagaagtcagtactcagtaccttatggcagttaggtcacggctttactatattcacaaattaggaacaaccatgtggaaaatgcccaaaatttgctattcgtcaaatatgcatagaaatgctctattgattagattttgtaacaagacggatataccaaatcagttgacactgaagattgaagaccactcagctacatttgtttaaaaagaattgtatgtacgtatttagtttatagtaatcaggaagatagactttttttttccaaacgaaattataaaattattgttccttatgcccatcattttatactttgcatttttaaattttgtatgcattttgagttccagaaaagtattctcattaaatagcactttaaattgatcaccctcataaattcagaatggaggactatgacaattaaccagaagcaatattaatgaaaattgagagctgttagatcatattacagcatttgcagcagtagggaagagcagaacatacaaatttttaaaaaaagaaaacagatggatttcattgatgcctgatatgactatatgaaagtaacaatttcatgatcaaaatcatgatgaatgcattctccataattgagatgtcttattgtatattgagaggctatataatattaaaatactagtcattctttacctcatataagcaattaagtatttgaaaaattgtcaaagatgtaaattgaaaaatgagggtacttcatttgttatcaaaggaaggttcttaaaattaactgaaaacatgtaatttcttactatccatgagtaataaaaatagctttgcaaatgtggcttcccaggtgtttcacttttctaacttcatataataaaatgcaatggaaagagatgtgttaatgaaattatgggaagacccaaagaaataaactaatttgcttttcatgcagactgagaatataaatagagaatgttagaactatcaaataactttggtgttaatctgctctatctattctcttggccaggaaccaagatcacttctgtgactttctaatggacacacagccctaaatgtaaaatcatttttctgatgattagtgataacgagcattttttcatatgtttgctggttgcttttatgttttcttttgagaaatgtctgttcatgtcattttcccatttttaattggattattatttttttcttgttgacttgtttaagttccttatagattccggatattcaacctttatcagaggcatagattgcaaacattttctcccattctgtaggctgtctgttcattctgttgataattggttttgctgtgcaaaagctgtttagtttaattaggtcccactcgtcaatttttgtatttattgcaattgcttttgaggacttagccataaattctttgccaaagccagtgtcgagaagtgtatgtcctaagttttttttatatatacttttttatagtttgaggcgttacatttaaccctttaatccatcttaagttaatctttgtgtatgatgaaagatagtggtccagttgaattcttttgcatatggctcgccatttatcccagcaccacttaccgaataaggagtcaacattttgttaactttgtcaaagttcagatggatataggtgtgcagctttcatcctcagagaaatgtaaatcaaaaccacaatgagataccatctcacaccagtcagaatgaatattatttaaaaagtcaaaaaataacaggtgccgtcaagacttcagagaaaaaggaatgcttatacactgttgatgagaatgtaaatagttcaaccatcgtggaaagtaattttgagattttgcaaagaacttaagcagaactgccatttgagccagcaaacccattactgggtaaataccaaaaggaaaataaattgtaacagacacatgcactcgtacgattatcacagtgctattcacaatagcaaggacatggagtcaaccttggtacccatcaacggtggactggataaataaaatgcagtacctatacaccatggactactacactgcaaaaaacaaacaaacaaacatgaaatcatgtcctttgctgcaacatggatgcaactgtaggccgtaatcctaagcaaattcacacaggaacaggaacagaaaaccaaatactgcatatcctcacattgaatgcccatggacataaagatggcagcaacagacactgaggactactagagaagggaaagagggaggtgggatggtctgaaaaactacctattgggtatcatgctaactatctggatgacagaaccacctttaccccaaacctcagaatcatgcaatatacccagttaacaaacctgtccatatgtcccctgaatccaaaaaaagaaaacgtaaaaagaagtaaagagaaaaaaagggttgtgagtcttaagattagcagtcctctgctaggtgaaaaatctatgtgtgcatttatttgttgctttatatttaaaacagaattggaattgaattacaaatgagtatacttcctggctgtgcttgagtggagttagttttccttggctcaaataaatttgaaggaattagtgggtgccggttaatctgaaccaaacaagctgtgacatgaataggcatttcatggttggtatcatctttatcttctgagaaatatctgagggttgaggaaagacttggaagactcagaaaacatatgaaattgctgcatgccattattcataaaaggtaaatcagtctgtcaaattagtggtatatctgttgcctaagcaaccggtcaggagaattataacttgaaggtagtccaccacgtccatgttagtgggagttaatagaactacttcactatacatccccatgttccttccagctaaagaaaaaatagaaactttccaggaaacgttgactactcaacacatacagaatacaaatccatgaaagaattcatttcattgtaattctctaaggaatgaaaaacctttactgtaataaaaagagtaatactgctcttgcaactaatgtataaataatgataggtaaaacatgcattttgtttaaaatgttatttcccataattacagaggaagaaaaacagggtacagatagtcaaatgacaatgtacttaaaattcagagttaatatctgaaaaagttctatcttttgtaatactagtaattattatgttactttagagacaacatgtcagattatgtttcttgtatctaaattcataaaggcagaaacttgatttattgtgtttaattactaagttacataccagttcttatctctaccatcaatggaggtaatgtggcatcaacgctgacctgaatgctattatagagatatttgagtataatcacacttgtaaatgcctgtctggtattgtttagtatatgtaaaaaatattaatatacttaattttaggaatattactttatgatattcagcttaaaattataaaagtgtgcattgagtcacaatttatcctctactttgaaatttagcttctattgtggatgctagtgatttgtttattgcaaacagtgcatttcagtaacagtttcaacatgttccaaatgtgcagcatatacagtttttgcaatgtaattagttagaaattggagatgcttaattttaaaattgaacagttcatgaaaatctatttccattctctgtatggcttatgcagtttctcttcataaaatgttctatagctgcttgaagaaattaagtgtagttaatcagaaagaacattatgttttgacacctaatttgaaagccctgttttgaagcagtgatatattgcttatggcattacacagaccaatgagaagccaaataggaaatccacttatgctcaaagtagatctccatattgatgtaagttagggtggtattgtctttttctgagacataattcctaaaagtatatatgtttgctaaaatatgtactttattgtttaacagatttagtagtgaaatagctttacaatgaattgatataattattgcacattagaacacagatcattgatggacatttggacatatgtaacaaacctgtacgttgtgcacatgtaccctagaacttaaagtataataaaaataaaataaaaaagaacgcagatcagtgataaagttattttactgtgaaaccaaatcagtttcattaatataaatggagatgtgaaggatgacatttgaaagcttaaaatgtagcaaaaattctctaaatgatggtagtgaaggtgttttcgtctctatttattctgtattcatctctccttcagtgccgccagcaatctcaatgcctcagaaatcttttaatgccacagcagagagaggagaagaaatgacattttcctgcagggcctcaggctctccagaacccgccatctcctggttcaggtaggttatgcacccccctccctctggcttgtgtccattatcaggcttatggaacagtattgggatcttaatcattttggtaaaaagcaaaccattgcattttagtttcattaaaaaaaaatcctggtgctatctttggggcttacggtggttagattaaactgctaaagagatcaacagtgtgaccccgctctaatattctgagtcaaaggctgtacccattatacttattctgtctgtaaaagcagacttttggaaaaatgggaccaggagcacctgtgacttattcaaacattttattatcattacaatttatcttgaaattgatattctagtgttattgacaccactgtcatatgtatacaatatcatattttattagaatataattgtgtatatttgtattatacacaaaatgttgtattatagaaaaaactgatttatagcattaaaattcaatgaatttaatgtgtaatttttaaaaattacctcatcaaatgaggaaattctgtattctaaatctataatttgatagtttatttttttagaattttaaaatactatttgatttttattaagttcaagaatatttttaaaatattccattcttttagattgtgtctcaaactacgaaattggagacgatgaactttaaaactggaccatcttgtagatatgcattagtaatgcaggttgctacagaagcattagctacaagtatttacagaatcatttcataaaccatatagtgaaaaattatttaaaaagattagtaaaatatacatcagaagtgcaaaagtgtccctactaagtattaggttgttgttttaaaagttctttgaaggacaacaattgaaatcccaaactaacttttattcttttttgcttgagcatgtactgatattaccttcaactttcaaccatttgtttctactgcttatcattttaatataggatgtaacaataaatgagatgtttcttcaaatattgtgtgtttagatgttcttttcagacactaattttcttgggacaaactgttggtattttttagtaggattacaccttgaatattaacatacccaccccagataatcatcgtctgtctcagtgactgctgatttactaatgtggatccttaaaagtccatatcagacctaattgtatcacagaaaagctactgaatcattcattccaatgaaaaaatactgttctacaatcttttttcctatggttttgtatttccacagagatttcttttttcttatttgaacagcatttatttaacagataaagaaagtaaagcacaaaaataatatgagcaggaaattgagcaacaaacatgagcttgagatactcatgttccactttgtatgtagtgggaaaaacatcttaaacttcaagcttatgccgatcttagctaatgtaattgatgattccacaaaccaatagtgggaatagtagctggtaggaaagtacaggtgaataagccttgttttgaaataattttccagtcatttattaaggaatgctataaaatgtaaactgttctgtgtaaaggggctagaagtcttcctgcattcaagaggaagaaaggaacatgtatctttatcctgtgaattcatcctgacgtgcacttcatcatttctgaggcagaaatacatggaaactgggtgtgtgattgttacagtgttagaacatatgtccttgaaaaatatgacaccaggtttaagaagaaaatctcctttacttctgagattacttgatcacaatgattccaagtttgatagtaatttcagattccccacctatttatgttgatgttaagttatgcagattcctcattagtcccatctttaggataatattagaacacttaccatcaagtcagaatagtaattgtgagactagatgcttttagtttggtcagtttagttgtctgcagcacaaccctttcaaataacagcttaccaattacttctcaccagaataccaagatcctccagcagctgggaagtgttagctggcttggtttttcagagagacttcttttctgcagagatttttttttcttaaagttttacattccttcaaaactgttttcttatatttaattagaaatagtattatatagactagtataaatcagattcaaagaataatataatgagtaatttaaatttatattttttcttctccatatcttcatatggtattagtttcatcctttggatagaatgaaataacaatttattgaaaacctaaataattgttctagtctctggatataaaatatatactgggaggatgagaatgtgtggttgtaacattaacgaaggtaaaatttgtgttagagggaaattctgaccttgtatctgtacatatagacatgtcatgtttgtggaaaagaaaaaattcctgaaagtatcaggaaatgtagggtagcatcccgagagaaatgtccagactgtttcatagagataatatttccaagcgagataagtgaagtcagttgtactagtcagcttgggctgccaaaaccaaataccacccactgggtagttcacacaataggaattccttgatctcttgacttcgtgaaccgcctgcctttgcctcccaaagtgctgggattacaggcgcaagcaaccaccaacatggtgaaatcccatgcatggtggtacgcgcctgtagtcccagctactctggaggctgaagcaggagaatagcttgaacccgggagacggaggttgcagtgagctgagttcgcgccactacactccagccaggcaacagagcaagactctgtctcaaaaaaaaaaaaaaaaaaaaaaaatttcttttcccatatttctggacactagatgtttaagatcaagataccagcagggtggccttccctctgtgtacaaactcatggagagagagagttctggttatcttcctcctctttcagaaacagcaatccttttttgtttgtttttaataatttcaacttttatcttagattcgcaggtttgttacatgagtataatttatagaaaccgaaagtagataattggttgcctgggactggatatgagaacagagattaactgtgaatgggtataagagatctcttgtgatggttgaaccactcaatacagttactaaaacttcagccaaccaaacaaaaaccaccagttttatgggattaaggcctcactcttatactctcatttaaacttagtgtcctccatggaggccttattttcaaatacagtcattctgggggttaggacaccaacatgtgaatttgagggttgggaaaacccaatttagttcataacatcaataagataattaaagaccataataggggaattataaaacatgttcacaaagagaatcaaaagcacttagtgacatgtaaatccaagagggagtaaaagcagtgactctaaaggttccccccttcattttcgttcaaacggtacttctatattgagaatacaatatggatttttattgttagcccattaatttcataaatttaatttattttaaaatgttccatttaaaccccacttaatcatgatacacaggcatgcccagcataatgacctatcaatgacacgcctcatatgtgatggtggttccataagattataatggagctgaaaatgtcctattgtctattgacatcgcagccatcataaaatcatagctcaacatattactcatgagttggtagttacactagtgtaaacaaaccaatatataaaagcatatacatattttatacactacataatacttgataaatatgttactggtttatatatttactataccgtacttttaatcattattttagagtgtactccttctacttataaaagagagaagttaactgtaaaacagcctcaggcagtttctttagataatattccagaagaaaggattgttatcctaggagatgccagctccatgcctgttattgcccccaaaagaccttgtagtgggatgagatgtggaggtggaagacattgatattgatgatcctgaccctgagtcggccgaggctaatgggggtatcttcctttaaaaaaaaaaaaaattagtgataaaaacttaaacaagaaaaaatatatatccttataaaataaacaataaagaaaatattttgtacagctatacaatgtgtttgtactttgagctgttattaaaaaagagtcaaaagtttaaaatttttaagagtatataaagtaaaaaaagctaaggtgaatttattattgaagaaagaaaatgtttagtgtcgcttaagtatacagtgtttataaagtctagagtactatacagtaatgtcccaggccttcacagtcactcaccacttactcactgagtcacccagaagaacttctagtcctggaagctccatttacaacatatatatatgccctatatatgtatagcattaattttttttttttttttttgagatggagtctcactctgtcacccaggctggagtgcagtggtgcaatctcggctcactgcaacttctgcctcctgggttcaactgattctcctgcctcagcctcctgagtagctgggactacaggcatgtgccaccatgcccggctaatttttgtatttttagtagagacgggtttcaccatgttggtgaggctggtctcacactccatgtgattatcccgcgtccgcctcccaaagtgctaagattacaggtgtgagccaccacgcctagcaaaaaacacttttataccatattttttactgtaccttttctatgttttgatatgtttagatatgcagatatttactattatgttacagtcgcttccaacattcagtatagtaacataccgtacaagtttgcagcctaggagaaataggccataccatatagtttaggtgtgtaataggctatataccatcttggtttgtgttaagtacactctatgatgtaaacagagctacaaaattgactggggacatattttgtagaacatacccctgtggttaggcaatgcatgactgcattatcctttttatgcatggctggaatcaatgtgtcaataatttgttaagaattttttatattcatggttatgagaaatattgttccatcattttcttgttcttgactttttaggggtcagggcattactagtgtcagagaatgagtagtgaagtatttcttcctcttctgttttccaatataacttttatgtaatgtttattatttcttaaatttctggaaaaattgccagtgaaaccatccatgtcataatttttcttaagttcacatttaagtacaaattcaataatatttttcatagaaatagggctattcaggtaattttctttagtgagcttagatgattaacgcaattccaggaatttgtccatttcttttaaatggtatttactggcattgtcattcatagtatccctttgttatacttcaatttgcatgttttctgtagtattctcccctctctcatcttgataacctcataactggttatttgttctactgtcttttttatcctgattattctagatgtaggtctatgcacatactaatgtcagtgaatctgcttttggcttcacttatttcttttttgtttcctattctccatttcattaatttctggttttatttttattattattttcctcctgtttactttgtctttaattttcttttccatttttgattgcttaaggtggactcatgtcattgattctaatcatttattctaatacaagcatctgtttttcctctctaaatatggctgtaattgcaccctgctaattttgatatgtcatatttccaatttggaggggtttaaattttgtttttaattctcatgttatttttaatactattcatttagaagtatgctgatttgtttctaagtatttgggtatatttcataaatattactgctgttgatttttaactaaattctatacttatcaggaaatagactttttaatggtttcaatttatttaactttattgagtcttaaattaaagtatgtgtattccactattattgtatggagaaatccctaatattaaatagatcaactcccttgatagtattgtggaagtcttctatatttttttgtaacgattcttctccaactttatttttaaatgtgtctatttttatattcagttctctctgttttgcttcatattttttgaagctctagtattatatgtttaaacatttattcacgtagatcagtactatgaaaattattatttaagggctttaaggatggaaaaaaatgataccatatagaactttgtttcagtctttttctgtttttcattttaccatgtcttcaagtgaactaagttacgtcactatgtcttcaagtttactaatattttctactgtaatatctaatgtttttaatcccatcagagtatttctcataattttatttttcttctctgagagtttcaaggagatgttttgtatgtcctccatgcctctcttaccattctcatgttttacttccttgaaaatattggaatatatttctaatagttgttttaataggcatctactcacctaccctctgtatcatacctatattttgtaactgactgatttttctccctcttgttttatttattttttggagacagattctcgctctgccacctgggcaggagtgcagtggcactcactgcaacctccaactctcgggctcaagtgatcttcctgattcagcatccccagtagctgggactatagacatgcgccacaatgcccaattaactttttaattactatttagagaagtggtttcagtgtgttgccagggttgaacttcaaatcctggcttcaagaaatcctcctgccttggcctcccaaagtgctggggatacaggagtgagacactgtgcctggtgatttttctccttcctctgggttgtattttcatgtttatttactatcctggttagtatatatactctatactctctctctctatatatatatatatatactctatatacatatatatatatactctatatacatatatatatagagagagagagagagagacgagagtgagagagagaatctccctccgtcgccaggctggagagtgcagtggtgcgatcttggcccactgcaacctctacctccctggttcaggcaattctcctgcctcagccttcgagtacctgggaacacaggcacgtgccaccacatggttagtttttgtatttttagtagagatggggttttggtatgttggccaggctggtcttgaactcctgacctctggtgatccatctgccttggcatcccaaagtgctgggattgcaggtgtgagccaccacacctggccgtatcctgggaatttttatttatttatttattttgagacaaagtctagccctgtcgtccaggctggagtgctgtggtgtgatcttggctcactgcaacctccacctcccagattcaagtgattctcttgcttcaacctcccaagtagctgcgactacaggcgcccaccaccacgcccagctaattattttgtactttttgtagaaaccgggtttcaccatattggccaggctgatctgtaactcctgaccttgtgatctgccctgcccgcctcggcctcccaaagtgataggattacaggtgtgagccaccatgcccagccaggaatttttaattgggttccagacattcagaattttgtgttttggggtgctgaatatttttgtattattttactttgttttatagatgcagttaagtgacttggaaaaagttttatttgagggagagcttccatttaggctcttttaggtggatccaaaccaccttcagtctagggttaatctggttccattactgatgcaatattattctaaggacatgacttaagtcctgtgttttaggatatctttttactctggatggttgaattgcagattattcctggtgctgtgtgagcttctggaattattgtactttatattttctaatggttctttccctcatctgagaaggccttactggtgtacactcattgatcaatactcagttaaagatttgttgggaaccctctgcagatatctatagctctgttgtctgtgcagctgtcttctctcacattatctaacctgcaccttctgtcgctttgacctcccccaactgcacactctgtcttccaacccagatacattgcctgactctgttcgtgttctctgcctcccccagctgcagcctgaaaactctcttcaggcagtcagcgatggaggtactcatatgccactgtcatatgcaaccagttggctaatgtgtgaaaactattgttttatatgtatagccagtgtttttgttgtttaaattgggagcatatagtttatgttaatacaatattgttcaaaatgaaattatcattcaattctttagtgtttacattaattctgtaatcctgacccctacattcttgtacctgaaaaaggggacgcttagagaagtggtttgagtttcaaagaatgggcttaatgcatgtgtcagaatgccttggagtgattttttagacgttgacatttcatagacatggattgtgaatagcaataggagcatttctacctgactttattgggagggagtaataaggtatttattgggagggagtaataaagcattggtaatattcccttatttatgatggcttaattatatttcctattgagcatttaaagtgaatgtaatctgtacacacttatgttctctaaatatgttcaagttttgcccctctacttcaaaggccaaatcaaggatttttattttctcatgaaaattcccagagtagtacagccatcttccttgtcatatctcccgttataacagatcacctcctgctcaaaaaagttgtaagtccactaatggaatctgcattaacctctattaatgccaaccaaattatgggttcctcatgatgggtggcaactaatttgctatacatcaaacatttagcacaatgttttatatgaagtaaggagataaccctcttttttagaaagaacattggaacttaattaacctgctgcttttattaatgggtgagcctgtctttttatttgtgaattgaggagtagagatatacacatactgtagttctctgattttgaatgagtaagcagagggaaaatgcacatttatgggctaattgtgagtgctgaaacctctaccgtgctattattattattattaggaaacaaatgaataattttcattgaagatattgagaaatatattgtatccctaattatgatgaaaaccctatctacatattaaattctagataaaaactctgaaatgtcatttttatacctgttgtaaagattgcattagtaataatatcaaaaatatatataaaagatactatatatgcatttattattattttttttttcggacacagtctcactctgtggccgaggctggagtgtagtggtgtgatctcagctccctgcaacctgcctcagcatcccttcggagtagctgggattacaggcgcctgctaccacgccaggctagtctttgtatttttagtagagatggagtttcactatgttggccaggctggtctcaaactcctaacctcaagtgatccaccggcctctgcctcccaaggtgctgggattacaggcatgacccaccacacccgacccatttgttattattttatgaatcctaattttgcaatcttccactcctcttaagaaatgttgtgtacttcatggtacatttagagatgtcatgagaaactggaacaataaattctattgagtatagacatataaagattatgttcatatatgtgttagtggtttctggaaagtagaaccagaattcactggaaggaactgcttagtgtatcagagaaatgtttgattttattttagaaaatagttttaataatatttatagagatttttttaaatttacaattgtatggacaagcaaatgtctccataccaatggacaaattccagaactttccattagtggttttaaaatcaattcagtcatgcaaaatactattataagaaaaatacaggaggggatgcaaagaagagaaaagaggaaaaaagatgaataaaatgaaaggagaatacacaatataaaacgatttcacaaataccgagggaaatcatagaaatagttcagattttaatatattgaaaatatttcttactgtagattatagtaaaaaatgtttgaaagccgtggttggttttaaaggacaacttagactagaatggagcagagtgagatgtatttcagtagagaaaaaaaaccttaaaaatattgataattatttgggactaagaggaaacagaaaaacaatttattttcctcattaaagaataaaattatcacattcaaaatagtttctaaattaattgtgttttcatgtaattctctcatcttactattttattggcagtacttatatgcaatatacatttatgatatatttacattgtatttactttgaagcttctgtgaagaaattttctacataaattattttaaatgtgtcccaagaggggagtaaataaatatatataataaatatgtattgtctcaccaacatttaattgtgtatgggattaaaaacagcaaacaaaatgttttttttgccaataatcaaagtacaaattgaactgatatactttttgcctggtaactattaagattttgacatagttcaaatgttattcttgtgtttacattcaaaaaaaatttcaagtataattttattgtttattcgttaagttctgaggctactaaaaatatacttttgattggaatatagccctgtctttcaatgatgatagccatatagtcatcaatgcctatagattaaaaagttgattaaaatctactaaattataaagccagatctgtgaggatgaacctcttttttcttctttaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttggtaagtattatagcatagtggctaaaactgttatgtctattggaagatcagagtgaaattctactctaatcatttgaactatttaaactttccatattaaatctgtttcctcttctctgtaatatgttttttaaatttcagctaccagatagaattttttgaagaataacgtaaaattacatatgcaaatttttgtaagtcattgatatgcttacagaagctggaaaaaaataatttaaattacacctagtggggtttgtcatctgtgtctgtaagggtggatctctgtaagtctctaaatgacacatgttaggatcagttttacttacaatatagttcaaaagggcacatttttaaggctacaatttaaaaacattgacatgtaactatacttaaatatttgctttcatttaactaaatgaaaatataagataaatatcttccatatttaccaagagccatattatcttatttgggtaacttatagagcatataaaactagtactttacagaaatataatgacgtagcttcaattatgtttacaagaagaaagacagtgatggcagtgggtgcttctaatagaatttttccctttaattagtgtaacactaaaaaatatatgccctattaacatttaatatgttttctccaactttaaaaacactgttattgaaatgctttcacaacaaaaagagggaaaaggaaggaaggagaaatctgttagaataagaaggactggggcctgttgtggggtggggggagtggggagggatagcatttggagatatacctaatgttaaatgatgagtaactgggtgcagcacaccaacatggcacatgtatacatatgtaactaacctgcacgttgtgcacatgtaccctaaaaaagtataataaaaaaaaaaagaaggaccagtgtttgcagttgacaggtgcagagtgccccttacactgaccatgagatgaatggtaatccctgcgtggacacgccctctgcagactggccctgtagtcactgctggaagcattttctgagctagagagatatttataaagcttattttcaagtggagtgacaaggagaataaacagctataccaaaatgtattaaaataaaaaatacaattttaaaagtagagatgttttgagaaagaaattggataaatcaggaagcattgaataaagagaagtattgttttggatagcatagtgtttggaaagttattcagcaggataatgtttaggtgatgttcagaatgatgatcttctaatgatcagaagtaggccaagctaagagcctggagaagattgttcacttacagggaaaagtaaatatacttaacatttttagaaattatagaaagtccctaacttgttctagcagtgttccccacttgaaaatattttttctataaaacctacaaaattaaataagtatgattcagtataaaaataatcatattagaaatagtattgtgtgagattattccaaaggatagatggtcttaatctgcctcagtgtactcatctgaaatagtatttacatcgtttttatcaggattgcagtgaaaaagaaaaaagattttttacatttctgatattttcatcctttcaagtagaacataatacatgaaaattttacatgttatgttattgttataatcccttttgtgtagtaacattcaacaaacttttgttgctcctgacacaaaattgtatgcatattgtgggaatataactaaatctattaaagttaatgaaataaagagtgaattgttaaaaattctgtatgctgtttttctgataccaagaatgttattttctgagcttaagaacaacttatttgtgtttctttgttaaatgtattaaaatatataaaaagtaactcacactgaaataatgagtacttgattgtatccattttatatctaaacaagcaaacatttaggaaatacaaataacacagatttcaaaaaataaagctctctggaactatgtaagtttatggagggacatattttaatattaagataattaaaattagtagacataatgcttttctttttatacaattgatgattaaaaattagttacgttgtctagtatattgttaagtaaactgaagtcaaaataaatcaagtggaataatatatataagtaaagtaaatatatttacttagtaaatgtttcaaaattttatatgattctacttgctacattttcaggatatatcatttacttctttggtgaaattgttaaagcttaagagagaattaaaccaattgtgtgtgcatgtgtctgtataaatatattcatgtgtatgtatgtgtatatatacatatatgtgcacacatatgcacccatatgcatgtgcctttaaaggaagaaattttgattttgtggctttaagataggaaaataaatcatgagatgacttttaaattggcagaattttgaaacaaattataatttggatgttggtttctaagtcacctcaagttattttgtataatggtaacagatgagttttatttcctaaattttttttcctgtgctattcaactgtcctggtacgtctgtaaggcaaagcaggccactgtaattctacaaagctaataatatcatactatactatagtagacttaaacacccatcatgacttttgtctgagaagtaatattttcctccaataccggttgagtaatatatatattctttacagtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataaggtaaccacatctcaatatgtaatggtttccattaccatgcaatttcagtattttcaatatcattaaatcacaaattagtctccaatttacctagtaacttgtaggatcaaataaatggtttgatttttaaaaaggtaactaacacaatgtcggctttaccactttcgtgggaggggaaatgtcaatatgaaatatttaaagatgttctttattaagtcacaaacgtttaggctattggtattactagcattgcttaactagacttttgttatacgttgaatctataaagtatgttattgcagttttaacccctgctgtgtgagtatctggcctttgcaaattcactgaccatgagaaaagtgctaggacaaataatattgccattttaaaaacaggaataaagatttacaaaccagtacatttaactttaaacctcagcaatttcagtttcttaaagaaatgattgtatatttagaaaacactgtggtgagtgatgagcgttgggattggcgaagaagatttacttcaaattaatttaatgtattttctacttagacaggtgtcaacaaactacagtccatagggcaaatttggcttccagcctgttttggtaaataaagctttattgaaactaaagcaaaagagtaatttaaattcaaaaaagtctgactgtcatccaatgctttaccctttagaaattgtctttctgcagtagaagtgtaggttctgctttcatataatttagaatctaatgtagagaaataggtacaaacaaattactgcattgtgatgacctttaaccagaatgcattcaacttacttagaaattaatgaaacattactatatgtttcactatactaatggattttaattactattatatttcacaacttttcatatgaacttcaaatacaaacaaaagagaaaggaaaagatggtgaaatattgaaatgatagaactggcaatttcacataagtgaagattataacattaggctattacattgcttttctctactcagtgttaaagagaaacctcctttaaacttttttcattattaactttatttaggtaaagagtccaatttctaaagtattcatacacctcaatataactttgatttattaacattgatagtaaaaaagagaagaataaatgtttgtccatagtacactttacatcaatcagtccatcccatcatgttatatttaacaacatgctaaacccataaattcaccaaaaaagtaacttctctggtcaatttattactttccttttgaaagactgtgttatcatatatgttacccttttttgtttcattttctcctcataatggcattttaagagattatttgataattgtactattttgatatacttattttatatattcaagttgaaaatcaaatttataaaatgtgaatgacagtcataatcttctgcaacccagataaaagttatagtttgctttagtatattcttaacaaaaaataatgtatgttactatgacacagttgccaaatctgaaaagaattaaatttatgtgaaattaaaaaaatacaatcgtatctgaaaccatagaggattgtttttgtttcaattttgcatgtttatttagattagatcactcaaaagtatttactttcatgcccttagactttatcataccttcatatttctaatgctgttttctaattatttttcagcttactgcaaaattcttaaaagttatcttctcaaagatagtttttactctgcatttaatgaatgttaccttatatattatgcagagaatgaaagataaattatactcagttatttcattaataaatgtcatcaagtaacaagaaagctgttatattttattcttggatctatgcctcaggccaccccaaactacacacagatacttattctgtagtaactgtgaaaaataatcttaaagcttttgtttcctaaggagtatattaaaaaacacatcttgttttaagaaaatctgacttggtttctttgcaataaacaattatagaaactcaaatatgcttttctgcacaagtttaatccagtcaataaagaaattaagtctattgtatttctattatatttctccaaatatattttaagatccttgacttatttttctatactccagtacacttcttttcccctaatatttctagtttcctgaatagcataattcacaaatcaaatggttgagctgaactttgaagtaaagtttatctagttttgaatctcagctctgccatttatgatgcctcagcatgataaaattgagttcaaagagtccaaataacattaccagtgttatttgaactctttttaatatgagtttttaatatgaattttttcatctttaaaatgttgatatttaccctcttgttataaggaagatgagcacattacaaatgcatatcaatgtttatcatattataaatatccaataaactttactttttaccttgccatattacaaatttacagtacaaatttacacattttactttgtcatattacaaatttacagtatggcctcacataatacagcttagaaatgaaattacatatgagaatggtcaagtcacgcttgaagcatagtttatcttgttgcctctgtaaagtataactaaggtttgattgaactttaatgagatcatattattcctatcatggaaagtagcatgggattgtactttccataagaatcacgtgggaagactatgaaaatgcagattctagattcccacttcttgaagttgatttagtatatgcagcccagggcataggaatgcatattaaataaactcatcagttggtgtcatattgttagtcttcaagccatattttgggaaacaacttcaagtaaggatgaaaattaacagctaatatttccaacagaaaaatgatcttaaccaattagttgacacctgatgggggcttgggaactataaaacaaaactaaactaaaatttccattatgcatgtatcagtcaagttttgatgaaactaaaatatatagatcaaaaatagtgaaatatcataaatgtcgtgtagtaaaaactaataatttcatctaacaacatggcaatgtatttagcaaatatgttcatcattttagatttttcagagaggagggtctcaattaacaatattcttttttttttttttgtctaagttctcaatcaccagataagacaaaaaaaatggggataaaataccatgtgacttaaatgtatagatgagtgaatgctcttatactgagctcaataattagataaacatactcaacacagtcccaagtagcatgagacttacagccctcccctgtgtgagaagacatgctaagataaccttgactgagggggacaatggtgaacccatgttctctttggggtggtcctttctgaaaagaaaaaaaggagtggttaggaagtgtatttaattttttgtgcccccatagttacctatcagatatctcttcacttcccatgggagaaaaagtaagggacttgaaaagtccaactgtggtatgttggaagaccttcctccccatggaataaatgattaagagttcacgagtagcattcactgcccaactaacaatatgctaataacatttaaatcaccatatacataactatctcagtttatcgtctggtattattactgcatagtaaatgaccccataatataatggcacaaaccaataattttctctcacttttgattttgtggatcagaagtttgagtaaggcttggccagatggatatcacttggaatctctaatgtgcttgtatcagatgttgctactaatgttgcttgtagttgtagttatgaggaggttcaactttgctgagaagccaacatggctcacttaagtggctggaattcagtcttgactgtgggctgcaagctcaggtggagctgtttttggaacatctatatgaagcctctccagtatggctatctaagagcagcctgctgtcttttgtggcggcaggctttctccacagagaacatttcagaagaatcaggccagacagacactatctggtctactctgacatagtcttggaagtcacacatttctcacttctgccacagtatattggttacaaacaaattataaggtcgcccaaatccaacatgagaggaattaggcactctgtcttgatggggaaggattcacaatcatattgtagataagtatgtggggtgggagatattgttaaggccatctttggaaatgcatctacaatttatctcaaaatattcccatgacttaagtccaatcattttcccaggcttgtagatgaggaaactgaggctcaggaaaattcaggggtttgcacaaggtcacacagggagtaagtggcagtggcaggatttgaactgtggtctctcactctgcatagtgcatgcccgtgcaagggcttcaggattctgttaaagtgtatggctggcactctcataggaatttaaattatatttccatttaatcaaataattgaaaagtcagaagaagctttgtttttaaaacttttttataatctgatattacttattttaaactaattaaaatatagtgttcagtaaacaccaaaactatttactggtttttgttaaaatacatatatgtaaaaaattacttcgtataatgggtactaccaaaatgtttgaaaacccatgccatataaaacaatctagaggtgtgggaggggagcaaaatggcagaatagaaggctccaccaattgtctccccaaccctgcaaggacaccaagttaacaactatctatacacatacacacacacacacacacacacacacacacacacacaatcttcatgagaaccgaaaatcaggtgaacagttgtagtacttggttttaacttcatattgctgaaagagtcactgaagtgatagaaaaaaatagtcctgaataaacaacaccaacaaacctccaccaccctcagcagccttgacatggtgtcgagagcttctctgggagctggaggagagagaacatagcaattttgaggcagtgaactcagtcctgacctgttagagcagaaaggaaaacaagacctaattcaactgacacccacccacagagggacaatttaaaccagccctagccagaaaggaatcaccgattccagcggtacaaacttgagtgcctgcaaacctcaccagtgaggaccaaagtgctctgtgtctcccagtaaacttgaaaaaacttatgaaactctaggccataaggactgcaactcttaggagagtcctagcgctgaactgggccaagagacagtggactggtgtcaggtggggaggaatgtgacatacagatacaccagctggggtggccaaaggagtgctgtcatcttccctcccctaaccccagcctgcacagcttgtggctccaaaagagacctctttattctgattgacgagaggaaaggaaagagtaaggaggacttggatactagctcagccacagcaagatagggcaactgttagagttgtgaggactttgttccatgtcttatctcccaaacggtgtttctataatagacaaactctgggccagatgagaacacactggctttcatgaaaggacccagtcctggcagcattcatcaatggctaactaaagagcccttgggccctgaataatccacagtgatacccaggtactacgtcaagggctttgataagcctctgatactttgctgggtccaaataatagcacagccatgggggtaaagcatgaagtggggtcgtagggtctgccaatccaggaccttactcttgcatgccatttctggacctgctgtgggtcactgtcctgaaatgtgattgcaggccaggcagcattcaccacaagctaacttaagagcacctcagcctcaggggaacattgttgtagtctagcagtactccttgtggtctggggtggtggtggctacagggtgaggctcctctgcctttggaaatgggagggaagagggggaagaactgaatcttgtggtctgagtgccagatcagccacagtaccatagaacaccaggtagacttctaaggttttagacctctagtctctgactcctagacagcacctctggacccacctggggcaagggggaccttgcttccctgaagggaaggatgcaggcctgactggctttgcctcctgctgattgtagagccctaaagccttgagcgagcataggcagtagccagggagaggttacaacaggccttaggtgagactctgtgctgtggtggcttgaggtctaaaacagcacagccatactgctgatggccacaggagtgcttgtgtcactcttctcccagctttatgcggtcagaaaatagagtgagactgtgtttgggagaaagtaagggaagagaacaagagtctctgcctggtaatacagataattttccccgaacttgtccaagactatcaaggcattacctctatgagtctgcaagaacctcaacattactgggctttgggtccctctaaagcaaatacaacttagatcacaatacccaaggtttttcaaatatctggaaagccttcctaagtaggatggatacaaataagcccaaacagtgaagaatgcaattaatacctaactctttaatacccagacactgaagaacatctactagcattaacaccatccgggaaagcatgacctcaccaaatgaactaaataagaccccagagaccaatcctagagaaatagaaatatgtgaactttcagacagagaattcaaaatagttgtgttgaggaaactaaaaaaaatcaagatgacacagagttggaattcataattctatcagatcaatctaacagagattgaaataattacaacgaatcaagtagaaattctggagctgaaaaatgcagcaggcatattgaagaatgcattagagtcctttaatagcagaattgttcaagcagaagaaatagtcagcttgaagacaagctacttgaaaatacacagaggagaaaaaaagaataaaaaaaatgaagcatgcctacaggatctagaaaatagcctcaaaatgaaaatcaagagttattgtccttaaaaaggagatagagaaagagataggtgtagaaagtttatgcaaagggataataggaacttcctaaacctagagaaaaatatcaatatctaaccgcaggaaagttatagaacacaaaagatttccctaaagaaggtactacatcaagggctttggtaagcctctgagacttgctgcgtccaaataatagcacaggcatttaatacctcaaggcatttaatactgaaactcccaatggtcaaggataaaaaagcaaaaaactaaatcatatcaccagagaaaatcaccctcactgaaggaagacaggaaggatagaaagaaggaagagaagaccacagaacaaccagaaaacaacaaaatggtagtagtaagtcctaacttatgaataataacattgaatataaatggactaaactctccaatcaaaagacatagactggctgaatggataacaaaaataagacccattgatctgttgcctacaagaaacatacttcatctataaagactcacatagactgaaaacaatattccatgccaactgaaaccaaaaaaaaaaaaaaaacaggagtcactatacttatgtcaaacaaaatagatttcaaaacaaaaactataagaaaagacaaagaaggttaatatataatgacaaatgtgtaaattcagcaggaggatataataatttaaatatatatgcacccaacatgggagaacccagatacataatggaaatattattagagctgaagagagaggtcccatcacaataatagctggagacttcaacacccaactttcagcattggacaaatgtttcagacagaaaatcaacaaagaaacttcagatgtaatctgcactatagatctaatggatctggtagatgtttatagaacatttcatccaatggctgcagaatacacattcttttcctcagcacatggatcattttcaaggatatattatatactatgttacaaagcaaatgttaaaatatttaaaaaattaatatcaagcatcctctctgaccacaatgcaacaaaactagaaattaataatgaggactttttgaaagtataaaaatacatggaaattaaagaatatgctcctgaatgaccagtgtgtcaatgaagaaattcagaaggaaatttaaaaacttcttgaaacaaatgataatggaagcacaaaatacaaaaacctatgggatatagcaaaagcagtagtaagagggaagtttatagctataggagcctccatcaaaaaaagaggaaaaacttcaaatatgcaatctaatgataaatcataaagaatggaaaagcaagagcaaaccaaacacaaaattagtagaagaaaataaataatggagaacagagcagaaataaatgaaattgaattaaaaaatacaaaaggccaatgaaacaataagttgctttattaaaaagttaaacaaaatttacaaagctttagacagactaagaaacaaagaagatacaagtaaatacagttataaatgaaaaaagagacattacaaccaatactgatgagcaactatatgccaataaattggaaaatctagaagaaatagacgaattcctatatacatacaacctacacataaacaaaatttaatgacatttttcacagaaatagaaaaaactttctaaaatttatatagaaccccaaaagactcagaatagccaaagctgtcctaagcaaaaagaacaaaactggacaaatcacattacctgacttcaaattatactacagagctatagtaaccaaaacagcatggtacaggaagaaatccaaaacctgaacagaccaacaacaagtaatgaggtgaaagccataataaaaatcctccataaagaaaagcttggaacctgatggcttcactgctgtattctaccaaacatttaaagaagagctaatcccagtcctactcaaactaattcaaaaaatagaggagaaaagaatatttccaagctcattctacaaggccagtattactttgatacctaaaacaaagacacataaaaaaagtatctgatgaatattgatgcaaaaatcctcagcaaaatactagcagccaaattcaacaacacattagacaaatcattcatcatgacaaagtgggatttttccttgggtcaacatataaaatcaatgtgatacatcatatcaacaaagtgaagcataaaaaccatatgatcatttcatttgatgctgaaagagcatttgataaaatttaacatccgttcatgataaaaacactcaaaaaactgggaatagaaggaatatatgtcaaaataatagaagccatatacgacagacctacagctagtgtcatactgaatgtggaaaaattgaaagtgtttcctctaagatctggaacactacaaggatgcctactgtcaccactgttattcaacttaataatcaaagtaccaactagaacaataagacaagagaaagatctaagtgacatccaaattggaaaggaagaagtcaaattatccttgtttttagatgacatggtcatatatttggaaaaacctagagacttcacaagaaaactgtcagaactgataaattcagtaaagttgcaagatacaaaatcaacatacaaaaatcagtagcatttttatatgtcagcagtgaagaatgtgaaaaataaaaaatatcccatttgcaatagctgcacatgaaattaaatacctaggaattaaccaaagaagtgaaatgtatctataatgaaaactttgtaaacactgatgaaaaaaatttaagaggacatcaagaaatggaaaaatattgtatgttcatggattggaagaatcaatatttttaaaatgtccatattacccaaagcaatctacagattcagtgcaatccctatcaaaatttaatgacatttttcacagaaatagaaaaaactttctaaaatttatatggaacacaaaagactcataatagccaaagcaaaaagaataaaactggacaaatcacattacctgacttcaaatgatactatagagctatattaaccaaaacatcatgatactggtgtacacacagatacatagacccatggaacagaatagagaacccaaaaacaaatccacacaactacagtgaacccattttcaacaaaagtgccaagaatatacaatagggaaaagacagtctgttcaataaatggcgctggggaaactggatatccatatgcagaagaacaaaacttgacccctgtctctcaccaaacacaaaaatccaatcaaaatggattaaagacttaaatctaagacctcaacttatgaatctactacaagaaatcattggggaaaatctccaggacattgacctgggcataattttttgagcaataccccacaagcacaggcaaccaaagcaaacgtagacaagtgggatcacatcaaattaaaagccttctgcacatcaaaggttacaatcaacaaagtgatgagataaccaacagaatgggagaaaatatttgtaaactacctgacaagggattaaccagaatatatatggagctcaaataattctatagaaaaaatataattatctaatcaaaaaatgggcaaaagatttgaatacacatttaccaaaagaagatacacaaatggcaaacagatatatgaaaaggtgctcaatgtcatggatcatcagataaatgcaaatgaaaactacaatgagatatcttctcactctgattaaaatggcttatatccagaaactatgcaataagaaatgctgacaaggacgtatagaaaagggaacctttgtacactctgagtggggaggtaaaatagtaaaatagcaatggagaacagtttggaggttcatctaaaaagctaaaagtctagctactctatgattcaacaatcccactcctgggcatatacccaaaagaaaggaaatcagtacaacaaagagatctctgcactcctatgtttgttgcagcactgttacaataactaagatttggaagcaacctaagtgtccatcaacagatgaaatggataaagaaaatatacacagttgggtactattcagccctaaaaagaatgagatccagtcatttgcaacagcatggatggaagtggagatcattgtgttaagtgaaataagccagcatagaaagataaacatcacatgttctcacttatttgtgggatctaaaaatcaaaacaattgaactcaaggacatagataatagaagaatggtaaccagatgatgggaagtatagtgaggtggggcgtggtaaggatggttaattggtaaaagaaatagaaagaatgaataagacctactatttgatagtccaacagggtgagtatagttaataccaacttaattgtacattttaaaataacttaaaaagtgtaattggattgtgactcaaaggataaatgcttgagggaatgaataccccattttcttgaagtgcttttttcacattgcatgcctgtatcaaaacatctcatgtaccccacaaatacatacacctactatgtaccccaaaacttaaaaatttaaaaattaaaaattaaaaaaaatctagaaacttaacactattctcactgtaaaataaatgattaagatagtaaataaatattttcagagttcatcttcaatgataatgggttaaagttttaataactgtaactcactaactacgatgtgttcctaattgtttttattttattattgggcacaattttatactacaatccaggacagcttcaaatagtgatagaattatattatttcacataaatgctactgggaaaaaaattatgccttttatatgaaatttctcatattctactggtttctgatgctaataacccttccttgctttgaggaagatattgaactgttgaactgtgcatatgaatacagcacaaaatagctttgcataatgtgatatccttcaaaaacaacagaattcacactggttaaaaacagagctattttaaactagtgactattgttatctgtcatccaaagcattttatgtacatgtaaaataatatatgcaatttttaaaactgttcagatcaatttcagatatacatataagcgtatctattttccttagaaatgttttctaatatctaggtcgggtgcggtggctcacgcctgtaatcctagcactttgggaggccgaggcaggtggatcacgaggtcaggagatggagaccatcatggctaacagggtgaaaccccgtctctagtaaaaatacaaaaaaaaaaaaaaaaaggagagaaaagaaaaaaaattagccaggcgtggtggcgggtgcctgtagtcccagctactccggaggctgaagcagaatggcgtgaacgcgggaggcggaggttgcagtgagctgagatcctgccactgcactccagcctgggagacagagagagcgagactctgtctcaaaaaaaaaaaaaaaaaaaaaaaaagaaacttttctaatatccaatataatttcaagataatttttctctattttattgagttagttgtcactaacttttaattattagtttattttaaatttctaggcaatttattttagtgataactcaaatattattggcgatatttccattaaaatataattgatgtacagtagtagggctatccaaaaataaatcaacagcttaaacttttcatagaaatttggcattttcttaagatgcacttgtgtttacaaattggaaaccctgacctctttatttaattaatgttgtgtacttaattgtaatatttaaatgtatataataaagcttaagacaaaccaaagctctttccacagaatatgaaatagccataagtcaaaattttgaattatcttgtacatactaagcaatatattgtttttattaaaaacttttctttattaaattaaaccatgctttttttcaaagccttgatctgagatatatgtgagattgtatgttcaaagtgttttaacataattttgtcacataacaaacacctactaaatattgccactttatataaacatctctcatctatttgttcatttgtttgtttctgttttgttttgttttgttttgttagacagagtctagctctgttgcccaagccagagtgcagtggcacgatctcggctcactggaacctctccctaccaggttccagtgattctcccgcctcagcctctggagttgctaggattacaggcacacgccatcacgcccggctaatttttttattattattactagagacagggtttcaccatataggccaggctggtcttgaatacctgacttcaggtgatcctcccacctcagcctcctcaaatgctgggattgcaggctctcatctgtttttgaatcaaagttgtttggttgttattgtttccttgtttttttgagaaagggtcttgctttgtcacacaggctggagtgcagaggtgcaatcacagctcattcaagcttcagccccccagtctcaagcatcctcccacctcagcctcctgagtagcaggactacaggcacatgccaccatgactagctaaatttttgtaggtttctattttactttattttatttggctgttgttgttggtggtggtggtggtggtgttttgtaaagacagggttttgtcatgttgttcaggatggtcatgaactcctggactcaagcagtccacctgcctcagactcccagagggctgggattacagacatgagccaccttgcctggctccaaatttatttagatcgtctcttattatcattcttcttgatcaataaatgttagtatacatagaaatcacagatattgatgaattataatgggaagtcatggaaagtgtcacacaattaaagcttaattctgactttcttgcttttggtgtgtcattgaccatgttagttctcatctctgatttcagtttctgcatgtacaaatcaagatataagacctacctgaaaaagggttctgaagatgaaatgagattacatgtaacaatatctcagacacaagcccaacaacttgaaagtgtttttctagttatacatttagaagaatgtataactagaaaaacactttcaagttgttgcacatgtaccctaaaacttaaagtataaaaaaaaaaagattagaaaattaaaaaaaaaaaaaaaagaaagtgtttttgtttttgtttttgttttgagacagggtctcactctgttgaccaggctggagtgcagtggcacgatcccagcccaccacaacttccgcttttcgggttcaagcaattttcctgcctcagcctcctgagtagctgggattacaggtgcccgccaccatgcccagataatttttgtatttttagtagagatggggtttcaccatgttaccatgttggccaggctggaaagtgttattttctattattcttggagttatcctgtcttcattccatattatacatactgttatgttgcaattacatttttcataaagaaaaatgaatatgttaactccgtttcaatgactgctgtcacacaagagactagataaaaatttttaaagcatagtcctatgtactttatgatggaataccatctaaaaaatgactgagtcttctacccttagttgtcagagattgtgcttccgtatagctacaaagtttactctaaaataatctctagcaatattaattcagtgattcatatatcaggttttaccacactaaattccagatcttgtgactgtatatcttattccttttggaagttgacaatgtcggaagtctgcatttggctcttgtcataaccaccttatgtttgccttcaatcgccatccatacaggcgagtgcacataaggtctctcacgtcctatgctagatgaagatagattctcaggccactcttaagtgatgaaggctagtctctacctatgaggcacaaaatcagaatagaaatatagatttcttatatcatcatctttttcttccctttctctcacatctgtcttgcctaactccttcaaatttttcctctgtgggaagtgagtcagttttttccttctttgggccattatacacctttcacattttatagcagtatatattgatttggaaaagattcttcaacattctaagaagtacctaaatagggcattaaggtaggaaaaaaagaacatattgtgctccacaaaacaagttattgaagaatgctttgttcttcatctatttttcaaactatgtttttatatcatatgataaaactgggtgtttttagaacatttgtctaaaaatgctatgttacttgtcaattttagtattaaattgaagtaaaaagttctaccgagggagtgattttgcctctagaattcttacaaaatgataaacataacagtaagtaattttatgtatatgaatataatgttttatatcataaatataaagtgcttattatatcatctagcagatgacatctcccttgtatcatttatcatctcttaagaaacagaatctataattactttattcctgttatacttctcctacgtagtatagacctacatccactagaaattaatcccactgtacattgaataagtatctgaaatgtacagcaataaattataactatcttaaggcagcatttctcaacttcagtcatttgataaccagcttcatctcttttctgtattcatgtgctgcctgaactgttacatgtcctctttcttctttaaattgaattgtttttatttattcttatctgtacccaaatgatcagtgaaattaaaagtatgatacatatgccagttatatttttaaatgcacattaaaattaatacaaaatatacagtacaattgtttttcaaaatattacctaacctcagcgtatccaccctcccccagtggttcacagatcacatttttagaaattctgcttttgtgtccaaacatattttgaattaatgtgatacaaaatttagctatgaaatattgagtgggacatgtttaaagatgttgtaattaggatagaacctgttttccatcctcctgtttgtgggtccatgcacttttctccagtaaataatatgcttcacttcactaatgggcactgagtttattcacaaatcattgtaaaagaaactcatttacttccagtccttagcactaaatgattcttttaggatgagaccaataaactgaataaataaaacagcgggataagctttaaaagcaatttcttcccttttttctgctaaagtgaaataataaaatgctggccttggtcttagcctagatcacctgcataatttgtaatcaaaatagtagtattttttgtgattttgcatttattgagaaaatgtgtctttctgtgttaaataaaataaactgattcaactttaatttttgtactgtgagtccagttttaccttctcttccttccaataaatagatgtattaaaactgaaatttaagattatttcgtgaccgggcatggtggctcaagcctgtaattccagcactttgggaggcttaggcacatggatcgcatgaggccaggagttcaagcccagcctggccaacatggcaaaaacccatctctccaaaaaatacaaaaaattagccgagcctggtggtgtgcacctgtagttccagctactcgggacggggccgggaaaagggggttgcagggggctgaggcaggagaatcacttgaacccaggaagcagaggttgcagggagccgaggtcctgccactgcactccagcctgagtgacagtgacagactgagactatgtctcaaaaaaaaaaaaaaaaggagagaaagaaagaaaagaaataagggagggagagagggaggagggagggagggagagagggagggacggaggaaagaaggaaggaaggaaggaaggaaaaagattatttatttgaattttattgctgttattattattattattatttaaggcggagtctcgctctgtcacccaggctggagcgcagtggcacgacctcggctcactgcaacctctgcctcccgagttcaaatgattctcctgacatagcctccggagtagctgggactacaggcgcgtgccaccacgcctggataatttttgtatgtttagtagagaccagcatgttggccaggctggtcttgaactcctgacctcaggtgatccacccacctcggcctcccaaagtactgggatcacaggcgtgaaccactgctcccggccttaattttaattcaaagtagggatagtcacctttaacaattaatttcgcatcaacacacacaaatacacataaattgtagttttaccaaagtggtccttgctgtttccgtagtgtagaaatagtatttcctccacgaatttagacacaatgatctgaagaatacatacttaaaatattttgcagactaaagtaccaattcaaaaggaatttctctcaggaataaagataggcagttccttaaatacaactacatgaataaaatatgatgcttttaaacttataacaatttaaatatctcaccacgtaaatatttcttacaacactgctgcattcattattatattattgttttattctcagttatattattctttattatatacttacaaatattttattgcaatttaatattgtcatttatggttcgcggttcctactgtggatttaagcaaactttatattttaaaaattatttatttaagccaggtttattggaagacagaaaacaatggagtgaacttttcacaatacaaaattcttagattatttttatttataaaatgtgaagattacattatattttttgtttctttttttattcttaagaaaatgtaacttctggaaaataaattttataaaatataagcagtgacttaatcagtcatagtaatttatgtaactaacatttcctttattactaaccccaattcacttaacaactatcaataaataatgaagacttttatattggcatgtgctaatctagacacaaggagtgtagcgctaaaaatataagtttcgccaggcacagtggctcacgcctgtaatcccagcactttgggaggccaaggaggctggatcatctgaggtcgggagttcgagacaaacgtggccaacatggagaaatcccatctctactaaaaatacaaaattagcagggcgtggtggcacatgcctgtaatcccagctactccgaaggctgaggcaggagaatcgcttgaatcccggaggcggaggttgcaggagccaagatcgcgccattgcactccagcctgggaaacaagagcgaaactccatcaataaataaataaataaataaataaataaataaataaatgtttcttgcttcatggtccatgcaatttaagaggggagatgaaactaaactacatttaaaattagtagtcattttttatgaatatacacttttgaaatatgcagttttcatatacaaaataccagttttgagtatacaagtgggctttcacaaggtcacaaatatagctttggcatatttctttacacttacacaggcccgttcaatgcgtatgcctcacagtcctctttttcagtgtattttgcaaactctatcaccaaaatatctcctcgtaatttgtttcaggctgacaaaaattacttagactttgattataaaaaatacaaaacttaaaaaatgtgtaacggtatacttaattggaagcatctttatattatagggggcattttaagattttgaacttccttttttcacctcaaatagaaatcaccaaaaggaaaccaacaaatccataattattgatttaaaatatggagcctgtagcatttcaaatatctgcacttttaaaaaaagctctggtgaaatgaaaaactaaaatataaaaaagtggcatatttatagcattgtctttaagattgaaagacagtatgtaagtcttttttttatacatccttgtgagtagttatacttctgggtaaattttttacaactttatttttattacttatatgaggaattttatttctacctttttaccaaaccctgaaggtgcattctgggatgcaattatagacaattcttagtgtttgattctaagacaaataaaaaaacaaataatacagaacaaaaagcgaagaacaaatgtcaaagagataagtttaatataaaaatcaaataaataaacttaataaaatactttagcaaataattgaaggaacaataatatgtttgttcagatattttagtcatacatacagccgaactagacacattgcttacttactgtgcatggtagtacatcaacagggttgtaattacgaaaacgcatagaatttgcaacagagattatagataatagcatgcattacattccaaacaagagaatgtctattcccttgaatttctctagcgtaatctgcaagatcatcaatgtctaagagaaaatattttcattcgatgtgatgttgccgtagaggatctcaaataatctatatttccctgatattctgtcttgtttaggatttagatctgtgagttagtattcagcgtagtgggactaactcacttttgtacgtaagaatcacataaggagctgtatacaagtaaacctgactgagcctcactccctaagatataactgcacctacctttcagatcttttgatacactaactttcagtggggattaaagagtttcattttgaaaatgtccagaaatggttcttgtgtatatgccctatagagatcctgtctttgaaattactttatttattctatcacagacacacacacatacactcaacacacaaaaatacacgcacatccactttcatgaaacatttgttacttagaaaaattattacggttttgatattaaatacaactacatatagaataagttacataaaacaaattagttcatatgactcatgtcttcctaatcatgatagttttggcattccaagtttatataaaatagagcttaatgaactagtattacgtggtagttttaacactgatttatctgctctgtgatagcaggtaaattgttataactttttctggtacaagtctaccatttataaataagtttccttcaatctgcaacatccccttattctgtaagtcttccagttggctcggtaaatattacaaatttttagatagtttttaattcatataaatttgatatttactaactttttagttgatgattttctaataacattgtatagtgagggagtgtttcttcaattttcttctgtttagctttccatataaatcaattagtaaggaaagccaaggttatttggataatgtctttaaattgaaaacaaaagtcaacttctgattgtagagaagaatgctgaacaacataccaccagttcctggcacctgtagattttcacgctgtgtgtgtgtttttcttttttcttttttcaacagagataatggacttttctgaaggattttttatttgaatgacattttaaagatctacctaatgcattttttcatactagtgccccaagagcaataatataagtccctgctgggcagtaggcaaaatggatacttctattccccatctgatgtaggtggtagaatataattaggcctgttagaaatcttccttgatgcttctgagcttgctgagaggtggattttcaatcatttacaactttctgaaatctttttctgtacacagcttgaataaagattttcagaaaagtctagtcatatgttgaaaatgtcattttaaaaattgtttttgaaataattctagataatatttttaaattgaatatgtctttttaaaagcatcatttactaatgaactattattttgaagtctataataagacctttcacttaaaaaaactgtcgtcagttttataagataatgtgatagtagtttacaattttatgatagttgtttgggggaaaatgttatttatatactaaaagtgattttaataaggctttgcagcaaaacatatattattttcttcttataaataccatattctacatacagaattcagttagcatttacatctgcttatgaagtagtcgactactacacttgaagaaaatataaaatcgtatcactataaagaagtctaaatatatcagtgaatattaatagacttaacaaaaacaacaaatttctagtaatgtaatttgagttaggtatgtggtattctagtgaataatgttaaattgtttaaacaacaagattaaataaatttgaatgaatgtatgtacagcaatgcattttggttcaatttttaaaaatatatagaaaaacaatttgaataaattatatacaagtaagtatagtatctatgaaaatatctgagcaaacattttaataaaaattgcagcaaaagaatacatttgatgaatttcattgttgagcttaagcatgcaacaaaaaccagtgcgtaagataatactgctttcacaataattaattaataagatggaatccattataacaaaaattgccttaacacagaagttgcaatggattcatttctcttgactcagggattgacataatacatttaaaaaagatatattcaatgaacatattcatttataagatcaaccgtatgtttagtagctgtgtttatagagggtgaaaaactcttaggtaagaatctttcttcgctatgatattatattgtcatgatctatctcttatgatagcatcaatgcttctgttttgtaatccacaaagtttttgtctgactatctaagtctttctttctcagaagttacatgatttttagattgacaataatatatctacttataagataatgtatttcatactctttcaaataagtacgaatagtaaaattctagtatgcataaatcctaccattttacccctggttcatagcgcttaccttgttcactcctttcaatcaccaacttatattttactgtctattacaataatcagtgcattatgtatatgccagtcttttttttttcgcttaaagaaacatttctggcaaaacacaagtcatggtttaatttacttttctcctctttctccacatgcagtagcacagctgaatatagctgaagaaaatcccacagtaattttaagtggtctgtatttaaaattatgttccagaacataacgtaaattctttctgctgcctagaactcatcctaccttttcttggttcattttcttgaccactgttttagataactacttcataaatttttatctattctcaaatttacaaaactcctctatcatcaaaaagctcagctgatgattcacttcctcttttactaattagttggaaacagaagaaaatcttaataaatcctgactactacacctgcaaacatacccagtggaacctgtatgttaccatgaatgaaatatctgagttttcatgtggagtctggatttcatccactctaacatcagtccagtaattcatctccctatatataatcatacctcattgatcattaccataacttttaaagctattcttatttctcttgatacacacacacacacaaacacatacacatccttcatacgtatgtgtatatttatgtgtgtgcctgttcttccaattatctcttgaacatactccagttagattttaccactccactgaaactctctggcaagcttaccaataaccttcactttatgaaacctaatggttgacctagttaaacaacctcttctgtttgtaccatgttttttttggcttctagtgaactctcttggtttttttcttactatgctgttcacttcctcaatctcttttgatcattctttgtcttctaattgacatctaaataattgggcaccctagtctgccattttttcttggatttctctaatgatgctgagtccttggtgatttcatctagtcttacggctttaatgatcaattggattctgtaatctccaaatttcaactgtggacctctctactgaactccagtcttctatgtccaatgacttaccagacagcttcacttggatattaaataaatctttcaaagttaaaatattcagttcaatactgtacttctttttccccttgatttgcttctccctcaatcatcccattctcattaagtggtgtctttttctgtttaggaaaatgcttgaaaacatctttggcttttatttatttttattctggctagaaatacattttttaactgttacttttggttcagacatacacgtacaggtttgttatataggtaaattgtacattgtggggtattgaagcacagattatagaaattcatatttttagcaaattttattagccctactttaaatatatccataattcaattacttttcaacaaccagctgttactgccttggccgaaaccattgttacttgcctgcgttatttcagtaacttttttttttttggatgggttacagaccagcgtttgctttatttgaacagagtttgaacacaacagtgagttcttaatgcatccacccttgtgcctgttattttcattaaaatggttagattgattcacctgaaacaagccatataatataaatgttctgttcaaaagcctttaatagtctcatataatttggaattctctgctcttatttaatggctttacatgatagaccacttttccatttgctgtgacaacctgcttttcctcatattctacttttttttttttttaaacctgaaacagggtcttgctctttcacccaggctgagtacagtgctgcaatcaaggctcacggaagccttgaactcctgggtcaaccaatcctcccacctcagccttctgggtagctgggactacaggcacatgccaccatgcccagcttatcctactcttaagatcaattaatgaatcaatgaaatttcatgtttcctccataaatcctagggcattgcaaactcttcagtggtaatttatccatttagaagactgcaaattgcaagtcttaaattcagtaaaaactatttcaaaactttaatatgcttactgaagtttctaattattttttgtattttctgagagagtgcttgaactgtcaaactgaaatctatatgatagactattgatttttaacaggtaataactatgaatatgtttaggttaattgttggattctttagataaaaactaaggataaagttcagtccactgtcattcaacttacaaaatgaaaagtcaatgtacatgacacactatagttgattttctatatggatatttgcatttaattccgaagttcactatacccagtagagtgacaagagctttgataatactggaaccaaaatttaaaacaaaacacaaatttatattaaatttttagtagcatattcattgataaacatatgaataaatagatgtaatttttgattgattagtgaataatttgtttataaactagaatctcttttggggccaaatgatagagaaagtgataattaacatatcatacacaagtttatagaagcaagagattaaagagcaatgaaactgcatgcttttattgtgtgtattatagagaacattttggagatttattgtgacataactacctctttctatgttactggaaacatggctagctttgtttagatcagcatcataagttgtcatattgcagatattaccactaggtagaatactttttaaatacccactcatacaatttgcctcaattttccctgtactataaatactcaacacttttcatacctgcatatcccaacacagtattacaagctggaaaaaggctgtttctcatcatttttatatcttagcaaagatacatataattttctagaccatttctgcttcgtgggtctttagctcccctgtcaccagacttacctttaatgaaaatatccatagtgttttattaatcatctggtgattgatatacgttaaagattcatcacagtctgacacatgattttctttgattttttatagaaaaggtatcatatagaaaatatactattcctggtactgttttaattattttttttacaaaatccatactctatcaatggtttatggttgttgcagcattgtatattttatcccacactgggaaggtgttttgataagactcctgattttgcttaaaaagcgtaacattttatcaacatttccaactctgtttctcctatacattattttatcttaataacttctgttagatcctctctgaagagtttcttctcttttaattgaaggcttctaacaatcacaaaaagcttgatttgtatatagagtgtttgtataaattacctgttcttcatggagggttgctttacactaagacaacaaaaagcaaaatcaaaactgaaaagcaactcagtggagttcatctatttgttttccacacttttagtttttagccactcatctcttagagataggttgtttctatgtctctataacaaaaataatttgatgaaattgcggttttcagattttaatttttttagtattttgatgtttctttcatgttctgtataaaatatttccaataaatataggcatatttatttaaatataaatctgttatcaattatacatgagttaacaagacagcctgaggatcattcaaagctcacaatatagatatattttacccttcttgaacttctcacccaatgtgtagttataaggcatcatgacaaataatgcatatgaatcattcagcatgtctccatattcaaaataaaacatatatttgctataataatatcagcacatacaacagtaattatacatatagactatataagatttcttatacatctaatgacataggtatgttaacatgtatttagcataatgtgattgtttaaaaagaaaatgtatgtgtagcctgtatatatacatatatacacatgtatatacatgtatatgtatacgtatacataaatatgtacatatacatatacacatacatctatatatgtatatattgccagatacttttaattttatggtatcagtccaataaaattaatactttgaataaggatgtgttctataacataagaaatctcatattggtgacaaaatgtggtcactagatgtcactgacattaactatggaactagtgacaatttaaaatactttttagaacttccataatggatgaagtggggcctgatttgcacaatgaacttaaaaatcctcagcaacaacaaaacaaaatgtacaatgtgatgggcagcacattgatccccaagagaagagaagcatgtgatgtaagctccattattgctcaagcctactgcctggagagagatttcaggcgggagcacagggatgaatgcttcaattgttttccctgttaggagacagtgttctgagtttgggtgacaacgtgtgctggaattctcacagtggggtagctgaaagggcagagccctgtggagatgacagaatttcacacacacacagagaaatacctccggagatcttcagtgctttccgttggagatttgagctaattattgcttagtgcgtgtgtgtgtgtgtgtgtgtgtgtgtgtgtgtgtaaaaacaatgcaaggccttggaaagaatcattggaatgctagaactgttgctttggttgtgtggccaaaatagccctaaactaaaagttgttcccaactcacctaacaaagcttcaaagcaaacctcaaaggaataaaattgttttcaagtaacttaatgtctcagaagagagactggacatacataaaggaatacaaaacatatagcactcaaaatatatcagttacaatgtctggcataaaattaaaaaaatcgtggcatatgcaaggtgaaaaaaataacccataataagaaaaaacagaaacagtatcaatagaaacataccatcgatgacatacatgatggtagtaggcgagaacactacccgatcaattgttttaatgggccctgcatatgtatttagaagatacagaaaagcacaagcacaacaaggagagatgccgatgatataaaacagctcaaataaaaattgtatatattgaaaaaacaacattttcaatactgaaaatgaccttggacgggattagtagcatagtggatactgcagaaaatgactagcaaaatcaagacatagcaccataatctatccaaaggttaagtgctatgatttccttttgggggagtaggtacccagtagtgggattgctgtctcgattgatatatttagttctttgaaaaagctttgtactgtttcccgttttaggcaggaaaaaggtgaatatatcctttgacctgaactgtgtcttttccatgctgtgagtatggggtggacaaaggctcagaatgggacttttatttgttctggtagatagagcaagaagcatagagaagaatgttcccaaaatattctgagtttcttcatagtgtatttactgtatttttccactttgggagatttacgtaaaaacatactaaaggacaagcgcaatgactatagttaacatttgtttaatagttattatacgtcacatattgttacaagcatatcatatgatattgtagcatctcctgtaggatattgtgcttcttgcttaaaaaaacaacctctcatttgtctgtaatttgaactagattaactatactgcttaggcactgggtactaattatatcactgattttaacaatatttatcatgtacctagcatggagcctgcctaatcttatttaattctcaccagatgtggattaaagcaaccagcactaaatgagtgcattagtccacttgtgctgtcataattcttcagtaaaatgtcatcaaaatctcagtagctttcaatacaaaagtctgtaggtctcttttaagtatgctatagcagcatgctctagacctgagtctggtttctgatctgctccacatattctcttaattcaggaaacagcctgcagggaaaatcccatctggggtgtgatgtttgaaaatttccatgataaaatacaaaatgtaattttacaagaagacaagtactagagaatagtgtcatcaaatcccatgtatatgtcacccagcttcaatagttatcaatacttttcccttccaattcacacgttttaagtatcacactttatctgttttccagtagggaattttgactttgtattagataccaaaacattttaaattttcgattttaaaatagttgatccatatgatgtatgactccctcaaaaccttgaaacaatgcagtcaatacttactaatgactagttgtatgacttgagagcagtgtggtttaataacatggtatcgctgttcacagggtgaattcaattatgtggcatacattatcaccatatctctgaccatattataacgcatttttaaaaggaagagcttcataatataatttggctcattctttcagatttctctttgcggttttcatagttttgtgacatgaaagtaaattttacaagatgtacattttagatctgactatcttcttggcttctttatctattggtgattttttttatagatttagggggtacaactaaagttttgttacatcgatatattacatgctggtgaaatctgggcttttatattcaccatcatcctgataatgtaccttgacaaggagttatgtgaaatgttttattatttattatagcagttgtctcctcctatagtagttatttgtcctaattgtattttgtcttttactaaatatattatgtattggccatggaaaaatactataaattatttgcacgtggttcatgggatcaagagaaaagtctagcagcaaaataaactgtcaattaaatagagtatgggaaagttattattttactttgagatggaatatatgtagaatgcttttggaaatcacaatgaaatagatgggtgtatgaaactcatatttattgcttagatctgcatatcagtagctttagccaatttattatgtactttacagatgctaaactccaaatattcactcatttaatctgcataggtatcctttgaaatctgtattcttatcatacccattatacagaaaagcaaactgaggtaccactaagtaaagtagttaatctcaggctttagagattataggtgccacagccaggatgtaagcctatccattctggttctgcaatttatggtcctaactattatattacattaaagtaggtaggatgcctgtgcaataatataaatactcaggtcatgttttgaaaaccagcattttgacaactgtctgttggaacccacctagtctctagtctcatgttttaaatttaaaaataataatctctaaaaggtttattctacttaaagctttattatcataatattttaattttaaatattatttttaaagtattgaatatgaaatacggaatagactttatacatgtattaaaatatgggtacttattttaaaatataaatgtatacagccatagtataattttatgtagaggtaacaatctactaatgtagataacattttatacctaaagggtctgtgacagaatgcaagaaatatttcttttctcttttctttcatcaacactttctcatttggtcatttactaaaaacactttcacttccaccttaatatatttctggaatccactcactcttttccattttcactaccattacctttcccagcatgtcatcagtgtaataatgtatttccagttgttctccctcccccaccatcttagtctgttcacgctgctataacaaaatactgtaaagtggcttataaacaacagaaatttatttctcacagttctagagactgggaagtccaaaatcaaggtgctagcaggatggatttgaggtgtgctgagggctcactttgtcaaagatgctgttttcttcttgtgttcttatatggtgcatgggactagctagctttctgtgggctcttttattgggcactaattctaataacaagggctttaccatcatgatctaatcaactcccaaaggcccaacctccaaaaataccagcacagtggggcttaggatttcaacatatgaactttgaggggacccaaacattcagaccatagcaccctctctaatttactttttttcctgcagtgtgagtgatctttttaaatcacaagtgcatctactttattcctctgcctaaaacctatcctgtccatttccaattgttcgtaaaacacccaataaccttcaactgatatttaccttttcacagtgttatttatgtataagtcacatagcaaacaattcacccattaaactgtgcaattaaaagccttttttcctagagttgtgcaatcataaacacaatcaattttggatcatttgatcacttcttttggtcatcaccccccaatctcctcaccaccacctcccattcccttgcctgccctaagcaaacattattctactttttgtatctatagatttgcctattctggaaatttcaaagaaattgaattattcaatactagtcctttgttatcagctttttcctcttactgtaacattttcatgattcatccatgttgaagcatgtgtgagtacttcattttggtttttctttggccaaataatattcctttgtatgtttataccacttgtttttttcaatccatgcaccagtaaataggcatttcagttgttttcactttttgacattattaataatgctgtcattagcatttatgtacaagtttttgtgtggacatatatcttcatttctctttggaatgtaattacaattctctgtttaacatttggaggaactgtcaaacattttatacaaaacatctgcaccattttacattcccactcacagggcatgagggtgccaatttcttcacatcctggccaacatgtgttactatctgactttttcatggtagccactccaatgaatgctaagtggtatcatgattttgatttaaatgtccttgatggctagtgagtttcagcatcttctcatgatcttattggtctttcttttgcttgggtacttcttattgtagtcttgtttatttctctaactctttcatatcttaccccttcaacctcatatttaatttgatagttccagtgagcccctttaaactctttcaacacagctttttttttcctcaagttcaagcccacacagttaccatttttttcctacttttcttacttttttattggtgagggctgactttgtaggggtacaactcatgcaactgcacagattctgcactctttaacgaccccaagtttgagctaatatgctgcagtcatcgtcatcttggcattttaatagtttttaaatagaaactcccacattaaattttgcaattgccccctaaaattacatagccagtacagttcctgacttatcattttgacttgtccttccgttttggcataaatacctacgagaaactcttcctcacctttgtctaccaaattaggtttcctttctgaatgtcatctatatcagcatgcattataatttgtcattttttcctctgatccttatgacctgagagaccaagggctttgctttcttacccatttttctttttttatatgtaaaagtaaacgtgctaatttattcccattaaagcatcaaaaataaatgttttgtgtctaatttttgaaaccaaatattgtacatgccatcaaatgtttcaaacatcttattggcatgttttggtgtttgaaatcctcatttaaaattgaataacatattttaaaaacaaaaattagaaaaatcactaatgaaataaacacatttagtaggtaaaaatgcccacttttcaatttgagtgaatgcatttttctagccccagaacccagcaaagtgtctattacatagctgcggtacatacatagttcaaactcatagttgctactcaggtggtaaatcatatatcaaaaataatcaaacatgaactccagggctagacaacctggtcattcagctgctaaagcttataagctgtgggatgtgggctagttattgaatatttttcaatttcctcatcttaaaatggaaatactagcctcagcctcatagtgatgtcatggagattaaatacactagtaaatgtaaagctttttggatgttgtctaacaagtataatttatcatatgtatgtattgccttttataattattacattcaattcctatttgttgaataaattttttattttattatcaaagaaaagagaaagacaggaggacctaataagaaaactacctaagtgaagaactttgattgcatgtatttatctttctgacatcatttacactgctgggtgaaatggtaattatacaagaggtcagctcatgaaattgaaataagaggaagattagaaagctaggagcaaatccagaggaaagaacattattgctaatagtaaagagaagaaacttacagggagggaaaacagtatttctgtttaaaattcttagtatgactgtagaaactggtggatttgatacattaaaacagttttgagaaggtagtttggataaattaattctaataacctttggagagtgttggtttttctgtctacatatttagcagttatgcattgtctttacctcagagtatttgaagttgagtttacttactcgatagagaaataatgccattaggaatgaggcaaacagaatacctatagaaggcatccacaatggggtgcatattcttttgtgtatctgcattgatcttgcattctgcctatggtccctatttacctgtccatcatcaggagaaccacatgaccccactgtcttctgtgcgtattcttgcttctctcatatctttcttatgtcctcttagggcatctgcctggaattcttccctcaacaccacccttctttcactatttacagatcacaatccacactttggtttgtcaggaaacatacctaccccattcctccacttactcctagaaagatatagtttgcctacctggtgcttttcacatttatttgaattgtactgtaaaattagtatctatcttgtttgtttaactttaatgccaccaagggtagaaactattacagtttgctcagcactgcatcgcagtgcctggttgcttattgtaaaataaatgcgcgtgcacacacacacacacacacacacacacgctctgacacaaaataattgttgaatggttaagtgagatgatccatcaatctcccaaaaggccaaaggatttaatgactctaaaagtgttccatgacacagtagaaagaatagaaagttttggaatactggccacctcaaatgtgctgtgaactctaattggattctaaatttgacaataaacgtctagtcaggtgaggccacaaaaaataacctataaataatgacacattatataatttcaattgtttgacaattaaaattgtcaacaaaaacttttagttgcaaataaactcaagaagtggttatcacatggatatttgattaagggatttttgaaaggacaataaactctaaaaataaccatattataaaaatattgaaataccatttaaataagcaattcttaaactgaccttctagaagggcaaagaacataacatcaaatcaaatttcagagagtgcgtttttgtaaaggatggaataataatgtacagtcagacactttgttttctaatcatcttacttaattcagtgatagaacctggaaatactagatagacagcaaaaatgctcattaacctgtctcaatcaaatatcagatgtcttaaatgaatctttagtaggtgttgaatcagagccaagatataaatgaattttctttcagatatttgtaatgcgtttctgtagcacaaagagacatgtcctttagaatgtcagaaacgaaaatagaaaatgaccttggacttttagtgcaagtatttgactcaaatgcatattgtgcatcattacagagccagtgatgaacctgagaatggcttctaactttcctaggaatcacacacttgggcacagtgtctgtttttccagaatttatgttaataatttcaggtatattgataataacttttaaatgcaaacatttttactaataacatctatatacaccaatagtttttcacaagtcaaagccatgtcatgtataacaggtaattacaagagaacatgtttattttcaagcgaagatcatgtaactttaaaatttacttttcaatactgtgaaataattacgtttcctttataaaaatgaataatttgctttgcattattaataatgtattttgttgttatattccaataaagttaattaagtacaagtgcttaactcatagtaaataatagctgaaggagtacattttctttactcaactgcatgtaaatttcactataacataatttgctttctaaaaatattagaatatactgtttctgtcctagaaatttaagtgacttttacgtgaagtaccataaatattttcttacatttgttcaactatactatcacactatgggatgaaatctgaagttccagcaagactttagtaaaagcaacttattccaagaaaattatgtagttcaaataagtcataattatttaggcaatcaggaactatttttaatacaatatgaaattttgccagtaacttaaaggatagaaagtaggatgttgccatgtaaatatagagagaaaaaaaggggaaaagtgtaaaacacgtctgtgaagagtgtttattcaaagcacaggatattgtggagagtacaagtaattcaaaataattggaattgacggtatccaaattgtaaagtgtgcttggacagaaaggtgataccacatgagagatctttaaacatcaggctgagtgattgggttttgtttggagtcattgaaatgctttttatcattatacagccagggtacaggaaaccttcatgaagctatgagaatgtaaaaagtgtgctttttaaaaaaaacttattcttagctatacaagaaatactttctacatcaggaacagtttcttttttctttttgccagagaaacatgggaagtaacataatgttatatgtttggtcaccattttgcacacacaagcataaaatctttctttttcctgaatcgatgtaaacagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatgtaagttactttcctttgtattttcattaaaataactttgcatgctttgaaacatatgatttttcaataaagaccaaaatatatatgtagttcacatttcagtacttaatgcatagctttagaggaaatataggaatcattcagtcagttattggagacatctagtggaaattacaggatatttcacagtgctgtatatttcatcattttgatattgcttttcctgaaaatggtctttctttttttgcaacattgaactcaaaacacagtatcaactgaaaaatattaattatcagtaattggtcgatatcactttagattttttatttctttataatatttatgattatgtctcaaatatgtagtgtttacatttcttattcaaattgttttgttaggctattttacattttcataaactataaagagtattttaaatgcagtgaaatgtactaatatgctgtcttatcaaaatagtgtttattttctgtctggaagaaaggagcatgacaaggatagtttttaaaataaatttaaaaatgtacataaccacgtgagttttgggaaatgggagggctaatgtaagtcaagctttcacaaaaccctctggcactgatggatttaaaaataatttgtatacatgctatttaaaaaggagaacttaacatcattctcaataaatatttatgaagcatcaatattggagagctctgatgcttgaaaggacatagctgttcttagtggatgtatgagatattcttattgccaaaatatttctattggagcatgtctagtacattaatattgatagaatgcaatggtaactgtgaaacaagatgcattctcttatcgagaatgccttcaaaaagaaaatattttctcaagaatagacataagttatccatattattttacattttatagactgtgcttgtcaagaaattcatggaaagaccaatcagaaacttctaaaagaaaaaaggactgttgtggggttgggggagaggggagggatagcattaggagatatacctaatgctaaatgaggagttactgggtgcagcacaccagcatggcacatgtatacatatgtaactaacctgcacattgtgcacatgtaccctaaaacttaaagtataataataataaaaaggaaagaaattcccataataggataaaaagaaaacaaaaacaaaaacaaaaaaaaaaacacccactgatatatttgttaaactatacaattcctggatctgtaacaacctttttaaaactattcatacagttgttggaatttactaaacttcgtaactaaaagaaaaaaaaagaaaaaaggattatgaaaggcagtcaacaataaaaggcaacttgattctgacacaaattactgacttcatttgctgatattaggcagcttctaagaaagccactttatttccatcacactttctaaaaaaataaaaatggaaagcattgataatattgagaacacacaaaggaggaagtgatgccaataacttacttaacctttttcccttaataattttttctacttttttccattattacagtatatttctttttcagaccaacaacatcattagcaaattataaatactttacacttttacagtacatttgttatatttttaattaaaatttgtttatttaaaccaaaatttactttatgattttttttaatttttctaaatgtgaatctaaatgaagaaaaaaaaaacttaagcatgccaagatatgatttatatgagacctcctggcctcttccactgtcctacaaaagtgctaggctgctaggcaacatattatcttaatgaaactatatttaggacttttattctttgcatttcattaatattttaaaacatttgctgtatcataggattagtactaaatgtctgttgcaggtcctcagaaaagtggagtttatgagaaatgaacactatggatatttccaaagcacagtaaggcagagtggctcgtacaagatatgctagtattagaataataggactagctaatatgttaattaatagtgtgttatgtgtccctgagtcctcaatttccttagttataagataagagggtttaaagaagagactgttgggacctatttatactcaagcatttaaagatacttttattcaagcgtatccacattctccagagatgccctgggatttctgaattattgtccatgcatgacagcataggtatttgtgtgaaacaaatgaaaaccgaaattaagattataattcatatatgtttatgttgtaaaacctcactgaaaatagttttaaaaaccatactaggtccaccttaagcttcaggttttgtgctgagtgataatggacacaaagatgaataaaacatagctcctcctttattagaagtctaccatcaacaggagtttaaattaaaccgcagcatgtattcagatttcaaagtgagaatgaataaaatatcaaattaatgtaaaatgctaatacataattacatgagatttttagttattggttttagctgggtagaaaataatgggataaacaaacaactgtatattgcaatttgaattatttgctcttgtaatctattaataccatgaattaataactttaatacgaaaaaagtacattgggtactttatttttcaaggactgatttctaacaaagtacaagttgcttttgatcacattgcattccttctttataagtttaaatattggtttatgtttctgcttaattattccaaggtaaatgtgcagacttaagctcaccagaaaattatgtagtttagtttatcttatttaaacagggatgaaaggtcttgttttctaaaaggatgttttgagaattatttgagtatcccctgagattattattgccgccatcttgattagagggtagctagattaatatacattgaaaaaaattttcttactattaaactatcatgtaaatataactactttttgttttccctaagcattgattatttttctgcaaatattgttgaaaatgagttgaatggctcttataacacttgatcatttttcctttttttccaaaatgaaacattcaaatttattctacttgagtggggataattagaaaaataaatatcatctcttgttaagacattattcaaatatatttaagtacaataaaagcccatatataatgtaaaatatgagttttgacctatgtatacaccactaaatctataataatcatcaagataaacatttacatcaccctcaagaattttctcaagtcactttaaaatctatccctcctttttacaactatccctaggcatccatttatctacttttgatcactacaatttagtttacatttacatgtaagaatgtatatacatagagtcatgcagtattatttttaatttactttattatctttgaaatgtacttatttacttttatttagttatagttgacaaataaaaattgtatatatttaaggtgtacaaatgtgatgcttttaaaaatttatcattagtattatttttgattggccaacaataattgtatccatttatggggtacaatgtaatttttgttgtatgtatatagtgttaaatgattcagttaagctcattaacatgtccattacctcacctaccttttttatggtgagacatttaaaatttactcttagttactttgaaaagcacattattgactgtagtgatccagctatgcaataactctcaaaacctatttctcctgtctatctgcctgtctaccctttgatcaataactccccatttccttccttcccatgcacccaccccagcctctgctgacatcattttactctgtttctgtgagttaaactttataagcttccacagttaaggaagattatgaggtagttgtctttttgtgtttggcttatttaactgaacaccagtgtcctctagattcatccatgttgtgcaaatgacaagatttatcattttttaaatgctcaatagtattccactgtgtatctataccacatttcctttatcctttcattcattggtggacatttaggttgattccatatctaggctgttgtgaataatactgtcatgaacatgggactgcagatacctctaccaggtacagacttttttttttttcctttgggtataaacccagacaaaggattcctgaattataaggtggctctcattttctttttgggaggaacttttataccactttctatgatggccatgccaatttacattcccaacaagtgttcctttttatctacttcctcttcagtacttgttattgttcatctctttgaataaagccattctaatgaagtgatttttcactctggttttaatttgcattcccctaatgattagtgatgctgagcacttttttaggtacttgttggccatttgtatgtcttcttttgagaaatatcaattaaagataatttgcccattttaaaatcaggttgttttcttgatattgatttgcttgagttatttgtatattttgaatattaaccctctatcagatgtgtggtttgcaaatattttctcacattatttgaattgtctctgctgagctttcacagctggcatacattcgcatgtatatgtgtgcatcaataatttatactacttgttcctgttattacatcctacagatataacagagtttgtttatctagtacctattgatggacattttacgtgtttttagttattgactactatgacaaaaaacttctgcaaagatttttgcagattgtgtggatatataaatactattctctggaataaacatttttgtttgatttcttcaggtaaatttttcaaaagcaaagaattataattttgctgtcgtctagtttattaaatttatcaaactggacttttacatgttatacggttcgtgttttttctgaaaaaatattacctaatttaaggccatgacaatttatgtctaagctttctttttaaagttttgtagattttggttttaccttagggctgttattaattttgagttcatttttgtggagtaggtgttcattatttttccatgtttatttctagttgatcaagcactagttaatagaaaggacttttctttttctagctaagagtttgacaaagttgttgatcttttcagagtgttagctttccattttgttaattcatattttctataatatgtctgttttccagtttgatgattctggctttatcttcattatttcctttcttctatgtattttgaattcaccatgcacttagttgtagattttttaggtggaatcttagtatatgtattttagataattcttattttctaatagaatcacataactccagattttcactaagcagtgctttaacggaaccccccaatattgtagtatgttgcatttttgttgtgattcagctaaaaatataattttccatttgatttcaactttggctcatagttatgtacaagaatctgtttaactttcagatatttggatttttccttgatattttgctgttattgatttctaatttagttcagttgtgctcagaaaaccctgtattttttatttttatatgtataaagattttatttatatcccaccatattaactattttggtgaatagacgattttacttgaaaagcacatatattctgtagttgttattgtgttttaatgtcagttagatcaaggtaaattatggtatttgcactcatcaggattccttagagggacagaataagatatatatgtatatatatatatgagtttattaaagagtattaactcactccatcacaaggtgccacaataagccatctgcagcctgaggaccaagaaacccagtccgagtcccatagctgaagaacttgtccaatgttcgaggacaggaggcatccagcatggaagaaagatgtaggctgggcggctaggccagtctagtcttttcacgtttttctgcctgctttatattctggccatgttggcagctgattagatggtgcccacccagattaagggtgggtctgccttttccagtccactgactcaaatgttaatctcctttggcaacaccctggcagatacacccaagagcaatactttgcatccttcaatccagtcaagttgaccttcagtattaaccatcacagtattgtttaaaacttctatccttactgaatttttattatagctgtttgatcacattaagaggtattaaaatcttctaccatgactgtgaactattttttctctcttttctttgcattatgtattttgaggcttacaatgagacacataaacatttatactttgtgtgttgtgttactttcctgttgctgctgtaatcaattacaaaagacttagttgtataataaaacaaatttattgtcttaaccattttggaagtcagaggtctgaaatgattctcactgggctaaaatcatgtgtgggtcgggctgtgttcccttgtggaagctccagaaggattctgttttcttgttttttttttcagcttctctgaggctgcccacattccttgcctcatggattccttcctttctcagagcctgcaatggcagatctagtctttctcacatcatatcactctgactcttttttcttcttcacaagtccatctctgtctcaaactttccttgcaattaattgcatccacttggataattcaagataactttctcatgtcaacatctttaccttggtcgcagctggtaatgtgtttgcagtttccgaaggtaaaggtgtcagtatctttgggaggtcgttattctccctcccgtttgtgtctttatgaatatcccctttcatcagaattaaatacctctctttttctctgctgatctctcacttgacatatcttagctaataatcaaatatctacgctagccctcttatgctttttgtttgtataacactttccattcatttacttttaacctgtctgcatttttatgtgaaattaaaatgtgtctttttaggcagcatatgatagaatattgctttctcattgactgtaaatctccttataattggagtgtttaacaagcagtcagtaattaacagggtcagggaataaatattttactttttctgggctacatacagtctctgccatatttttttttctcttgtaaaccatgaaaaatgtaaagaccatcctcatctctgagtcacatataaaagaagcccttgggcaagactttgcccatgggctataatttgccatccactggtttaggctattaagtttaatgccattgttgttactatttcaattaggcctacaatttttatttatattctgttttttttcctatgtttttttcacattctatgcccatttttctgccttctattgagttattcgaagttttagtatttgattttaatttatatattggcaatatttttggtttttgttttgtttcattttgttttgttttaagcgattctataggaattttaaaatacaaacctacattttcaaagtttccttgaaatagacttgagttcatattttgacactttacataaaatgtgaaacattgcaaccatttggattccttacacacaccttatctaattatctttttgacatcatgcattacatctcaaatcattaaaaatcccatcaggaattaagatattttttcttttaagtagttacgcatattttaaagaactaaaaaaatattttatatgtattcatctatatgtggtttctttattcttccttcatttttgaagatcccaattttttttcatctgaagaagtttcttctccatttcttgtagagcagattttccagagataaattccattaatttatctttcatcaaatgtccactacacctcttccttcctatttctgaaggattgtttttctttgctcttgagaattctacattgacatttctttaagcatggggtttcactatcttctagtctcctctgttttcaaagagaaagccatataaattgacccattgttccctcatatgccatatatcattttatctaactgctttaaagctattttctttacctttgttatttatcaatttgattaggataagtctaagtattgttttctttgaattttcttatttggagtgtactgagcttctggaatgtggggatttatatttgtcaatatgcttgagccactatttctttctggccactatttctgcaatttttttgtgtgtgtaatctcttactaatctctggaactttacttacacatatgttataccctttgaaattgtttcacaggctcatgatatacttttcagttttatctatctcatttctcactgcccttccaattaggtaatgttctcttgtttcctcttcaagtcaactgactctttaccccatcatctcgtttctgctgttgagccaatagtgaagttttttgttttatttcaggtattttttttttttttttgagatggagtcttgctttgtcgcccaggctggagtgcaatggtgtgatctccgctcaccgcaaccttcacctcctgggttcaagcgattctcctgccccaaccttctgagtagctgggattacaggtgcgtgccaccatgcgaggctaattttgttttgttttgttttttgtatttttagtagagacggggtttcgccatgttggccaagctggtctcagactcctgacctcgtgatctgtctgtctcggcctcccaaagagctaggattacaggcgggagccactgcgactggcccaaatagtattttttttttttaagttctaaaatttcaatttgctccattttattctttctgtctttttactgaaaagtcctatagtttcatccatttcattttatctattttagaatatatacattttcttcacctcataaatgataagcaaagctgctctaaaatagttgctctaaaatctactatctgataaatttaacatctaggtcattttagtatttgcatgtgtttgttgtattgttcctttacaattcacctcactgtactggttgtcaaaaaatactgaattttgtcctggatattgtaaatattatgttgtgcattctctgtatctttagataaatatgtggggattttatttttcaaggagttaatcacctctaagttttgtgttccatcctgtcagcagtgactcaaacctcaagtgatttctcaaagcttttgctgtgctggtttgtgcgtgcagagctagggcataggctaaaatttctgtgggtttttacacagaattttgacatacccttctctgactcctagctgagattaccctcacactctccaacattatgtatgcttttttccaagatacctctgtccttctggacaagttttagttaccacgatcactttgaacctcttcaactagggcccgtcccctgggaaaagccttgagagaaaaacaaagaaaaaaaatggaagctagttttcatttcccatcacaatcttcctgatttttttcctcttgagaacccttggatagttgtttttgaaatttatttcatattattttcagagttctaaattcttattagtagtgaagatgtactatcttgggtttcagctgccattatataatgaaaaatctttatatattctacttctagtacaactttaaagcattaatatatttggtatgtctagtgtctggaaccaataacctacgtgttttagtttcagttttcagcagtatttttattatttttcttttttaaaatttatttttcacattgtttagagtattttacatcatatattctcaaaaacattatttttgtaatgtaagattgtttaaactacaaaatttaaaaaagtgtttaagtatcttttctttctgtcagtgtatcagtcctttggacagtcaattttgtttaatattttcttcattagcctggtgtttgttgacatgtttacatagagacaaaaactatcttcatgaaaactgtaataagtttactggtagatatataagtattttaaattttaatttgaaagatattataactttagctgaatttagagttatatgtttaaagtcttaaatagtatcctttaactataaaacgttatttctactcatatagaatgaatttcacataaagcaaaagaaaatctttaagatcactaaacaaattctcaaattttgtcatggattatatttacatattttattttattttttatttctattgaaagttttttttcttatggatctaacctatgcttgatgaatgccatttttagactggttattaatgtcttacatgtttgttataaattacttgtgagtctctagcagtctagtttcctttttgattaatctagattcttatagtatttctttacatacattcctgaaaatttattatttttcacaattaaagttactcatgaattccaggaaaataccaaatatattggaaatctacctcacgtttccaaacttttgctacatataagaataaatttttaactttagcatgatactgacttgctcatatatttgcctaacctcttcactattgtagatacaagattattaccttctaagtgacctataattaattgaaagaccaaatcatgtaaataatgtttaaagtagatgaatacgatgatagaaaattcacttatggtaaattatataaatatgctagtgaaagattgatgaatacttaagtagaaagtaatataattcttaatattaatttcattagttgctacagttcaggttttattttttgtaatagaaatagaaaaaatatcacgagatatatgtctacatttagtggggtattgggttagataaccatttggaatatgtaaccatgattgtaatttaaaatttagcctgtcctctcttttagttacactccttttaagcctgtatgattgtattatgaaagttgaaacttgtttttttttacgtttatgccaccactatttattaaatcttaattccctttatgtgaagattatgacacatttttagttgtatattgcaatcaaatgcccatgatatatgtggaagttgtctaataagtatattttttggcagttgaagcctggtttgttattagatattttatttcgcaacaaattcataatagtaataaaactcttagtaccttatgtgaaaggccacaaaaagctattgtcgtaattaaatatttacctattaataaagctcagaatacttttgttatgcatcatggccatcaaagttgtatggagacaaaaaattacaaagacattacacaatgttaaacacacacacacacacacacacacacacgcacacacacatacacacacacaattaccagaacagtcttataccacctgaaccaagcacctacagggtaatactgctaagagtgagtagaaaagagtcaaaccatttataatttgatagaagccgcatttactgtaatagcactaaacttaaggtgttagaaaattaagcctttttttgctcaaaacctcttttgtgtttcagcttaaacagatttcttggcattcttccagttcattttcaacatttccgaggcgttactttactaagaagcaggaattgaactaaacttccaatttctaaaacaaaggagaaaacaggcatgtgatatacagtttaatgcagtaagcactggttacatagtatgtttgattacaattagaatatcattaagttttgtgactaggtaatcattacatagtaactattaattagacttaattattttatgtataaatttaatttaacagttacatactaacaatgcatgctaagaaatattagaaattttcatttactttttttttctatttgagcttgctgcacctgcctttaattctccttagacataatggtgatttgtaaatgcattttctcctgtagtataaaagagagagttagcagtatcagatacattctaaggttatggttacattaaataatcccataacacagaatcatgttacttatttacatgctgtccatataattaatagatgtgtgctttattgagtaattcttatctcaaattctctgaatataacagtggatgtacattctctatatataaagtgattttactagcatgattggttagatgtataggatgaggtaaataagatgtgaacataatttaaacatataaagaagcttatttcagtaaacacttagaaattagaaaaattccttggtcatagcagacacacattttatatctgtgattaaaatcttgtcttatgaccctgacttttacactcaccatagtacatttaagccaatgaaactttaaagaagatggctcatttgcagacataaattggttctactgcctgcaactatttaggttttatgtccagtatggtaatttcaaggacagcaactgagaaaaatggaaagcatatctcttcatccagaagataaaaagaacagaccattaaaaaagaaaggtgaagagtcttttattgttaagctgtagatttttaacccaaactttatgtgagccccctgggaaaatgtgaaataccacattcttcatgtgtatagatactgtcgattgtcctcgttttataacattattgtctctctgacaggtgttatttgattcagatcagatcttgttaaaatgtatttcagagataatggtaagaaaatttttaaggaactttaggaaatattcaatccttgagatgataagccttagaagtgaacaaacagcaaacaaataaataaaaacatattttgtaactggatttatcactgcctgttggcgtctgtttaacagtcagaaatactaaagtctacttgaatcttacccttgctttctgtcctttctctggaatgaagaccttgccctgggaatcccagttctcactgggacaatgaatatcttagttcaagctgctgtactaaaatagcacagatagggtgggttaaacaacaaacatttatttctctaaatctaggggctataagttggagattaggatgctagcacggttgggtgactggtaagggccctctttttggttatgtactggcatggcctttacttggtgcgcacacacacatacacacacacacacacacacacacacacacacacaaatctggtgtccctttctctttttataagggcagtaatcccatcacaggtgtttcaccctcataacgtcacttaaacctaattgctccccaaaggccctacttccaaataccattactttgagggttaggaatttaacatagcaatttagggaggacacaagcattcagtgagctttctgggtttaacagagaagacacctcatggataggacaagtacagaatttccacagcgtgaggggacagcaagtcatctgccacaaggtcttagtgtatctttcaggatattcaagacaaaaaaaaaactcagtgaagtctgtaacagctcagtatgatgtgatctcagcctcacactgttcatatggatctaatcctaaaacattggttaattcatttaaattaccaagtttcaatttcccattttgtaaagtgaaagagacatatctatgaattaaggcatactgaggttagggttgtaattaaattttttcaacaatatgaatcagccgtatggtacacaccaagccctcttctaggattttagtgtatagaattgaataaagcaaacaaacacccctgctttcatggacattggcaagagaaaccaatgactttaaaaaataaagtagaaaaataatgtgggaaacagtgagaaagtctaaggaagaaaaaagtaaaacagtgcagtgagacacatcagtcagcttgccataataattatgcatcataaacacccaaaaacacagtgtcatacgataattatcacgttggaaactgctgatcaaagccaggtttgaataaggagcttggcttcaaacagcagtgcttgactcattggtatggatccagtaacacatataaccaggctgaagaggcaataagtacagagaggatatcatcttatggtgatggcagaagcacaagaaaacaagcccgacaacaaagacatatttaaagtgtttgttcacatcacatccaaaaatgtcatgtggctaagccaaacatcagttcatcagggtaatacactagccttctatttggaggtcttttggagtgaaattttgctaaacagtttaatccatatcagacatatatgcttgtgggtgaaattttaggtagataaagaaaatatggtaagagagggacctgctgcaaatgtaggaaaagtacattccaggcagagggaacaagggcagattattcaagcaagagcaattctaggaaattcaagaggcagcgcagaggctaatgttgctgaagctgaataagcaagggtcagagaggaggggaagatgaggccatgaagttaacaagctgccagatgttatagagatgtgctgtccagtccggcagccacttgttacatatggctatggagcactggaaatgctgccggtacaactgagcaactgaaattttgatttctttttactttaattaacttaaatttaaaatgtgatgctcgatttagttattggaaaacttttaagtagttttggaacaaattgagtatgtgaatctgtttattcggttgtacattatataaaatctaaatgcagaagaggctttcccaatacaaatctagtggcttatttgagatatgctgtaagtgtaaagtacacaacaggttttgaactcttagaacaaaaaataaaggatataaaatatctcactaactatatctcactaattttgttacttatttttaatttatatggatatgtattagttgtatgtatttaagggatccatgctacattctaatgcaagcaaaagtgtgtaatcctcaaatctgggtaactgggatatccctcacttcaaacagttatcatttctttgtgttgagaactgtacgagtctgttctcacgttgctaataaaagcataccgtagactggtcatttataaaagaaaaagatgtaatcaactcacagttccacatgggtggggggaagccttacaatcattgctgaaggcaaatgaggagcaaagtcatgtcttacatggtggcaggcaagagagtgtgtgcacgggaattccctttaaaaaagcatcagatgttatgagacttactcagtatcacaagaacagcactggaaagacccactcccatgattcagttacctcccaccaatccccttccatgacacatgggaattatggtagctacaattcaagatgagatttgagtagggacacagctaaaccatattgggaacattctaagtcttatagctattttgacatatacagtaagttattgttaactatagttgccctcttgtgctaccaatcactacgtcttattcctcctatctaactgcaattttgtacccattaaccaatctctcttcatttttccctgctcaatatcctttccagcctctggtaaccaccattctattcttcctccatgagatcagttttttcagctcccaaatataagtgagaacattgtcttttaccgcctgacttatttcactcagtgtcctctggtttcgtctatattgctgcaaataataagatttcattctcttttatggctgaataacattccattgtgtacgtgtctcacattttctttatccattcatgcactggtgaacacttaggttgattccatattatggctattattattattatgaggcggagtctcactctgttgccaggctatagtgcagtggcacgatcttggcttactgcaacctccacctctccggttcaagctattctcctgcctcagcctcccgagtagctgggactacagtcacgtgccaccatgcccagctaatttttgtatttttagtagcgacaggctttgaccatgttgaccaggatggtctctatctcttgacctcatgatccaccctcctcggcctcccaaagtgctgggattacaggtgcgagccaccgcgccacctggctattatttttttttatattgactacgtgttgaaattataccactgtaaatatattggcttgcattatgttattacaattaatttgacctttattctgtttctttttcagtatggctcttagaaaatttaacattgcataggtggctcccattgccattgtctatattagacagcactaatatagagctttataatatcaaggaggactttgaaaaggatgagaggccactggagagttctgatcggaggtacaagcagtcttctcagatcatattttaagtgaatgacctttgcttcagagctgagaatagactgaaaggggtacaaaggcagaagcaagggagggacaccagtagggagactattgcaagacatcaagtgcatttcatagtgttattgtaatttacatcaccttaacataaatgtatataactattagtgaacatcgttttaaaaagaacaaataacatattcagtatatattaattagaatggattacattaaagacaagaattgagtttgttatatatttttctttattcaaatcatttcaagaatttataaaaacaactcgactgtatttttaagaaatgcatgcaattctagaaagcaagagaaaaacattaatcacagggaaatattacattctaggtataatgtaaaattgtgcttttttatgctaaatgtatggtcaaaagagtaatgtgcctagttttaaaatagtattcacctttgtgaaaatatgcacacctatatttttctctaagtggtttccaacttgcttggataatcatcacatattgataagaaaaacaaacaatatttctgtaagttgtcttaaagttattcaagaagaaaatggtatttctgtatattcgtttaaaaacctttgattttagttattcaatttaataatatttagtcgagtgtggtagtgcatgcatgtaatcacacctcctcaggaggctgaggcaggaggatcatttgaacacagacgttcaagaccagcctgagcaatacagcaagaccccatctcaagtaataatagtaataatagaaataataataatatttattgtacaacactagaaatagactgttagtatttttcaaacatgcaaataattgaacatacttacaaatatttcaataagtctagggaaccggaatctacttatgtagaatagcttagaaagcatcataaattaacatacaacttaatgtgcttataagaaaatatgtgtcatagatagtatacaaatgagcaataagagaaaaaactctttgaaaggtaacatcatcacagtattttgaagtagaacctaaggaggagataatattgaatctgagtctaatacaacattaaaacaataatgatcagataataattaatctgaatcaaatgtgatattaaaacatacatgactaattcagattagtgtatttattcacatagatcccttcattgcaaatttacagctcaccaacactaacatgtcttctctctgctttagtattgtggacatgaaaaatttcctgcccttggaatgaagatgaaggcttaatcagagcaaatctcctctttaaatcattatttttagtactcttggtatctcagaattcttcacatgcaacagaatttgaaacattgctggttaggtacaagttattttatgataatcctctttgtttaaatgatctttgatgtttcttgggctgctaataattttgctaagattgtaagagcaattatcaatgagttcagtctaatgccaaaaaaaaattcttatttttaaaaaacttttaaattcaggggtacaagtactggtttgttacacaggtaaacctgagtcagagggtttgtgtgtctgtgtgtgtacagattatttcatcacccaggtattaagcctagtacctattagttatttttcctgatcctctccacctcccaccctccaccctttgatagttcccagtgtgtgttgttcccctgtatgtgtccatgtattctcatcatttaactccaacttataagtgagaacatgcaataattggttgtctgttcctaagttagtttgctaaggataatggccaccagatccatctatgtccctgcagaggacatgacatcattcttttttatggctacatagtattccgtggtgaacatgtaccacattttctttatccagtctatcattgatggacatttaggttgaatccatgtctttgctattgtgaatagtgctgcagtgaacatacaaatgaatgtgtctttatactagaatgatttacattcctttgggtatatacccagtaatgggattgctgagttgattggtatttctgtctttaggttttgaagaatccccacacagtcttccacaatggctgaactaatatacactgccaccaacagtgtaacagtgttcctttttctccacaacctagccagggtctgttgtttttgactttttaataatagtcattctcactgatgtgagatgggtatctcattgtggtttcgatttgcatttccctaatgatcagtgatattgagctttttatcaaatgattgttggccacatgtatgtcctcttttgagaagtgtctgttcatgttctttgcccactttttaatggggttggtttttttcttgtaaatttgtttaagtttcttagagatgctagatattagacctttatcaaatgcatagtttgcaaacattttcttccattctgtaggttgttttattactctgttgatagtttattttgctgtgctagaagctctttagtttaattataccccgtcaatttttccttttgttgcaattgcttttggcatcttcatcatgaaatctttgcccatgtctatgtcctgaatgatattatctaggttgccttccagggtttttatacttttgggatttacatataagtctttcatccatcttgagttaatttttgtatacagtataaggaaggggtccactttcagtcttctgcatatggctagccagttatcccagcaccatttattgaatagggaatccttttcccattgcttatttttgtcaagtttgttgaagatcaggtagttatagatgtgcattcttatttctgagttcccaattctgctccattggtctatatgtctgctcttgtatcagtaccatgctgttttggttattgtagccctgtagcttttctgtgattttttccagatagtataaaatgtttaatttctatgatgcaaatactagggcgatcaatgctaaaacggttgtcctgtacaattttttcttaccataccaaaattttttcttatgactgtttattttaattattttaagagatctttattaacctaataagtattggatatgtaaaatttaaagataatatcttaataaaccaagattttaattttatttggatatatgcaggtttgttttgaaaggcaaattctgaaaaaacaggcattatattatttatgaaacaacttgaatactgatatatctatatcaccagtaattcttcctttgataactcagaagtttttatgaaagaggttcatttaatctttgttttctaaatacataggtgaaattatacttaaaaatgatacagctattcatgaaaaattcaaatatataacataaccaatagaagacaaattagccattggaagtacagctacaatatttttattcatattttatgtatgatttgatgaaggaaagatattctgattagaaaaaggagaataatattagaaatatgaataattcaccttacttatcaaatttttcttatgaccagtaaatgttttatcatgaatgaaagtcaaattagagagaaagccagtatgtgctaagaagtcacatataggtattccttaataaaaattactcttgtgactcaaggatcataaaatatgctgagatgtatgcataacttggctgtttaaaattagaacaaaaactgcatatccagtgttatggttaactggaaataagcacacatctaatttagtattccacatagccattagaattcccatggtacatggactgaatccagttaattgtcatagctttttctacatatgacagaacacagagaactggatctatgaaatcattaattgaattaccctttaaatgtgccaaaagatatattagtttttactcccttggtagtttccctcagcataaatcaaatgagaaaatttaaatgactgaaaaaaaagaacagtgagtgttacaggttattttaaatgtgcagttagaccttagttaatttaaggggccagctttttttttttttttttttttttttttttttttttttgagacagagttgcgctctgttgcccaggctggactgcagtggtgcaatcttggctcactgcaagctccgcctcccgggttcacgccattctcctgcctcagcctccagagtagctgggactacaggtgcccgccaccacacccgctaattttttgtatttttagtagagacggggtttcactgtgttagccaggatggtctcgatctcctgacctcgtgatcctcctgcctcggcctcccaaagtgctgggccagcttctttacaaaataattataaaggtctaagaaagacaatctattacaatagatataacactggattgaagtccaaatttctgtgtctttagaaatatcaaacaaatgtgggtgtatttctcatcttcttttaaatggagtgatgacatctggaatacatacttatcctggttttcattcatccattttactgttattgactgaatagctacttatattcaggtgctgtagaagaactgtgaggcaagtaacattgttctttccctcattgaatgtataaattaggctggctgggtgtggtggctcacacctgtaatcccaacactttggcaggccgaggtaggtggatcacctgaagtcaggagttcgagaccagcctgggcaacatggcgaaaccccatctctattaagaatacaaaaaaaattagctgggcctggtggcgcatgcctataatcccagctcttgggaggctgaggtaggagaatcacttgaacctgggaagcagaggtgacaatgagatgagatcacgccactgaactcctggcccacagccgggacagcagagcaagactttgtctcaaagaaaaaaaaagaaaaataatttttaaattagggagatagaacatacatgggtacattaaaatgaaatatatcaaaggtggttaggttttgaccatactgccaaaagcagtctacaaattcaatgcaattctcatcaaaataacaccataattcttcacagaattagaaaaaataattctaaaattcatatgggaccacaaaagagccctcatagccaaagcaatactaagcagagagaacacatctggaggcaacacattacccaacttcaaactatactataaggctatagtcaacaaaacagcatggattaaatagacacacagtccaatggaacaaaatagagaactcagaaacaaagccaaatacttacagccaactgatctttgacaaagcaaacaaaaacgtaaagtggggaaaggacacccaattcaacaaacggtactgggataattggcaagccacaagtagaagaatgagactggatcctcatctctcaccttaaacaaaaatcaactcaagatagatcaaagacttaaatctaagtcctgaaaccataaaaatcctagaagataacatgggaaaaatcctctagacattggcttaggcaaaaacttcatgaccaagaacctaaaagcaaatgcaacaaaaacaaagataaatagatgggacttaattaagttaaaaaatttctctacagaaaaagaaataatcggccagtaaacagacaacccacagagaggaagagaatcttcacaaactgtgcatccgacaaaggactaatatcaagaatctacaaggaacccaaatcagcaagaaaaaaaaaaaaataccatcaataagtgggctaaggacatgaacaggcaattctcaaagaagatatacaaatgggcaacaaatatatgtaaaattctcaacattactaatgatcaaggaaatgccaatcaaaaccacaatgtgatacaacctccctcctgaaagaatggccataatcaaaaaaataaaaatacaatagtgttagcacatacatggtgaaagtggaacacttttagactgctggtggggatgtagactagtaacactgtcatgggatctttacagtgtcactttgccagccagaaacttctgtggctggtagtacctctgcttgggttttgcttgcttccactgggctcattctgcccactcagctcatgctattggcctagatcccatacccgccaagggtgaaccaggtggggagtggtgaggggtgtatcagtgggcgagtgcagggtccagccactgggcccagccaggcactccagctgctgtggtgggacaggcagctccaggtgccactccatgcaaggctgaaccaggtgtatctcaaggggcttccactgtgggcacaagcatctggaccaggggaatgcagtggtgcccgaaagctcagagacttcagggagtgaacagccccaaagatggtgttacatcacgccacagccctggcatggggagccccaaggtctaggctcccagaaggaccacagctcttctctccttctcattgcctgcaacgtggcaagtagggggcatgtttcagtcctgtttgtgttacagctctttcagtcccgccattctgcagatcctgagttcttgtctcatgtccaagaagaatgaggtatgcagacaagtggtgggttagcaaggaggaaagcagtttcattgagctacagaaaagctctcagtagaccctaagtgggtagctctatccactggcaggtcatcctgacatctgtccaactctggctgagtcggggttttatgggctcagagggaggaagtgctgattggtccatggttggccatgggtaggcctggaaaaagcaccagaagttatcactctgggccacgattccacccagaacttatagccctaactccaggcttcaggctctccttggcttgaaggtggaccctcagctttctgcccagaaggctgtctgcctcctgctgccatcaacatgttgtatatggcccccaggctgttcatgccaaggggtgcctataggcccctgctgagccacatttagtcttccctcagcctccctcctatgctcctaggtgcccaatgtccagagggggttgaggtagcaggggtctggtgtgtcagcacctccttgagtgtgcacacacctaggtgggatgggacggcacctgggctgggccacaactttgctccaaaatcggagcaggcaccaggaatggagagaggtcagggatgggagcaggcacttcccagcctttgggggaagggggagttcctcacctcctgagagcagagcgcgactgtgcggctgcacatgcaccagggagtgcagggctcccaccccacctactcggtaggaggcagggcttcttcctgttcctggcccctgccggctctgtggagtgcacaaacctggccagacctccccaactgcagctggcatcttcacagtggctgctccagatgggctgccactgccatcacaaccactatggaaaactgtgtggagattccttaaagaactaaaagtagatccactatttttccaacaatgccactactgggtcattatatgaaataaacacttgcacatgcatgtttatagcagcacaattagcaaatgcaaaaatatggaaccagcccaaatgtccattaatcaatgagtggataaagaaaatgtagtgtgtgcgtgaatactattcagccatatgaaggaacaaaataatggcatttgtagcagcctagttggatttggagaccattattctaagtgacgtaactcaggaatggaatgccaaacatcaaatgttcatactcataagtgggaactaagctatgaggatgcaaaggcataagaatgatacaatggactttggggactgaagggaaagggtgagagtagggtgagggataaaatattagacactgagtacagtgtatactgctcaggtgatgggtacaccaaaatcccacaaatcagcactaaataacttatccttagaaccaaacaccacctgttccccaaaaacctattgaaataaaaaattaaaattaaaaagaagaaaaaaggtgattaggcagattgagacagctagtacaaagcaccgaaagcacaaaagagttcgggatgattaaggtttaagaagaagagttaatttaaatgtatgcaaggtcacaaataagcctaggttattttatgtgaagctttgtaaagagtcataaaagtttggatttaaggagtgtgaataggatctttaaaaggttttaagcaggatagttacatttgcttaaagtagaaactggtaggtgagtaagtcagcaaggggcttctaaaactgaccaggtagtgactatgaactgggcaagagagctcatactaaatattgagagacatgaatgatatttctatatattgtgctttagtggtgagaaatcaatgacaaagcttttaaaattgacaccctattataaccaaatctaagttcagctgctcatcacttgaaagccaaacatgagagatgagagttggcaggaggaaaagcaggtttattctgagagccagcaaaccaagaaaatggtggactaaaatcccaaagtaccatattaagtcagtacaaatttcagcctctttttggttaagggcagggagggtgaagagatggggattaggatcaagaggtgaccaagggtggcagacatctgagtgtcagtgaggatccaatggggttggaaaattttgtctttggtcaagtcacaatgcttccataaatatttaatgagaaatatggttaatttgtacatacttttcctttaactccagaattcgttttgaaaattatgattgctgtccttgcgtattatgagcgttattaaattattctagcctccatgtaagaatggataaaggctccttaaacaaaaatggagttagttatgacagttcttttgctgtttcactgttacactattacatgtgaaaataactctttctgttatttgtagttcttaaaatataatattaaaaaggacatttgaaaattgtttgccacagagtattatgactggaaaagaggaagatatttcactctagtatgtgaatgctttgaagagtatgtaggacataatctacaatacaatcataatacagttttacaaggatgatgcctattcttattctcatcaatatgatttttaaaaacttatttttattataaattatttccctagtaatgccttttcaatttgatttagaaaatggattgtatatcgtgagttttatagtgagttacctggttctaatattcatgacctagtggaaattcaggtcaaagacttgtatatttcagttcccagagcctgtgttatgctttattatcagcttcaccctgctcagacacaggcagaattcagtaatgcaggccagcactgagcaagaaataagacttttcttaggtcacagttaccaaccacaaataaactaggctcagagaaaatatttcagagccaaaggaggaattacaaaagaaagtagaaagcttgcattaagcaagtaatcaagtcaagaaatctcatactgcaggagaatgcagtgatcagtactgactccaagttcacctctaaatctcagaataagaaaaaaaagaggcagggagggggcatttatcaaaacaagtataacttggtaccaagtccaaagacatgctttaaattgacaccctattatagtttctttggtgtctcctagtatggaaaggattgggctggaaataagcttgtcctgaatgaaacattgaggaaggtgacacattcagatgctggcatatgttactgtttcatgtgatgctggcaatgtaatgtcagagattcagtcaagggcatggatttaagaataaatgttctaggtcagacttctgcctgtacagctgccatttaattaaatctaaataatttatcattagggatcatttcattgtgataacagctaaaagagcatagttccttgtttttaatgtctgtagacacattacatcttgtttgcagtattccttttcttatggtctatatagtaatgcacaatttttattaattatatacttattaagaagattttggagtcttaagataatacatttaccaccaaggactactgcattatttaccctcatgtagtctctttttgtctgtttgaaagatattcacttattaaaatatttaccaaaaacttttttttttttttttgagatggagtcgcccaggctggagtgcactgatgcaatcttggctcactgcaacctccatctcctaggttcaagtgattctcatgcctcagcctcccaagtagcagggatcaaaggcaccttattgtacaaacatatgcgtatcaatgcctgcatttgtatgtagtaaactacaccagaggcttttataaacatgaaataattattatcccaagtggcttacatagttctttagaaaggcaaatgccaccttttatatggactagtgctactttatgtatcctaaaagtaatatgcatgtttattttttaaatttgtcccagggtaattttaaagaaatcttagaggttaaggaatttgggaagaatttatctagttcaactcctaaattctttaaagaaaagaaaaaaaggccaaacttaaaagcagaaactcaaggtcacatcttttctacttgacagagttggcactcaattttgattgcaagctcaatgctatttccaatacaaaattttgcttatgagcaccagccacaaattttattttgttttcatccactattctctgtgtgtatgtgtgtgcacatctccagacctttttaatttagttgtatatatttatgggtcacagtgtgatattttcatatatgtctaacagtgtggaatgtttaaattcttcacctcacatactcagcctttttcgtggtgagaacatttgaaatgtactgtcttagcaatttttaaacacatgatacactaactgttgtcatcttattgggtaatacatctcaaaaacttacttctgttgtctaactgaatctttgaatcccttggccaacatctttctattcctcttaccaccataacctctggtaaccaccaacctactgtccttttctatgaatttgactgttttttattccacatgtataaattagattatgcagtatttgtgtttctgtgcctggtttatttcacttaagataacatcctccagattcattcatgtcattgaaaatgtcagaatttccttctattttcattttgtatatatactatgtgttttgtatccattcatctactgatgcacattttaatctgatttcatgtcttgactattgtgaataatgctgcaattaatataggagtatggatatcttttctacatactaattgaagttcctttggacatatactcacaagtaggataactggataatatggtaattgttgcaggaagtcagggaccctgaacagagggaccggctggagctgcagcagaggaaacaaattgtgaagatttcatggacatttatcacttccctaataatactcataatttcttatgcctgtcttactttaatctcttaatcctgttatcttcgtaagctgaggatgtaagtcacctcaggaccctgtgatgattgcgttaactgtacaaattgattgtaaaacatatgtgtttgaacaatatgaaatgagtgcaccttgaaaatgaacagaataacagcgattttagggaacaagggaagacaacagtaaggtctgactgcctgcagggttgggcaaaaacagccatatttttcttcttgcagaaagcctataaacggacatgcaagtaggagagatatggctaaattcttttcctagcaaggaatataatattaagaccctaggaaaagaattgcattcctggggggaggtctataaacggccactctgtgagtgtctatcctatgtggttgagataaggactgagataggccctggagtcctgcagtaccctcaggctgactaggattgggaaaccccagccctggtaaatttgaggtcagactggttctctgctctcaaaccctgttttctgttaagatgtttatcaagacaatacgtgcaatgctgaacatagacccttatcaggagtttctgattttgccctggtcctgtttcctcaaaagcatgtgatctttgctctgctttttgcctcttgaagcatgtgacctactccctgtttgtacactccctccccttttgaaatccctaataaaaacttgctggttttgtggctcaggtgggcatcatggacctaccgatatgagatgtcacccctagtggcccagctgtaaaattcctctctttgtactctttctctttatttctcagagtggctgacacttagggaaaatataaagaacctacactgaaatattgggggtgggttcccctgataggtagttccgtttttaattttttgagaaacctccatacagtttttcataatacatgtactaattgacattcccaccaaaagcatataagggttatcttttctctgcatccttgacaataattaccttctgggttttttgtaatagcctttgtaactgatgtgagtttatatcttcttatggctttaatttgcatcttcttaatgattagtgatgtggaacattttttaaaatacctgttggccacttatttaccttcttttgggctaattcagttcctttgcccattttaaaatcagattatgtgttttttttgctattgaattttctccagattcttgttgtaagacttgtgacaagttgtgagaagcactatgcctgggacattttaactgctcacaaaatagtagagatttaagttaatgttcttctgggaatctttctctgggttgcagttatataacaatatatttatttacttttgcatctgcctcatccactagaatgtttcctgttgagatgaataccttgcatttaaacagtaatttgcatgaaataaactaccagtgataatttgggacagtggttgccctcccagagctgcagatggaaaatctttaagattaaggttgagacattcatctttttcctccacaaactctcaatgtgccagttaatactcagggaagaaaaacttttatacccaaacagttgtgtccagcatctgctaaatggcttactattcatagacataaattttgatattattttgaattattagtgtacaatcaaatatatcattctgatttggaggattttaacattttatttggcaaggcaacccatgatggcagtatatcatgaagaagttaaattccttcaacatctttttgaaagtgaaggtagaataaatgtacaaataggtaaatattagtttgaaatcaaaacaaataaaaccaaaacataaataaaatgttaattattcaccatacgttatggagtatgattaattctaaacaagttattgtagcattgaaatatgtgaaaatatagaatgtatgagctctgtcattaaaatatgagttcaatttagaaatttaaataaaaataaagtcactatttaaggggtcaggcttaatatatggtatcataatactgttaaaatttaatatgaattttgccctctttatgataaaaataattgatgttgttttatgctttcaagtgtcttactacatatggagtgtcttgacatttttaaaaatggaaataaagcctctttcaattttaatttcaaataattatgcctctcaacaaataaaatagataactcaatatttcccctgatgtgaggcatacgtgtttactgtagagtgaatatatgtgtgtaaacaatatcaacatatgtcaatatattgtatgtatatgtgtacaatatggtttggctgtgtccccacccaaatctcatcttgaattgtagctcccataattcccacgtgttgtgggagggacccagcagagcataattgaatcacagggtagtgaataagtctcacgagagctgatggttttataaggggtttccccttttgcttggctctcattctgtcttgtctgcagccagggaagatgtgcctttcacttccccttctgccacgactgtgaggcctcaacagccaagtgaaactgcgagtttatgaaacttctttttcttcataaattacccagttttgaatgtctttatcagcaacatgaaaacgaactaatacagtatatatttgtgtatatgagtgtatatatgtatatatagtatgtatgtgtatataccgtatatcaatatatgtcagtatatctatatatacacaatatatgccattaaatgtatatttgtatacatgagagtgaatatgtatatattcatatgtgtgtttacacatacccactcgtatgtacatatatgtatatattcactcatatatacatatatacatatgtgcacacactttacagaagtgaaagtaaagttgcttttttacaaaagcaactttacaatagtaaagcctacataattatttgaaattaaaactctaagggtttttattttcatttttaaaaatttaaagagactccacatgtagtaacgcattttacatttttaaagccatacatatggctttccaaaagtttgtaactttaccgggactgaaaaacatcaaaattagaatacactattgaggaaagtacagtataacaaatatattattattatacttactatttttagactatcaagatatttttgcagtcatgtttagtatttttgttatttatttatggtataattactaacaagactcttttagtttttatgtttcagaatattgatttaatagaggctgaatattctcaatgaaaaaaatgtgaaaaaagcatacacaatatgcctactgccaaacacgttagtattaacaatgatgggagcattgtaatatattttaacctcttaatgcctcagcagagacttgggaagaggtaacaacctaatttcttcataaatgtcctaattgaaagttgattatagaacctaactttggcgaggtccagatgcatattcctgatgtaaaattatacagtaaaagtattttaaaataaaaagtataatttaaaaagtgtctttaaaatcaattattatatttgaagacgttagtaagtatacttatttgggtattctttcttgagatgtcaaatgacattttccattattttaggcaaatatgttttaatgcagaagtttacttgttatgatcaagggcaaaagttctatgaatcaatttatttgtaatttcttaatcacaactgtgctagggagtacaattttgaaattcacctttgaaatccaaatcttgtctgtaaacaatattgcaacaaattttctacactagtttaacaatatttcttattaattcaaaatggaaggcattttaacatttctaaactacaatctagggaatcttctttgactttctgataatgaagcaagtgattaacttacctgcccattcataattttaaattaactgtagctttttattttaactctcatatttcaaatatacaaattttaccaaaagtaacccactatctcttattactgatgcatctgcttcacatctgtctctctcattctctctttaagaaagggaatcaagctttctttttaaacaccttcttggggttaccctcattcgtcaaacagaaattattccgagacctgttaaaaactgtaaggaagactagtcattattactaacacaatagtgctcaagactattgcaatagaagagagagattgagctcaaagccaaatacaaggacaagttggaatgtacagccaatgagtagagtgagagatggcagtggatgaaaagttattaagagggacctggtaaacttcagaggtaatgactttcttggtaacctggcctaacagggtccttgctaaagacaggccaaagacttagaccacaattgtgttgaatgaagaacttggtcagatagcaagagtgatcagaaatcaagggtgcgggaactcttataaatggatttggcaggattctttgctactggcaagccagggacagtgccaaggtcaaggcctagttgaaaagtgggctaagaagaacctgactaaagtttgatcaaagagggtgtctgtgtcactttcttgattgtcactggcactggaggctttcagaaaggagatctttttctccacctccagtgaatgacatacttccatcttttcactattcaaatttatcttaacttttttctactctgctcagataaaaattaattcttccaataaagtcacttcttttcattataatttgtagaatcatattttgatttggactttgataagattgatggacacataactccttaagatatgcttccataacttcatatttcatgtagtcaggaattaattgggcacaaatcctaagccaaaaaaatgcaagttcaagataaaaatgtttccatgcctattgccttttttctttcatatatatgtgaaagaatatagcataggcaaaagtatctttccacttctgcttatgctatattcttttctcctttttcccctgtatgtgtttctctaaccaccagtgtttatttcctctgtacatttgaaacctttcatgatgtaaagggccttcctgattttgaaaatgactatttttggtacaccaacatgacatatggctacattcttcagccacttcagatggtgctatgcaagagtcacatccctcataccacactggcccagtaccaagttgttaattgcattgacatgctaatcttgtgccagtgaatatcgctgccttgctactgtattgatatttacaaagcatatcctgtatagacatttagtttctgttttattatagaccggcgttatcaatattttcttgcttgataccacaaatacattttttaatgtggctttcagtatagcatgtattgcctgtagcaagtattgcattcaacactgataattctgagtaaaattcacactgagatcatcaggcaagcaattagtggcaattgctttctgttatggaaaacaacaaatcttaccctcagtatatagttaaattacactattaaaatacactacatgcagatgccacattgtggacagagtgtgactgcaagtcagctattaatgtttccattaggatgtatgaatttcttattggattgagtttatttgtaactatattttccttaaacctctccgtgaaatagtataatgttaaataagttatattttacataccttaacagttgtaaataaatttaaagatatagatatagacgtatgaatttcttgttggattgagtttatttgtaattatattttccttaatcctctccaagaaatagtataatgctaaataaattattttacataccttaagggttgtaaataaagatatagacgtaaacttagtttttgactttgaatatcaagaaatttggcttctcttatagttgttcctttaatcagttgtgtgttcttagattcttcatgtccctggctttttcaatttagttgaactgttgaattaaaatttatttgactatttaatttccagtcaattcaatgtacagtttaaaaaacactgtgtaagccattagataaataattgtgactgagatacattctgacccccaaatggacatcatttggtgtagaaacgatcaaatagatgcttccattgcctaatgaccatgatgagggaaatcacagaatgctgtgggtgcacaatttaggccacctcatctagaactgaagagtgtggaaaggctgtgtttagaaagtgaggagcttacttttgaactcagtcagttgaagggaagggcaggtatatgccgagctaatggaaagccataggcaaatgtatctgtgtaatatttagcacacctaagtacaaagatgtaccaccatttatgggatgttaagttgttttcagtttttgttattaaaataatagtgcattaaaagtcctttaaataaacttttataatatttataattattttctctggatacatactggattgcagaatcaagattataaagctgttttatcttcctgagaattgtttcaattatattccctttaataatagatgataggattcacagcaccaaaatgtttcaaaccctgaaaattataattttatttctgtatttgattgggcatataatagacgttggttaaaatagccctatattgatatctgagccctaaaacttattgtgggaatgagcttggcatctcttaactcagatcccttttccatagaacagagattattccttccttacaaggttattaaaaatattaaatataataaagtatataaacaacttaccttcatatagaaatgattcagtaagcatttcagacttgtatgtgagattgtcattaaaaacattcattaaagtaaaataggacaaggacttctaaatgattacttctgcatttgtactacagataagttacatatctgatatttatataattagtagatataacaaaactggatattgcttttttaagtagtttgcagtaataaaatatttaaaagttaaatgacttaaattgataatttttgatgtgatattaagttctaagtagttaatattagtaacaataatcagcataaatatgagcaaaattttagctacagcttacttgagaattatgctttcatgtaaaaataattataaaatcttctcaaataattatgcaggcaggaaattgagaggttacaatatttggcatttgatttagatcgtagtcctggggtggaggaagagtgaaaacaacatttgtatgttttcacatttagatttttaaataaaattatacattgttttctcttaacttctgtgatagagatctagaatacagacctgaaaaaattgatagggaatcgtaagaataggaactggttacttttcaaattaattattgttgattaatttatgacatctgtggtttagtaaaaatgggaaatatggatactttagggaaaaaatgtttagttatgttgttgccattccaacttagatttcatacctgagtcttcaaaataatttatagaaaaagtgactatgacttaaacgaaataaaaagtgaggaaagaaccatttattagattttatcctaaactctcactttatagtttgttccagaaatagtttctacacaagtagatagtcattaacatagtcaatatgtattttttgtcagattagtaagagcaaatttaactctggttctcttatattttaataattggtaatttatgagtgtatgttaatcctattaaattatgtgataaaagtattcaaatgacatatattttcgtgagttctgatgcactgtgttaaatacacaaaattaggctgggagcggtggctcacgcctgtaattccagcactttgggagtctgaggcgggcggatctcgaggtcaggagatcgagaatcacgaggtcaggagatcgagaccatcctggctaacacagtgaaaccccgtctctactaaaaatacaaaagattagcctggcttggtggcgggcacctgtagtcccagctactcagaaggctgaagcaggagaatggcatcaacccaggaggcggagcttgcagtgagcggagattgcaccactgcactccagcctgggcgacagggcgagactccgtctcaaaaagaaaaaaaaaaaatacacgaaattagaattatgtggcttctttttatacagtagaaataactaatgcttatactacttaaatgattatttaacttaaagaaaatgcctataattattttattatattgtattacagatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagaggtaagtccacatgtatacatcaataaattgtattattttaacaactatctactatttcagaatatatttaaatatcttcatatgcatatatatatataataagagagagaaatcatggtgtatatattttacagttatttacttaaaggtccatggctcattaatgatgagtgtatgaatgtctattcacttatatagcaatgtggctatatagcaaagaccattatttttataaatgcacttttaggaataaaaacaattatatggccgggcgcagtggctcactcctgtaatcccagcactttgggaggctgaggagggcagatcacaaggtcaggagactgagaccgtcctggccaacatggtgaaaccctgtctctactaaaaatacaaaaattagctgggtgtggtggtgtgtgcctatagccccagctactcaggaggctgaggcaggagaatcacttgaacttgggaggtggaggttgcagtgagccgagatcacgccactgcactccagcctggtgacagagcgagactccgtcttaaaaaaaaaaatatatatatatatatacacacatatatatatgtgtgtgtgtatatatatatatatacacacacatatatatatgtgtgtatatatatacatatatatgtgtatatatatatacatatatatgtgtatatatatatacacatatatatgtgtatatatatatacacatatatatgtgtatatatacatatatatacatatatgtgtgtatatatatatacatatatatgtatatatatacacacatatatgtatatatatatacacatatatatgtatatatatatacatatatatatggaaaatctaggaagaaaaaattggtaatgtaatagttattgagggataaaaatttttccatatatatatatatggaaaaatctaggaagaaaaaattggtaatgtaatagttattgagggctaaaaatttgtcttcaatgttgatgttttcattgattccatgtggtatagcttttttttcttttcagtctggcaggtataaatgctatctgttggctagatttttacaattctagtgtaaattccaaaataaatgaaatttacttgttcagtatcttttgttttattactaaaaataagattttgtataattatttttatattgccaagtaattggcctttaaatactgtctgaataaagtgcctcttatttattaattggagtgtatgtgtgtatcaatttccgaaacataaaaaaatctatgaaaatgatcatcaccctttccaaattatgatgcggttaggaaaattgggaatctttttcacacagccttatttgctgaaaggttgctacattttattcactaattcagtttgcataagctaaaatgaaatgcacgttttagaataccgtctaatatccatactgccttaacttaaaatgtcctcattgatgccatttagactttaaaaaaattcgtttgataggaggatttagccatcatgtctgcaaatacttgcatagctggctggttggtaattaaaccgctatgtctaaatcaatttcaatataaataagtttctttggaaatattttagaagaattagctatttgtgacttgacagggatgtcaatttcataaaaacatctggacagttttaatctaaattttatgtgttttaccttagtgaaaagctcaggttagatttaacttgttttgtgtagtgtgtagtctccttgaatactttaataaaatactatagacaggatggttgaaatcacagaaatttgttctgagttctggaggatagaggttcaatatcatggtgcctgccaggttgctttctatagaggactcttccctggacttgtacttggccgccttcttgctgtgtcctcacatgccctttcctctgtgcgcacacagagttctggtgtcttccttttcttgtaaggataccagtcctgttggattaggtcccactcttattacctcgtttaaccttaattaccttcttaaagatcctatctccaaattcattcacaccggaatttagggtttcagtatatgaatgggcagagtgaggaggcgggcagttcagtccatagaaagtagattgaatttcgtgagtaaatgacagactaatgtgtaatttctgctttacttcatcttgacattttttagttcctcagccaactcataattctctatatttaatgtgaagggacattttatacatacaacatagtatatagtgtatgctatttaaacttctgcctaaagacatccctctgcactccaaaataaaattttaaaaaacccacaatttttgcctacttgacacacagccaggtgatctgttggctaaaccactgactttaaacagacatgtttatgtgtatactctcacaaattaaatttaaattctgaatgaaaaatataaatgtgtgattaacacaacttgaaaacatagcataacaaaataacaataatataaagagaaagcaacaatgagcattactaatatttaattattagtatatacagttgcttgagacagttacttttgtttagtaattattgtaaaagtcatatatgtgctaattctttagaatataaaaggaaatataggaaaagtttacacttaacaagttgtcagtaataaatttattgaattgttttaaagattttttctttaagtatatatattcaaacttttaaaattgtgtgttttaaaacataaccaaatattcaataaattatttaagttactgccaataaatgcctctgtaatctgtaaaggtcaaggtcatcaaaactttatttttttaactgaccacatcctgaggaaattacaaaacttttcaatatgtgggcaaacattgaaagaaggattggttttaataggtttgttagaataatattgtgctttgcattgtctgtatctttgtttcatatcctaaataggggtgcttactgttgtgtccatgactttcttatcatggaatacatagaagaaataaatatttttaggtttaagaaaaagactagcaagcttcttgattaatattatacacttagcttatatttagatattcaaaactatatttgttagttcactatactctgtccaaacctaatatcattaattaatatcagcatttttagctggatacagatataccttggagatattgcaggtttagttccaagagcacctcaataaagtaaatatctctataaagccagtcacacaaatttttgcttttttcagtgcatataaaagttatgttggcactatagtctattaagtgtgcaaaagcatgatgtataaaaaggtctacataacataactgaaaaataattactaaaattttctgggaataatttgagatttaagcaagttgtaacttttttcattggtgaagcgttttgtcgcaaggttgatggctgcttactgatcagaatgttgattgctgaaggttggagtggctgtggcagtttattaaaataaggcaacagtgaagcactttgttaattaacacttcctttcatgaaagatctctgtgtagcaggtgatgctataaggctaacagcatataatactgtttgttaggaattacctatagcagaacatctttcaaaaatgaagtaaatcctctcaaaccctgtcaccgctttatcaactaagtttatgtaatattctaaatctttggttatcatttcaacatttttcaggcatcttcagcaggagtaaattctaccaccagaaaccactttatttgctcctccatgaagagcaattttcccatctgttagagttttatcatcagattgcagcaattcattcacttcttcaggctccatttctaattctagctctctatttccaccgcatctgcagttacttccttcactgaagtcttgaacccctcaaagtcatccatgagggttggaatcaacttcttccaaattcttattaatgttgatattttcactttctcccatgagtcacaaatattcttaatggcgtcagcatggtgaatccttttcagaagattttcagttgacttttcccagatccgtcagaggaatcactgttttatggcagctgaagccttaaatattgtatttctgttttttgttgtgtgttttttttttttttttgagagggagtctcgctctgtcgcccaggctggagtgcaatggcacgatctccactcactgcacctccgcttcccgggttcacaccattctcctgcctcaccctcccgagtagctgggattacaggtgcctgccaccacgcccggctatttttttgtatttttagttgagacggagtttcacggtgttaaccaggatggtctccatctcctgacctcgtgatccgcctgcctcggcctcccaaagtgctgggattacaggcgtgagccaccgcgcccggccacaaattgtatttcttaagtactaggacttgaaagttgaaattactccttgatccacaggcttcagaatggatgttgggttagccagcatgaaaacaacattaatatctttgtatatgtctatcagagctcttgggtgactaggtacattgtcaatgagcacgactagtttgaagggaatcttttttttttttttctcagcactatatctcaacagtgggcttaaaatattcaataaaccaggctgtaaacagatgttctgtcaaccaggcttagttttcccatggatagaacacaggcagagtcgatttagcataattcttaaagaccctaggattttcataacgataaatgaatgaacaatggcttgaacttaagtcactagctgtattggcccctaacaagagattcaacaggtccttggaagtttgaaccctgccctttacatctcctctctagctataaaagtctagatggcatcttcttgcaatagaaaactgtttcatctactttaaattctattttttagtgtagtcaattccatcaatgatcttagcttgatcttttttttttttttttttttttttttgagacagggtcttgctctgtcgcccaggctgtgtagtggcgcgatctcggctcagtgcaagctctgcctcccgggttcacaccgttctcctgcctcagcctcccgagtagctgggactacaggcgccggccaccacgcccggctaattttttgtacttttagtagagacagggtttcaccgtgttagccaggatgatctcgatctcctgacctcgtgatctgcccgcctcggcctcccaaagtggtgggattacaggcgtgagccacctcgcccggcccttagcttgatcttctggataacatgctgcagcttctacatcagcacttgctgctccaccttgtatttttatgttataaagatggcttcttcccttaagcctcatgaactaacccctgccagcttcaaactcttcttctgcaccttcctcacctctgtcagccttcattgaattgaggcatgttagatctttgctctggcttgggctttggcttaagggagtattgtggttggctttgtcttctatccaggccaacaaaatatttctccataacatgagtaaggctgtttagctttcttatcatttgtgagtccactagcgtagtactttagatttttttcaggaactctctcttcacatttaccacttggctgtttgttgcaataggcttctgttttagcctatcttggttttgtcatgccttcctcactaagcttcatcatgtttagcttttgatttaatgtgggagatgtgtgactcttcctttaacatgaacacctagagaccattgtaggattatgatttggcctaattttaatattattgtgtctcacagaataaggaagccaaagagggagagagatgagggtacggccagtcagtggagcaatcagaacacacatttatcaattaagttcactgtcttaggggcacagtttgtggttctccaaaacagttacaatagtaccatcaaagattactgatcacagatcaccatagcaaatttaataataatgcaaagtttaaaatattgagagaattaccaaaaagtcagagagacaggacatgggcaactgttgttgaaaaaatggtgctgttagattgcttaatgcaggattgctacaaaccttcaatttgtgaaaaaaaaaaagaaaagaaaaaagaaaaacactatctttcaagcatggcaaagtaagacacaataaaacaggtatgcctatatttaaatatgaagaaatagttttatcagtagatgtttctagtagatgtttatcagtgggtgtttatcagtagatgtttcttgattaatattttcaatgctttgcacattttaaacatttaaatatttttacttaatggtctataatataccctcgttatattatcttatattttcataaaattatataacatttcattgtgctgggtttaagtgtaaaaccactattggactttagttttatgttgctttcctagaatacatcaaataagcttcagggtacatgatttggccagattatatctagagcatgtgtgtggatgtgtgtgtgtgtgtcttaatctatgtcgtgatgggtgttttctttatttattaagcatacaacatgataaaaggttgcttatttaagatgaacttttatctgttgatagctgaactcccaggaacaacaacaaaaaaatgaattgagcttttaagaaattgttccaatgaaaatggctctatttaaattattaatcttaaggagctgtgtaatagtcacatttctttgttgtggctatcctgtcttggcattatattgattcaataaacacattcttctctgttgaatttgcaaataactttctcatatgcatgtagaataagaattttttgttaaatctctttctcattagaacaattagtttagagttaaattagccttgcttattaaaagctacacataaggaaaatgaatattttaatcacttagcagtaattatgtaagagctgttacaaattctaagcttattcctatgatctgtttctagatggacagctgactagaaaacgaatgacacagcttttctgtactctttcagaattatcatcttcaatgggcctcaaaattgcactcttagttaatagcctcccattactacaaaatcatttttccctcttttgggatagagttgaaattaacagcaactcttgtaggcatattctctcttaataatagttacagagattgaaaattatatctattactatcatcaaatctcttatctaaattgatacttcagaatttctgtacattagaattacagggtttgtctcagtgttcaccaatagaatccccgaaggttaacttaattatggatttcaaatgtttaaggatagaggtcagctattttctacctagagtgaaaaagaatggtaggaattgaacagaaatggaagcaagatactgttattagatagcgagaaaaagtgcctgtctatgagtattgttgcaaagagtaacattttattgcacagtatgttcctggaaagatttcattaagaatgatccttcctccttcgttagtattatatgttcaataaactcaaaacagggagagaaatatcacatatctggagactttgttgaacattaaagcaaactgatctgaggccaaaacataaaaaacagttaacaatgcttttattacaagcttcctgttttcaagtttacacctacattgattgcaaactatagatacatatatatatacatgtatacataaatatatacacatatatatttcaaactgtgtactactttctgagctttacatatatgtagatataatggttatgctatttaatagatacatcgaagtggtgccatttgtttacttaatgaattaatagataaattctgatttgcctagtcctgtggatattacgggctcatggatacatcataaaaggatttatattatttagtaatgcttacttaataaagaaaattaaaaatatatggtaaggagttgttgggtaaaaaatgaaatgtgtgaaagtggtagtcatactggggtttattataaaacttctgtgatgttttagaattgtaacatttgttattataattatttcagattgcacctacatctgacaatgactttggacgctataattgcacagccactaatcatataggaacaagatttcaagaatatattcttgctttggctggtaagtatagcacaataatttttgagatcgcacacaatatttctgagagcaaatgaaaatttaagttgataaagtggtctcatttacatgtgggatttaaaacaatggatctcttggagatatcaggtagactgtggttaccagaggcttggtagtatattgggaaggagggaatgaagaggggttactcagggagcataaaactacagttgattacaaagaataagatatgctgttcagtggtacggtagggctataatagttcacaataagttattgcatatttcaaagtagaagaatatatttggaatgctccaagcacaaagaaatgacaattgtatgaaagaacagacatgccagttactcagatttgatcattatatattgtctgcttatattaaatagtcacatgttccctgtaaatatgtacaacaattttgcatgcataaaaattttccaaaaccttagactttagcgtgtctataacaaaaatatgaacttccaaaaagtgggtgtcatgtaattttaaatgttagcaaagaatatattttacatttttataggtaacaatacagattgctttttataaagaatgaatcacttttaaaaacttgaaaccattgtatctgctatacagtgagcatgtacaatgtatttactcatcaggattgattttaaaacctgattctaatccctccaacttaaaagtgagatatttgtgaaagaaatagggaactttttttttttttttttttttggatgttaggaacggtcatggttttttttttcgatttttttttattattatactttaagttttagggtacatgtacacaatttgcaggttagttacatatgtatacacgtgccatgctggtgtgctgcacccattaactcgtcatttagcattaggtatatctcctaatgctatccctcctccctccccccaccccacaatagtccctggagtgtgatgctccccttcctgtgtccatgtgttctcattgttcagttcccacctatgagtgagaacaggcggtgtttggttttttgtccttgtgatagtttgctgagaatgatggtttccagtttcatccatgtccctacagaggacatgaactcttcattttttatggctgcatagtattccatggtgtatatgtgccacattttcttaatccagtctatcattgctggacacttgggttggttccaagtctttgctattgtgaatagtgccgcgataaacatacgcgtgcatgtgtctttatagcagcatgatttataatcctttgggtatatacccagtaatgggatggctgggtcaaatggtatttctagttctagatccctgaggaatcgtcacactgacttccacaatggttgaactagtttacagtcccaccaacagtgtaaaagtgttcctatttctccacatcctctccagcacctgttgtttcctgacttttaaaaaattaaattatatttcaagtaaagagagaatcctgatgaaaaaattaaaaagcaaaacactctgagaaaaaatgaactataataatatattttaaacttttagacttgaaagtacaaagagctatcttacttctgaaggaaaatagaaaattgaaggttacataaatttgttgaaaatattttattttgtatgtatatgttaatattctagttttacctctaaaacttaaagatatagaaataacaacatatagaataaaaaattcatacaaaccagaaagccagatattgtttacttatttataaaatttgccattatgttttacaagactgataaggaatcctaaaatacattttaaaaaatagtttatgtagctcaaatggaaaaaatgtgatttacagtcttctaagactaggtaaagtaatatcagaaaattattgtaatattatattttaacagacttaaaagcatctgtaaagaaattttataaccttttcaggtagagattttatttataactttaattttatattaagttcagaaaaatgttcatttttactgctgtataaatatattctaaatattaatgtcattgatcgtaaaggccaagaagggaaatttttaagctaataatgtcaaattattatgtaacttagagaacctgctattctccaattcaggttttactgcattgatagagaagggagaaaagagattacatggaaggaattgatggaagaaggcagggagaaaaaaaatcaagataagtgagtttagaaatgtgaagagactgttatacaagcaaattaaattataagaaaatgaagtgtgctaattctcaccaaaatgcatagataataaattgaagaatcaactgtactaataagaaacattcactactcaaattaattccaagcctttggaaattatgcaacttttctttaaattagtatataattttataaataattagatataggatcaatatatgtatatataatgttattaatattgatccagtattgtatattgccatttcgtaaatgatgtgtttttcgattaggtacaacttaataaatgaccagaatttttaggagggtgtattaatatttggtatttaaaacattatgttgattaggtttaaataattccatgaacttcacaggtagtatttaatgtgcatgtacctttgtatctcacaatacttactgcaatattgttcattgaaaaatatatttgattcctatccttctagtgactatattaaattactgagttttcttctgtccaaacataataaaaattaaagtttttcatcaaagctgagttagaaaatattggaaattttttgaatatttttcagcaattttcctaatattccaaattttatacaattccaggctaagaatttgttttagaaaaaggtggattcagttgaaattgtaatgaagatataaaaatgattcagacagtcagccttagatgggaaacatgcatttaaatatcaacatttataaatatgctttattttatggtactcttatttaatactaatatttggtagaaaacaatctgtcctgcagaatcctaacactgaaactatactgtgattttaaataagatgtaagacatttattatataaaaaattaaatatttcctaatatatgaggataccacagtttaagatttcattggcctatttgccttgtaaaaggtcaagatcatttggcatatggtattttacagtgtaagagaataccttacttccaaagggaattaattagagccaaaatgtagtgtgaaatttttgtacacattcagtggtaatataggaaacaattactttttcagcattcagaaacattttttccttttttcctcccatttgtcctcctttccttcttttttccttgcattttccctttttaataacttagccctacatcggaatgaggtaggcatctgtgtaggagtagggtgaagcacagaagcctggcatgggatgtgaaagcctgagcagagtgaatggagtggaaggagtgttgcaggggtccagtgttgagtgttgggatccagagagggtaaaaagagtgcccacttgccaagacagaaacagcaacccaaacaggcttgttggaggccattcacctaagtgaaacaactcaaaaacagaaattcaaatactgcatgttctcacttgtaagtgggagcttaacagtgtgtacacacatggaaaaatagacactggagactcccaaaggtgggaggctgggagagaggggaagattgaaacattacttgttggatgcaatgttcaatattctagtgatggatacactaaaagcccaaactttgctagtacataatatgtgattgtaagaaaaccccctacacctataaaaataatataaaaatgaaatatttttgaaatggaagtaaaatgtatatgtgtttggtttaagtcagttaaccctaagcaaggactttccattaaaccctgacttcctattaatgagcaggagttgacgtagtcttcttttacctatctcctctgtttttagaacattggggggaaaaagtaatctttctatgttgttacagaaatatgaaatatttcacatatgtgcttgataattttgttttcttaacttttaatccaaatattaactagaaatataagacagacaaatacgtatatattttaagacttcaccataaagttggtttttaaaatgtacctcctaggtgttgatcctgctttctagtaggaagcattctctatttggattgaagtacatatcttgaatcaaattaaagttgtacagcatgtaaggctaaataaaagtttgactatatagtgttatttcttccttacaattttctacttccaaaagatgattatctgacaaggcattctgtatatttatatgcatatttattatttcttttcttaaaaaatcattaccctacattttaaatattattatcaagtaatttcatttatatatttttaaatttcttaatttgtttcatcattgttatatttttaactgttgaacttttttatattaaaccttaaccctaaataaaataatcacacctttgtttcattaattgatgcaggtttctgataaagtcaccttctcttgggcaattttatgggagggacttggctgttagctgtcatcaggtagtatgtccagcccctggggaatgagagcctcagctctttaagagtttctgtgcagtcattccaagaggtacctggtaacagtattgtgacaactaagtgagttaatgcattcaagcacccagcacatgacaagtactcaacaaatattaggtaggtattattatggcctaattatagttcatattggtcacttttcttttggatagaagtcagtaccttgatacctctttagttattatacatcaatctagacatcaaggaccaaggcttagtaaaatgagataatgaccttacttattctgaacattatacttctattaaataatgttaaattcatttgacttttgttatttttttccatttaggagcttgtactaccaattttttacacaaactgctattaagggaggtctctgatactgtgcttcacaattgattttttttaacctcagttcaggactctatacttacccctattaaatctcatcttgtcagttttgactcattttttaacctactgaaaccctgtcaaattcaatattttagctctttttttcaggattgatttaagtcacaagtacaatatcatgaagcactcatctgtattttcaccagagtcaggattagcctgtataagtcatccttgagaacagagattggcttacaggttaaactggatcaattgaatagaattctaagatatggaattatggccgatctactggtctgtgtacctagattttatcttagccagacctttgctccataacacttgaaagcatgttaaaattagttcatttggtatcacactttcttcacctaaatataacggcaggattctttaacataatcagttttatgatctagcctggacaagtctacatcttgatttttcaaagaactcattaagcaaacagtgatattcagaaactattcataatatattcttggttttctcattctcatattgctatgaaggaaaggaaatcaggataacttgacattattttcagagaatccatgtttgcatcaattcctaatcactttttaattcattcactcaaaaaatataatgaatttctagtaggtaccacacattgttctagatcttgggaatctgaaggtaaataatacatggcatctggtctttacacataagttggagttcaaaagatataaggttgctgtagaagtgtgaatcaaaggtttgggagaacaaaaatgaattctgattggagttcttggaaaaggctttcaaaaggtgtcaacttttgaattgagtctgaaagagggagtagaaacaggtccagggaagatgaaagggaaagactcaaagaaacatcaaggttacacttgtacataggcactatgctctgaaaggatgggactgttaatgagtaaggcatttaatggaagactggaagggtatattgtatgagaagaccagtgttggtaatgtgcttagagaggtagagagaagttaagttatagatcttaaaaacattcatcatgtttgcagggcaaggtggtttacgcctgtaataccagcactttgggaagccgaggcgggtggatcatctaaggtcaggagtctgagaccagcctggccaacatggtgaaaccccatctctactagaaatacaaaaaaatattagccgggtgtggtgatgggtgcctgtaatcccagctactcgggaggctgaggcaggagaattgcttgaatccaggaggcggaagttgcagtgagctgagatcacaccattacactctagcctgggcgacaaaagcgggactcttcctcctccaaaaaaaaaaaaaaaaaaaaaaaaaaaattcatcatgtttacattctgtctggtatacaacgagggaaatttggagatttttattcataaagcaacatgattcatgtatcttagaaaattatcttggtggtgttctagagacagatttcaacatagaataaaatgtacgtatgtaactaacctgcacgttgtgtacatgtaccctaaaatttaaagtataataaaaaaaagtgacacaactgccaatttccaaatttctccaaatatctaaaatatataaatttaaactcaaacactctaatgttcactcttcaaaatttttttctggctcataatagctctaaattgaatgtttgaatggttcattgtgttatatttgatttgcttatgacccattgttgaaatgcccagtactaaagataagtgaatctgggtgtccgtgagttgtgagaagagtcaagacatactcatatttggaggaaataatttccattgatatcttggtagtgaatgaacactgctatggagaatattagaggtaaaaatgggaaaaccaaggtcagatctctggacaacttcagtttaattcatggatgtataagaacaaaaaaaaaatgaaagaaatttttcagggagatagtgtatctattttgaaggataaatgtaaatataattggtcaaatattgtgaaaaagtctaaataataatttggatttggcaattggtaaaaactaggtgagtagtgaaatgagaaggaatttacagcatttcagatgtattgcaggttggctatataatattagattaagctcacaatgtttcttgctctattctggatgctatagcaaaatatattagactctgtaatgtattaccaacataaatatattgcttacagttctaggggctgggaaattcaagatcaaggcaccatcagatttggtttttggtgtaggtccaataaccaaattgtttttatagatggtgccttctgtgtgtccttatatggtgaaaggggcaaacatacttcattcagcctcttttatggaggcactaatcttattctcgagggtggatgtctcatgactttatcacatcccaaaagaccccacctcttaataatatattcaacatataaaatgtggagggaaaccagcattcaaaccacagcatgatcgaaacaagaaaaatgtatataaaaccttatagaagtaaggtagccactcaaaacagaaatagatagaacctatctcagcatagaagtccttgagttgtaagcaattatggtgacactgcatgtaacagtgttactggatctaggaaattcagttacttatgttccaattcttttagtatttgagacttttaccagatagaaattgatgaggaaatcaagcagaaactgatttatgataaagaacaagctggttatgaaatcactggaaaggcagagaaaagaccaaagacagccaccaatattctaccttcaaggtcacaaaatagcataagcgtggtccacatgtgaagtctgcaatgactaactagaggtcaggaagccctcctgccaagttacccctcagctaataatcacagccacaccactcctgaaactggatgaataggctgtggaatggggagttcggatgctactctcattcatatctgcagagcctcttgtccatgcgcacctcctgagaaaagtgggactgacattcacacccctccagcattctaaactgtatacatgtacctttcattctaggttcactacatgaaacttagaaccatagcagcaagtcagtctaggaaatgaagattttagcctgcaatttcttatgataaacaggagtgtcttaaatcgtataatttgactctgagtgttaatagaaaaatatctaggatagggtttaaaacaccattctgaaataatattcatgctagcacttccttttaaaagagagtttacaaaaatcaaactcttcagattcctggatctaagtttagcaacaccacagcctcatatgtgtaaaaagagcacagttagtgtctatgaactatgcgtgctgggagagcaaattctcagaaataaagatgttggggcagaaattagaaataatctattgaaacagagtaacaaagaacaaaagaagagtatgtttcctgagaagagagtgggattgaaaacaaaaaaaagagatctttataattcacagtaataagactgagaagaaagaataaaattccaaagaagaagaaacaggaaaagagctatctgataaagaaaaattttggagaagacaaaaggaaaagacatgtcattcagagatgaagggtttagtcttggaaaataagaagatagagttccattatcagttaatcaagacgtgatagctgtccaagacattggttacattgaagcattactcacaatagccaagatagccaagatataaagatgtacagcatgatctcacttatatgtggaattctaaaacagtgaaagtcatagaaacagagaaaagtggtagttgccaggggctggggagtgggagaaatgggaagatgttggacaaagattaaaaagtttcagttatgcaagatgaatagcttctgggagtttaataaacacaagttcattcagtgactccagagattgtatccatctgactcctaggtcatggcaccaactccttgccattacacacctcaaaaaattctgagctgaacatcgatattgtatccattacctgccatttgactaaaacattgatacatgtcaatggatacaaaagtatgtaatagaaggaggctgatgatcagggagggatagaaaaattacaatgactgacatttgctaagagttttaacgtattctagggtttaagtgctcaacattacttgatatttccaacaacactcgccgtcgtactattctaatctccatttgagagagaaaactactgcgatgtgaaaagattaagtgctgtagttgacaaaagtggcaaggccaggtcttgaatccatggactctcatgacatatccagtctcttaatccagcactttgccagcactgttagaggtgaagagaaagggtaattaaacaaataagtatttgcacaattgcttttctattcatttattcattcattgagtggtgaatggtattcatcaatttttgggatataagacactagaaaatagtttagaaaaatatggtaacaatgaaggaataatagtgtgtaaaactgagcatccgatatgagcctcagttgaaatattgggctgtgtctgaaagtcttttagagtagaccagtatctttgcatacacccagtgcattagataatccaggatcctgaacatgaggctgaaaagatcgagactaatgttgtaatgaaaatgaagctcctgaataccattgcagggaagtgatgtgatcagagtggttctttacaaagattgattttgcatttgcatgcctcgtgcattgatgtttttgttagacatccaatagaaaaggaagccaagagccactaatggcatcacaggaaaagtcagatagggccagggcttgggaggtaacagaggaaatgggaaggaagaaatagatacaagaattataatgcaggaattattaaaatagtgttttgactgattgtgatgtataagatagataggaatcaagggtgaagacaattacagattacagaaaaatccagaaagtgaagagaagaattagagatgttgattctaggcacatctgacactattcacttagatatgttctgtatctttgtatataatttttcattactgaaatatttaattcatcaagtatttcctgagaacttactatattccagtcactttgttctatgttacatgtatctatctgtatgcatgtataaatacatgtgtgcgaatgtgtgtttgtaaagtgttttatctctttcctcaagaaacttacaatttagtagtcagttgacagttggacttataaaaccaaaatgtaaaaaatatttagaaagagaatgaaagtcataagcatgcttttgctttaaaagaagtaatagaaataagaggccagtggaaaataatatgaaaaaaaggctacagtaagtgtcagcagatctgaaaacggactatataactagaagagactaggcactggcccatgttttgatgatggtggctttgtgctgaaagaaaaaacaaaggctcttctttctctgcaggtgcaccatgtcagggtgcacagttggtgaatggtgcaacctctgcagtcagagtaaaaacaaacaatcatgtttataccatatattcaaagatggaagcccaagaggatagataatatctccctctcatcccccagaatatactaccttcacttttgacacatgtccccaaactggagtgtaatgcctatgacatccaacttagacctaatgtacattagggagtcagccactcagcacagattgaagaattggcattttttaaggggatccgtgtgcatttgtttgcctttctcctatactttggatcaaacttataagtaaattttggatcaaacctacagctgaaaagacatgcagattaacctggagattaaggaaacatgaaaattattagaatatttgaaggccaaaacattatttagatatcttaaaatttgtatttccagatatgattttaatagttctaagacttttggatgcatcagaattctacacgtgtgtttgaaccttagagttgtaacatcatgtacttcataggctctctaaataattcacagtttctaattagagttgaaatatacactgtggcatttctttacagtattcacatgtgaaaggccgtaaagctgtgctcctggctcttgctcagtactatttataaggcatatttttatatgacctacagtgaccttttttaactctagcaaaaagagtacatttgacttttgactgccatatgagattttttatttgtatttatttatttttgagatagagtctctctctgttgcccaggctggatttgcagggacatgatctcaactcactgcaacttctacctcctgggttcaaccaattctcctgcttcagcctcccaagcagctggaatcacaggcacactccactacacccggctgttttttttatttttgtggaaacagggtttcaccatgttgaccaggctggtctcaaactcctgacctcaagtaatccgcccacctcagcttccaaagtgcagtgattacagttgtaagccatcatgcccagccccaattttatgtaaatgactgatataagaattgaaattcacatgtactgcatatttatcagtcaagtttatatatattagcccattctcacactgctatgaagaaatatctgagactggataatttataaaggacagaaatttaattgactcacagttctgcattcctggggaggcctcaggaaacttacaattatgctgaaaggcaaaggagaagcaggcaccttcacagggcggcagaacagagtgagtgccagcaggggaaatgccagacctttataaaaacgggaagagccagaccatttataaaacaatcttatctcatgagacttattcattatcatgagaacagcatggagaaaccgcccccatgattcagttacctccacttggttccacccttgacacatggggattatgggaattaaaaatcaaggtgaggccaggcactgtggctcactcctgtaatcccagcactttgggaggccaaggtgggcagatcacgaggttaaaagattgagaccatcctggccaacatggtgaaaccctatctctactaaaaatacaaaaattagctgggcgtggtggtgcgcacctgtagtcccagctactctggaggctgaagcaggagaatggcatgaacccaggggaggctgaggttgcagtgagctgagatcacgccactgcactccagcctggccagaaaacgaaactccgtctcaaaaaaaaaaaaaaaaaaaaaaaaattcaaggtgagatttgtgtggggacacagagccaaaccatataatatatgtttgtgtgtgtgtgtgtgtgtgtgtatacatatatatatattccctctctgaaaaaaaattatttttttatccaaagtttaagattatttcagatgtgataggaacaaaagaggaagagattcatagagaaattaatgttaatgtgtctctaaatcttgatgtttctggagtagagttttcaaaaatccctcactgggattttttttttttctagttctgcgtgctctgcctttgagataattcttccgaaataattttttatattagacactaaattaaatgtccacctaagataccttattgaacttgaaataatttaagtagtggatggattaaaataaaacacacaagaagaattttatagctattttgaaaatatgggaatagtattttaatatctcaactaaaggtttaatttaattggataatatataaatgaaattagacctaatagtttacagtcttatttagttcataatactgacatttttctcaaaacttagcacttacctacaatttaggaatataattgtggtgaatgcaaagaaaatacattttgtattttcacaaggcaccattatttatggtgatggttgaataattgatttatgtattctaacgttttaactaccctctttatctctcttttatttttttttcttaaacacacacgagattgttttcctggacctcaataaaatgtttatatcgtatagaaaatgcagaagtaacatattccctcaataattaaagtgtgattttaattttactgtctattttctgaggtaataaaagttgactcatgtatactttcttgtaatttcaaaagaacattcaggtgtttcaggaagttctgtaactcgaacatattaagtgatacaggtagcagttttccttcactcctagttctcataacaccataagccttaataatggccattcccattcccttggttatgttttctttatatttctttgtccatagacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaagtgagtcaacaatttcaaaatgtgttggttaattcaagctgatcttcagtatacctgtatgattggctttttcggtttcctccaacattttcttttcttttaataaaatggtgttgggaagatattttctgtgccccattcttcttgataataactcgaatacagagtgaatagtttccatcttcagtaaaaatgaaagagcttagtagaatcagcagagttcaattctggaggaagaagtcactttaaaaaaattcgttggtggaaaggcaattgctcacatactagatatgatggctggattttatgaaatgtatgctcatgtttcatttattaatatttctctcaagaataggtgtgaaaatgatactgcaaaatgtagttaccttctatacttatgaagccatctctaaaaatctgtagaattttatatatttgtttactttttgtatttttatatttttttacttttatatttctattaaaaatcaaaataatttacagagcttcttttcacttacgtaaaatttcatcgtcttatgaaaatgtagtttgttttctcattaggaggagacaaaactaaagcaggaaataataagaattaccagcgttggcctctgttgtttaagacacagaaccatactgagtgttccaaaagggaagcataaaatagtgaggaaattaatgttccataggtctgttctatgaggatcctaccttgaccctaacacatatggtgtaggggttcagtaaaaagcaagagccttcctgagaaagaaagagggaaccaattctagtgaacatagagagaaagcaaatgaaatcatcctggtctcatctgtgttgaccctactttatcagtttgcactgagcataactatgggtttttgatagaagtatcagaaacattaatcagtcatctatcatgtaccatatacttcaaataatgttctcaaactgatgagctcatattatttattttaattatgaaatacttggattatattatctgtgcacattgtgtggtttaggagagatttataaagacagtgccccccaaaaacaatgagtgagacgaaggactatagtttttttttaaaaaattattaacctggatgcaggaatattgtgctactttaaattttgttttgttttattttattaaaagagagaaagggccaggagcggtggctcatgcttgtaatcccagcacttttggaggctgaggcaggtggatcatgaggtcaggagaccgagaccatcctggctaacatggcgaaaccctgtctctactaaaagtacaaaaaaaaaattagacggatgtggtggcaggcacctgtagacccagctactcgggaggctgaggcaggagaatggcgtgaacctgggaggtggagcttgcagtgagccgagatcgcaccactgcactccagcctgggcgacagagcaagactccatctcaataaaataaaataaaataaaataaaataaaataaaataaaataaaataaaataaaaataaaagagagaaaaaggagggtggtaggtgaaaaacagaaggaaaaaaggcattatttcctaaactgcataaaactcagtgtttgtgctcaagcacaagcacacagaaaattaatattaagtctgaatattatagaaattgaacacggcacaaaagtgctgctgcaccctagccctgccaaacccaggaaaaggttaataggctccctccagacttcttgcaaaggtgcagcacgatggagaatttatagtgcccttgatctggccaagttgatcaaggtaaaaatcctgacattttatcttacctgtccatctgtcagaggcagatcactatgtttataaaactgaaatataataacaaagcacattcgttactttgaaatgagaaataactgtcacagaaattagaacattcagagtctatataagtacatactttacctgttggtatattatgaagatacaaaatgagagtcagaaacttgtttggtgagtctagaatatgaactagggaagctgcgtgcatagaatgtttagtggcctcagactgggacagttaaaagcttgcgaatgagaataaaatactcaaaagtcttgtggctagggatttctcactttgatttgaggaaaatgacagcattagtacttttttctgtttccattgttgattcatcttccataggtatgttaatgagtaccttaaaatcaagttacagttatgtaatcaaaccactgtatgatctcaactcagtgcagtataaacatgaattttaaatttgactactacattaagctcttctttttgattctccctttcagttatttaataatatatttggcagacactgtagatatattatcatcttccagtattagaaaaaaaaagttcaatattgttggtatagtggtgagcatcgctgccttccagaataaacagttcagccatgcacagtttaaaacttataataatgtttaattttgcattcacattgtctctggcctccatgaaagataaacctcaacctggggagcttaatggtgaaatgaactgcatcttgtcttgggaaggtgaaagagatcaaatacctcatgtttctggtgctgttgacctcattgggctgtcgctgtcacctgccctctgtgggacaggcatctaagtacctgccccttggggatgtgtgactggagtgcaagcacaccagaaggagatagaatatttcatttttggagatagaatattcctttttggagacagaatattcatcatggggtgctgcttagcttgagctctttatacctttcctcaccctttacttcagcaggatttcttttaagtgtgaatgtcacccactaacattatgcaatttccacttgaccaagagaaatgctccacattctcacttagctaagatgtaagaaactgcatttctttgcagctgatctctttctcattttctttctcctcattttaaagagacatagtagatcaatcctctgtaaaagcagaagtccaaatttccaaattgcgatgcaaatatcatatctctcctctcatctcttgtgccaaacaattcagtgggttctgttcacctcttggacttaccttcacttactgggagggaagcatcactgcgctttcttctgggtggaagacttactagtttcatcagtggattttttcctccgcctagttttctgcttacattgcggggagtgggaaggacagggggcatgggagttaattctcaaggcttgggttgcaaacccagtttaacatcttcttctttaactctgcaggaggtgcctgacctcttctcaaatcttaggtatttaatgtttttttcttctctctatgaattgtctcagttgaaaattacagcactacagaaacatgcccgctacatgtttccatacagtttcttatggctgtgctggtactattctttctacttgagattaagagtacctgtgtaatgggatttatttattgctgcatttacactttatatctcaaatggtgatgtgatctcactttatatataaaatcatgttttggggaaaaccaagtttttaaggatttcttagtgtagactccatatttgtatagcaggcatgaatgtaaatatgtaactgtaagatcaatataaatgcaatgagtacccagggaaagaagctgagtaattccattgggaccacccctaacgttgtaagatatgtgtgtctggcacttattctttctttagccaagagatgtattattttgtaaagacatagtaaagatattcatcagaataacatgatttttgctgacagaaatatgaaatgtgatgttaatagtcataattatatttactgtaaattgacaggaatgatttgattattgaaacatatgacatagttttgactgaaacgttctactttaaccaaacatactttcattttgtttctgtgatttcaatgagtcactatgtcctttaaagtagcatttccaccttactcacattttcccatctgactgacttaggtccttttaatacttcccagaattattgttttaccctgaaccacttacaacatactttcacaatcagtccttgaaagtgctctcacagtaaaattccctcttcctccagaatgagtgactgccaagtggcactgtatttcagatgttatattgtattgtgcatattttaatatataacatattatattttatggtacttctcttacattataactctgaaggattttttctcctagtttataaactccatgagtggacctcgtatgccttgtttatgtcattgtttcaagtaccaaaagcatattagggtagagggaatactgaaatttggtggaggtaggagaatggaaaggattattttatagcacctctgactgggtcttaagtgaatccattatacatccccttccaataagtatgtgtctacagaagcaactttttttttcttttttttttttgagacagaatcttgctcttgtccaggctagaggacagtggcgtgatctcagctcactgcaacctccgcctgccgggttcaagcgattctcgtgcctcagcctccctagtagctgagattacaggtgtgcaccaccacacctggctaatttttttttttatttttgtattttttagtaaaaatgtggttttgccatgttacccaggctggtttcaaactcctgagctcaggcaatctacctgcctcatcctcccaaagtgctgggattacaggcataaaccaccacgcctcgccagaagcaacttttaaatggaaactaaggttcaaagtgtttatgagagattaacacacttttgaaaagagtgaagatgaagcagaattcagccaatggagtgagctacagttcaggctccagtggtatgccgggagttgtcgttgttgttgttattgttgtttttaaggtacacaactctgcactgcatataacattaccttgatcaagaaaccagaagactttactgtaattcttccactggggcatgccagaaattccacacaacatttcttccaacctctattgtattgacgaatatcagcctcaccagatcgatcatgtgagcaatttatactatgtgagcaattcaatggttatgaattttcaaagaagtatttatccaatcccccaccaagattctgtgtgtgtgtgtgtgtgtgtgtgtgtttctagcacacccttttatttcattctaaggatattaacggtcccggtttatgcagggatccccacttcatctccccattttgaatctttttttaacccactgaggccattcaaaaccaatcttgtacatcagagacccatgcaaaagctctgagaatctgagtaccagaaaactgccacaatttatagaaaaaacaattatatggctgctcctctagctcctggtctttccacacacttcatttttgatgtttcagagtttgctttccttttctgtgagataatcagtggatttgaaaagattttcgaaaatgatatgcataatttctaggtgtacttagaaggcttgtttttctggctatctaggagaagatattgttgaaaattagaatacatatttaaagcacatattatatatatatatatttgaatactaaggaaaagcttgtttgtgccttcgttttgtaaatcacaggttgtgttaatcatatatcttaaagtttaagaattctatgtaagcacaattatactcattctctgaagcatttgttagaagatagatttaggtttatctctgaaaatgcaggtacatatggtctcaacatttcagctatcttttccctctgagcagctttatttattctaatttatgtgagtttaatgtttagttacttttccttggtagtaaatatatatgattttgaatacacttattgatgtgtccaattctaattgctgatgtcaccacccagaagtaattatcagctcttggtggactgcaatgctatttaagatgaatattgtagcataaatactgtcctgttagtagattctaatcttaaataaatcattaacaaattcttattaattttaccttctcactgtgcacctggtcctaggtttaaggtacaatggaagccaggcctattattatattctttttgaaggtttagctgaagccgtactaattatcccaaccaatgatgtgacatgaaactaattttcaaactgtaaggaattgtgaaccagtcacatatcaacaactcgaactatagagatatagaatgtgagtcagtgtgactcttcattttgagtgagaaacatgtatcacagctgtagcaagactttttggttggggaagctacaggatgtattcattgccaaatcatataatattttgtgggtttcatacacctcactggccacttaatgaagagaaaatactaatcttacaaacagctactctttttttttcagttttcttaatacaaatgacaatatcaatattttaaaatgttaggccaggcatggtggctcacgcttgtgaaaccaacattttgggaaggtacggagggagaattgttcaaagccgggagttcagggtcagtctgggcaacaaagcaagaccccgtctctctaaaaaaattgttttttattagttgggtgtgaaggaatgggccagtagtctcagctactcaggaggctgaggcagaagaatcacttgagcccaagagtttaaggctgcagagaactatgactgtgccactgaactccaacctgggcaacacaacaagatactgtctctaaaaaaataaataaataaaaataagtaagtacttcctttttttttttttgatacagagtcttgctctgtcccccaaggctgcattgcagcggcacaatcatagctcactacaacctccgcctcccgggttcaagcaattctcctgcctcagcctcctgagtagctgggattacaggtgcgcgccatcacatctggctaatttttgtatttttagtagagatggggtttcaccatgttggccaggctggtctggaactcctgacctcaggtgatccaatcgccttagcctccctcagcctcccaaagtgctgggattacaggcgtgagccactgcgcccggccttcaggtttaattttagcaaaagtttttattttaatagaaatctggaggaaaaaatatttgtggtagagaaacttatttcagtttggtagaaaagtagtgctttcttgttttttatatacctttttttcctgatagggttttgaaatatagattttgatttataatcaatatgcctgttcttgataggtcagaaaactaattttgaataaaggcctgaattaaaatatagtaaagtttagtagatcagatactgaaatcttaggtgcaaatatgcaaagtaccagcaataaatatagccagcattcaaaaaacaaattattcctatttctttaaatgatatgtgttgaaatgtttttatacctatgatacacattgtcaaagaaaactactcttgcatcctaataagcagctggggatgtacaaaatgtattcatttattcaagtatagaacacgtgtatgttcattcatatactgagtcattggtttcattagtgaaaaataagaggaggctaatgaaacttcccaaatctcttaaaacagaggaactgactcatggaatatgtgtaactcctactagcctagttgtgcagtcataaagttctgcgttagggctaaagttatggtagaatttctcttagtatatttggctcaacaaactttagttcgctgctgatgtagagatttcatgcttacatatttctaacagcttgacattttaaaaaatgtgtcattaaaataaccttttacttaaaaataatttgatttttatatatgagttcaaagatggtaccaaaagtattcagacacccttcacccaacctccccttataataacataccacagtacatgtatcaaaattaatgaattatcatgggtatattagtagtaaataaactacagagtttattatgaaatgtcatttttaacagccttcctctattgtagttatctcatattgaaaataaataggcctggcacagtggctcatgcctgtaaacccagctcttagggaggccaaagtgggcagactgcttgagctcaggagttcaggaccaacctgggcaacatggcgaaacctcatattgacaaaaatacaaaaattagctgggtgtggtggcaggcgcctgtggtcccagctactctggaggctgagatgggaggatcacttgaacccaggaggcagaggttgcagtgagctgagattgcagcacggcactccagcctgggaaacagaaggaaatcctacaacagcaacaacaaaaaaaagaaaagaaaagaaaagaaaaaacagagaaggagagaaaaagaaaaaagaaaagaaaaaaatggattaataagaatgcaaacatggaaaagttcatatcatttttacctgttaaagatttcagaaattctattcaacaagtaaaagctacatgtacttaccaagcttagtaaacattttagatgaattttacttttctgtttgtttaagacaatttttaggtagaaatataagtcaagttaacaatcaaactcatttgattgactcatttaaatgactcgaattagcagggtttcaaataaaaattaatgaaattcttcataaccctgtagtcttccaaatcaaaattttcaaacatacttttctctcttgctcatcatacttcactctcaatttgtagatttttaaattctggaagtgtttctgcttcagcagtagttaatatttacatcaccttcaggtaaactttaatgcagttttcatgagaaacccatacatgtttcatgtctacaaaactaaaagacagttattattttacgaagcatggaataccaaaaacaaaaacaataccttttaagtgacatcctagtgaatctccatttgtcacgagacctcaagctttccagttctggcacaaagtgattactcataccatcacttcaaaatgatgattatcttcatttattttagttatattgaacaaaatatacatttaaaaaatctaattactaaatattctccaacaaatatatacttagtatatactattagtgatgcatgctttcaaatatttggactatatcaatgaatgaaacaaaaaattatttgcccttaaggagcttagattctaacagatggattcagatgatttttatgccttatttcgtaggtttaaaagagcaatggggaaaagggaagaagagagggattgaaaatattgagaaggttgggagacttagcaattttaagtaaggtagtgagggtaggttttattggcaaagtgatttttcagcagagactgggaaagatgaacgtggtatcctggaggaaagcctcccaggcagagttaagctgctaacaaaagtgcccttaggctggagtgggcttgtttgattaaggaacaaagaggtcagcatggttgcactagagagaaaaaatcagatggcgtaaggagatgaaatcagaaagatacgaggctaggcaaaggggtactctatgtaatgaacatgacctggcagtactgacatctcctgagggactgttagaagtgcagactcttgtatcttttctcaagtctatgaaatctagacttcattttaacaagatgacccgatatttacatacacattaaagttccagaagcactgatataacacattgtaagatcgcacaggacttcaattctttttctggtttttagaggcagtcctttggggtgttttgtgtagagtataatgacctgaaatatctaggatcactctagctactatcttgaggaaagagtgcaataaggcggaacagttcagaggcaatggtggtcttctaaatgaaagacacacagcactcaaaccaggcagttgaggagggatgggaagaagttgtcaaattctagacatattttaaaggtagtgtccagagaatttccttagatgcgtaggaacatggaggataggacatagggtggaaataaacgaaataaagaaactgaagctgattctgacattttagacctaaaatctcaactaaaagttgccaagatgggaaaaactaggtgcatcttgtttggtgagtggaaatcagccttgtgaattaagacttaaactgatgtctttaatcccgtagaaataccatgaaggcagtagaagatggctaaagagaggtctagactgtaggtacaaatttaaaagtcacttgcatttggatgcttaaagtcaggatattgtgaagtcaacagaggaataaataaatgcagagaggggaaagaaaaggcccatagactgagccattgtctggtttatttacatattagtatatattttcttaaagatgtttgctatataataatgagttacctaaagtgtgacttttctaaatttatggggaattttctacattgtgttatggcactactaaaaataataaaagaaaatattgatatgagtctatgttacttgaaatattttttaaggggagatgtacctcaaaagatattccacaagaaatgatctttctctttatcccaccctcgcccctcctacaaacactggattactttaactatacaaaaattttcctgctttctcttgtgggcatttagtgctataaattttcctctacacgcagctttaaatgtgtcccagagattttggtatgttgtgtctctgttctcaatatgcagccataaaaaaagatgagttcatgtcctttgcagggacatggatgaagctggaaaccatcattctcagtaaactatcacaaggacagaaaaccaaacattgcatgttctcactcataagtgggagttgaacaatgagaacacatggacagagggaggggaacatcacacaccggggactgccgaggggtgggagcctggggagggataacattaggagaaatacctaatgtaaatgacgagttgatgggtgcagcaaaccaacatggcacatgtatacctatgtaacaaacctgcacattgtgcacatgaaccccagaacttaaaagtataattttttttttcttttttcttcttctcttccctattgtgcttgctttctgtgttgtggaaaaatatattactgtgtatttttatgtatattagcagacatcttttataagcaatgagtaaaggattcatttggtccaatgacatgaatcaatgacaggtattgcatttttcaaatgctgtagcataccagatatgaagcttctttggataacagttctgatgggatgggtctaaatttctctttttaagtactcagtgagagatagcccttttccattatagtagaggcagttgttctgtaggaggacctatagatttctcagaggttcaaggtcattgtaaattaatttccacttatgcttcaaggtgtttatcctgcagcatttctttgaaactagttatttacaattccctggaagtaactggatttccctctatcatactactcaacttcactgttatagaaaaactttaagataatcagtatttgtactggttatcaaagggaataattctagtttttgcccattcaatgtgatattggctgtgggtttgtcataaatagctcttctttttttgagatgtgttccatcaatacctagcatttttagagtttttaacatgaagggatgttgaattttttcaaaggcctgcatctattgagattatcgtggtttttgtcaatggttctgcttatgtgatggattacgtttattgatttgtgtatgttgaaccagatttgcgtcccagagatgaagctgacttgatcatggtgggtaagtttcttgatgggttgctggattcagtttgccagtattttattgaggattttcataccgatgttcatcagggatattggcgtgaagctttctttttctgttgtgtctctgccaggttttggtatcaggatgatgctggcttaataaagtgagttagggggagtccctccgtttcaattgtttggaatcgtttcagatagaatggtaccagctcctctttgtaactctggtagaatttggctgtgaatctgtctggtcctgggctttttttttggttggtaggctattaattattgcctcaatttcagaacttgttattgttctattcagagatgtgacttcttcctggtttggtcatgggagggtgtatgtgtccaggaatttatccatttcttctagattttctagtttctttgcatagaggtgtttatagtattctctgatggtagtttgaatttctgtgggatcagtggtgacattccctttatcttttttattgtgtctacttgattcttctctcttttcttctttattagactagttagtggtctatctattttgttaatttttcaaaaaaccagctcctggattcattgattttttggagtgtttttggtgtcactgtccccttcaattcttctctgatcttagttatttcttgtcttctgctagctttgtggttagtttgctcttgcttctctagctcttttaagtgtgatgttagggtgtcgatttgagatctttctagctttctgatgtagacaattagtgttgtaaatttccctcttaacattgctttagctgtgtcctagagattctggtacttcatctcttcattctcattggtttcaaataactttttaatttttgccttaatttcattatttacccaggagtcattcaggagcagattgttgaatgtccatttaattgtgtggttttgagtgagtttcttaatcctgagttctaatttgattgcactgtggcctgagaggctgttcgctatgatttcagttattttgcatttgctgaagattgttttacttccaattacgtggtcgattttagaataaatgccatatggaactgagaagaatgaatattatgatgatttggggtgaagagttctgtagatatctattagtttcacttcatccagagctgagttaaagtcctgaatatccttgttgattttctgtcttgttgatttgtctaatattgtcattggggtgttaaagtctcccactgttattgtgtgggagtctaactctctttgtaggtctgtaagagcttgttttatgaatgtgggtgctcctgtattggatgcatatatatttagcatagttagctcttctcgttgacttgatccctttagcattatgtaaggcccttcttttgtattttttgatctttgttggtttaaagtgtgtttcatcagagactaggattacaactcctgcttttttttttcttggtaaattttcctccatccctttattttgagcctatgtgtgcctttgcacgtgagatgggtctccagaatacaacacactgatgggtcttgactctttatccactttgccagtctgtgtcttttaattggggcatttagtctgtttacatttaaggttagtattgttatgtgtgagtttgatcctgatcaagagtcatcatgatgccatcttgttattttgcaaactagttgatgcagtttcttcacagtgtcattggtctttatattttggtggtttttgcagtggctggtaccagtttttcctttccatatttagtgcttccttcaggagcttttgcagggcaggcctggtggtgacaaaatccctcaacatttgcttatctgaaaatgattttttttctccttcagttatgatgcttagtttggccgggtatgaaattctgcattgaaaatgcttttctttaagaatgatgaatattggcccccaatctcttctggcttgtagcgtttctgctgagaggtctgctgttagtctgatgggcttccccatgtaggtgacctgaccttttcctggccttaacattttttttaattttatttcaatcttggagcatctgatgattatgtgtcttggggttgaccttcttgcggagtatcttagtagtgttctctgtattttcctaaatttgcatgttggcctgtcttgctgggttagaaagttctcctggataatatcctgaagtatgttttcctgcttgtttccattctccctatcttcttcaggtactccaatcaatcataagcccagtctttttacgtagtcccatattctgtcatcactcctattccacatagtattggaagttcaggcctgtgcaatcaggcaagagaaagaaataaagagtattcaaataggaagagaggaagtcaaattgtctctgtttgcagatgctatgattctatatttggaaaaccccatcatctcagcccaaaatgcccttaatctgataagaaacttcagcagactctgaggataaaaaattaatgtggaaaagtcacatatattcctttacaccaacagtagacaagcagagagccaaatcacaaatgaattcccattcacaattgttacaaagagaataaaatgcctaggaatatagctaacaagggaatgtgaagtacctcttcaaggagaactacaaaccactctcaaggaaataagagaggacacaaagaaatggaaaaacattccattctcatggataggaagaatcaatattatgaaaatgtccatactgcccgaagtaatttctactttcaatgctattcccatcaaactaccatagacattcttcacagattagaaaaaaactactttaaatttcatagggaatcaaagaagaccctgtataaccaagacaatcctaagcaaaaagaacaaagctagaggcatcaagctacctgacttcaaaatatactacaaggccacagtagcaaaaacagcatgttactggtatcaatacagacatatagaccaatgaacagaacagagacctcagaaataacaccacacatctacaaccatttgatattctacaaacctgacaaaacaagcaatggggaaaggatatccttttcaataaatggtgctgggaaaactggctagcaatatgcaaaaaactgaaactggaccccttccttacaccttatacaaaaattacctcaagatggattaaagacttaaatgtaaaacccaaaaccatgaaaaccctagaagaaaacctaggcaatgcagttcaagacgtaggcatgggcaaaaacttcatgacgaaaagccaaaagcaattgcaacaaaagccaaatttgacaaatgggatttaactaaagagtttctgcacagcaaaataaactatcatcagagtgaacaggcaacctacagagtgggagaaaatgtttgcaatttacccatctgacaaaagtctgatatccataatttacaaggaacttaaacaaatttacaagaaaaaaacaaacaaccccatcaaaaagtgggcaaagaatatgaacagacacttcccaaagaagacatttacgtggacaaccaacttacgaataaaagcttaacatcactgatcattagagaaatgcaaatcaaaaccataatgagataccatctcacactcgccagaatgttgattattaaaaagtcaagaaacaatagatgccagagaggttgtggagtaataggaatgcttttacactgttgatgggaatgtaaattagttcaaccatcatggaagacagtatggagattcctgaaagatctagaaccagaaatataactggacccagcaatcccattactgcatatatacccaaaggaataaaaattattctaccctaaagacacatgcacacgtatgtttattgcagcactatttacaatagcaaagtcacggagccaacccaaatgcccatcaatgatagactggataaagaaattgtggtacataaacaccatggaatactatgcagccatagaaaggaatgagaacatgtcctttgcagggacatgaatgaagttggaatccatcatcctcagcaactgacacaggaacagaaaaccaaacacctcatttcttactcataagtgggagatgaacaatgagaatacatggacacagggaggggaaagatacacaccagggcctgttgagtgtgtgggggcaaaaggagggaacttagaggataggtctataggtgcagcaaaccatcatgccacatatatacctatgtaatgaacctgcacctgtatcctggaaattgaagtaaaataaataaataaataaataaataaataagtaaaataatcagtatttggtcttagctttaaactactatacagattttaaaatcttaatgagttacagtgcttttaaaatttttctactagagtattttctatgattacactatttctaacataaatgcccaaagaaaaaagactatcatttctaaatgactatatttcatatgataaaggagaaattgactataaaattcatctgactatgttaaatgaaactgcagtaaacttatgaattgcaaaaaagaagaaaagtaatccacactaattccatattttcagtgaaagaaaatttgttctgatttgcatgttgtggaaaggtttctgtatgttaaaattcaaataagaatatcttggactgtgttcattgcacccataaagagaaccatagctaaattaggatgttgtatgtaattacattcttaatgattttaaaccatgtagatcaaagtatacaggcactaagctaagagaaaaattaagcaaaataacaattttaggtaaaattacttgtctgctagaaacctcctcacttatcttaagatgaagacacaaattcatacataattctatactcagcctggtctctgctatatgttaaggagaacttctatgcaaatactttttttaatttttcaataaaattaatgagcttttctgtgcatgcataattttatgaatcaaataaatagtacaaataaatgatattaatttatgtaagaaaaatgtttgtgagtagtgagaaaacaaatatgaatatttcatgagtgttttataggagtttaatccacgggaggagaatgaaagtattcatagtgcccagaaacttaaaaaaaaaaaaattagagctcatctgactgctcaaacatacactcttaaggcaaatttaaaattcaatgtacatatgatgtttgctagaatgtagcttttaagtccctaatcccagtgaagaattcttgtgggctctcatgcacattttgagagtgaattttattgatagcgcattttagatgacatttaaatataataactataaaatttttgaaattatgccaacatatactattgtattaaacattatttaacttttggattattaaaactacttactataaacattaaatattttatctattatagtatataaatgtcctcaaaggttaaggaggggtatagagccattccattattcactcaatggcttaagatgcttatatcagcaagattctaatcttctatttcaatagtaccatcctatatggagtgatgaatgccgcagactgacatgtacagatatgatttcagaggctggtactatcttggttctcattgcttttactttatgtatagattatggagataatattattaatttttcttatttttagcatcttgtattcgttctttttctgtgtatcagtgtctgttcatctttcttttaatcttttaaactaatgtactgttttgattttttaaactaatgcactgcctgatttgcctttttacaaaatctccattgcacataacagtgttatttaaagatgcacctattccagggtatttgaaagatcaatcatcagggtacacaaagataaatcagaaaatattttcaattcatctaatcaaataatataaattacaatttaaataatcacactgaataaatgattgacaatactgtgtatatatacacattatatatgtatatgtatgtatgtgtgtatatatatactattttaatatatgcgtgtgtgtgtgtttgtgtgtgtgtgtgtgtgcctcatgtgtcttaatatcttagtctctttttataaattaggagacagggtttcgctctatcacccaggctggggtacagtggcacaatcatagctcactgaagccttccaaaacctgggctcaagcgatcttcccacctcagcctcctgagtagctgggactacacacggctaatttaaaatttttttcttagagaagaggtcttgctgtgttgctcaggatggtctcaaattcctggcctcaagtggtcctcttgcctcagcctcccaaatcaccgggattataggcatgagccactgtgccctgccttagcctttcttttctgccttacctcatatcttttctctacataaatacttggcactttcatgtctgtccacttattatgtccaatatgcattttactttcttacagtcatgcatgaatttgtgttattcctcctccccatcatgtatgtatgtatgtatgtatacacacacacacacacacacacacacacacacacacacacacatatctcctgtcaccaaaggggattcccttttgtctttaatgttagaatacacagtagaagtagcacatgttacacacaggttaaatgctgcttttaatttaaagggtgggagaaagaagtaggaatatatatatatataggtccaatatattccaagcgtttatatgagaattcatgagattcatttttagtggaaatagttttctcttcctttggtaccctataggaactattgctcatacaggtattttgccagctgctcacttgttaagcagtatgacatcagtcacgcctctctgtcttgactgcacattggagggcctgtttaccgttcatttggctctttgagtcttccatatcatttgaggtgaataaatggattatctaattactgtttgtttacactcaaataaaactaaatagttactgttttcaaacatctataaattatcaacatgtccaggtcaaatcaaattaaaccatctaagcacattgatcgttttattctttctttggaatttgtagaaagagaatccacaagcttttctgggaagtaatgttatgtagttagctgttcttcaatattaattcttaatgaacatgagtaaaccttcattctacttaccaagatttttaaaaaattccattgcaacaatttattttattctaagtgcagacataagtagacattttagtaaaattaaaatagtagtttctcttcctctaaagcacagtcttaattgttactacttctttctcccaccctttaaattaaaagcagcatttaacaactgtgtaatatgtgctacttctactgggttatctaacattaaagacaaaagggaatcccccttggtgacaggacaagcctgtgccgttctggtaacgtgggcttgtcaatgaaaaataagataaatttcacatcacagagaaaataatgggcttcatgacgctgcttcaacttggaaacctcaccagacatcttcatctccacagtttattgtgacacagaaacacatagcaaaaaatgtaggtttaagtttcaaggcccatgattttctgtccatggtagtgttgtcttttttccccatctattggttgggccactcatactacattctttatcttcaactctttcttgacaaatgattctcacttaattctacaaatatttgtcctgcctactctatttcttgatgctcagattctgaatagctttaaagaacacttcctttctttcgttttaggatatagtttattagtgactttatctcttatgttatgtaattttcaggaggttttttatctcctctgatttataaatgtgaactgaccacacacacacacacacacacacacactagatgtatgtacacacacatatatattatatacacacatatacatatgtgtatatgtatatatacatacatattctaacacaaatgacttcctgcttggtcatcttaattgaaatgatatatgtccattcatttaatttaacaaaaactgaaaagcacctactatgtttagggagattttagaattttgaattgctagagattccatagtgaagaaagtaatacaatgtcttcatggaatttacattgtcgggggggaagatgtatttatagatgcatcaatagataaaatatcaatttatatataatatataatatataaaatatattatatattataaataaatatataatatatactatatatagtatatatattgtatatatattgtattgtacatataattgtatatatagtataatatatacaatatattatatattatatataaatatatatattatatatatttaatatgtattatatatttatatatcattttaaaaatataatatatattactttatatattatataatatatataatatataatatattactttatgtattaaaatatagtattactttatatataaaatatagtattactttatatattatataatatatataatatataatgtattgcattatatatgaataaacatttctatgaattacattatatattatataatatataatatatattactttatatattatataatatatataatataatttatactatatattatatattatatatattatatattatatattatattatataatatataatatataaaaatatataatatataaaaataatatatacatatataaaaatataaatatatttataaattattatatatttaatatattatattaaatatatattatatataataacaaaatatatatagtttatatataatgtttaatatatcaaaatttataattttaaaacagttaatgatataaagtatgaagaaaaatgaagcagagcaagatgctgtgtaagtgggggtgggaatggggactaattttataaagaggagtcagcagggtctgtgatgtttaagcagagtcccatatgaagtgagggcatgatcacataaatacctagggaagcctagccttggcagaggtcagtatgaagggcgtcctgcctggaatggcatgatcagagagaggaattaaatgaagtaggagtagacagatagccaagccaatgtcccatggggccttacaggctatggagaagactttgcattttattcttaatgtcatggaaccttattgaaaatctcgtaagtaattctagaaaggagtataggagaggtcatttttaagtactgacattattaaaagggatcattttgagtagggaacaacctttctcaaaatctcctttaccacatgaagcaaaattttggggttagaaaagtaaaagttaccttctgccatatgtttagtaaagatgaagaatccttagtgcattgtatcacttgatatacattttccttctttttctacattaaacaaatgattctttgctatttttgaaattctcatctttactagttctcaaaatattgaaatttagtttccccctgtattattcttgaattagtccttagaatataaggcgatgtttatagttaaggtttgtttttgtttgtttctttcttcggtatggtgtttttattcttgaaatacagaggtctacaatgacaatagttcagcgtcctatgaatgttctttttgaatttttaaacagtatgatgaaggtaagttatgatttaccatgcctaggatttctagttacatattgtggaaattaattgatctaactttgtagaaatttgaccacctacccttttctaaatatatatatagacacacacagagaaatcatacttttcctgtactaattacaaaactctagagtgatgttaaatttttcatgcattaaacaactaaagcctacagtgtgccaaggcactgttcaaggaagtgagaatataatcacaaaaattcttccctaattcatattaaattgtatatatggagtgtgtatgtttgtgtatacccattggaagtttgttttattctgccaactgatctaattagataaacttagtcaatatatttgaatcccacattccagcagctattttctccatttgcttttattgctgtttgtggtgagtttgatatataattttaaggtgttaacatccctaacttatgtatgggtacagctcataaatacgaacctgtgtcatgcaactcatatatgactgtgttcaaaataatgtgtattagactgtaaaacgattttaatattttaaataactttcctgcatttgtcggtttcagcaggaaagttatttttaataacttccctgtatttgttggtttcagtattaattaatctcattaatgctaaactttgtgatcctaggttaaaaaacatattcaagatagcttcagaatgtttggtatacaaataggtctggctaaatataagtgttagctttctcaagcatctaaatgctggcgggcttttaaaaaaccagggctttaaggagaaaacacctgctctgtggttttgtagcagatatgaagtattcaaatttcttaataaatagaaaaagaaatatataacagaaacaggttgcacttgtctttctcattaagcaggtggttagtaccattatttgcattctcatagccttaatatacattttccttctctagatacaaggggaaattatcacaaatttgcctaaggatagcaattaggattactaatttattcttctttgcattttattaagctttaccaaatacaaatgaatttcataagggaagattatatgtgtttttacgtctaccattataaatttgtatgccaaataagatcacatggtttctttcccaaattctaacataatcttccactcagagtccttttaaaaggaaacctattggcaaaaaaaaaaaaaaaaaaaaaagtttaatttgtcctgtttgatgactcaatacagccaggatatcccagatcaaaagttattggaataatatgatttcatcgtttttacatttatacctacaattatttgtattcactgcaactttaatttagaaatactcatttttttgagctctaaaatgcaaggttcaagtgattttttttccttttaatttaggaggagatccaatagaataattcaaataagcattttcaggttctatgacatgctcataagaaaataaattattcatagaaatgtttattcatagaattactgtcctaataatttaacttctccagaaaacatgttttaaaatgctatatatcaaaataacgtgtaatctttcaaaatagcattagaaaaatataatgcaatattttcctgaaatatttgaattattatttaggaatacaattcttgtcacaaatatttagtgatgtgaaaatctcggcaaaccattcatattaattcatttaaaatatttaaataaataacttgaaaatgaaaaatttgtgttaagcaacaacaaaggacagaaagaaacataaatgtttccaaatatctagagagattagaaggtttttatggcttgaatttcattgaaaaataacaagcaatttattagaattaatggagatatctgggttaactatatagaagaatggcttagcaaagacaaattttaaatattattatgaatttcttcccaatataatattaaaaattctttcaaaataagagagaaaactttaaaaaaagaaacaaaaacctgcctagtgttgcaattggtgcgttgatctcaaatcttgttcacattctaacaaggcctctgggctttctgtgtgatttggtatgttccatagtagagaatacaaatgatatagcaagaacagttcattcatcattattagcaaatttgactgggaatcttgaatgggatatatgaaataaataggttgatttcatagtttaagaaatgacagcatatgctggccagagtgtataatagtaacaaagtggctggtacatgcatctttactacaaaaggcctaagaataaaatctctaattaaccagagaatctgattgactttattctgaatctctcttctctgtatttttagtgtgattacaatttgctcctgtgaactataaggaaaatgctgaattgtattcattttatagtgctagcaattcatgaggataatcagcatggatttacatttttttagtctaatgagaactcagaaacacgtaattaagtaaaatattctgagaaagacactgtgtcctctaatagtttaaattaaattttaaaaagatcttacaccatatgcaaaaatcaactcaaaatagattaaagacttaaaggtaaaacctgagcccataaatctactagaagaaaatttctatagaatgactgtttggtaccctcaaaatttatatattgaaacctagtcctcaatgtgatggtattggaggtggggctttgagaggtattaaatcctaagggcaaaatgctcatgagtaggattggtgcccttttaaaagatattccagggagcgacctaacttctacatctatgtgagggtggaatgagaagatgtctataagccaacaaccaggccctcatcagctgtcgaatctgctttcacctaaacttggacttctcaggctctggaactgtgagaaatttctcttgtttataagccacttagtctaagatattctcttataattgtctaaatgtaataagccagaaatgggcaccaaaaagtagaggtgctgctctaacaaatacctgaaaatgtagaagagggtttagaattgggtaatggctagaagctgtaagagttttgcagtacatgctagaaagtgttggcattgcctcaaatagactattaagggaaattcttgtgagggcccacaagggaaaaaagagctacatagaaagtctcagtattctttgtgaatacttctttgtgaagagaattctgttgatacaaatataaacagtaaaggacgttctgatgaggtctcagacaaaaattatgacatgtgttggacaatggaggaaagggcatcattgttaaaaagtggcaaagaggtctgacgcggtggcacacgcttgtcatcccagcactttggaaggccgaggcgggcagatcatgaggtccggagttcgagaccagcctggccaatatggtgaaaccttgtttctaccaaaaatataaaaattagctgggcttggtggcatgcgcctgtaatcccagctactcaggaggctgaggcaagataattgcttgaacccaggaggcagaggttgcagtgaaccaagatcatgccattacacaccagcctgggcaacagagcaagactccttctcaagaaaaaaaaaaaaagtggtgaagaactcaggtacactatgttagtatgctagtgtttttggtaagttacaacttgtgtgtgatggaatcagatattcgcctggaaatttctcaacaaagtgttgaagaagcagtctgatttttcctgactgcttatattaaagggctagagaaatacatgatttaaagatagaattattaatcaaaagggatgcagaactttttaccgtatccattttgtaacaaatgagaaaaactgggaaagaacattaagggtttggccaggaggacatttgatatagagattgattagcatggatcagccatctcagtcgaagctaggagttaatttttccagacaatggaggaatgtccatgaagcagatacaaagataattagagctgccactcccatcacaggatcagggttcaagtgcctaggagacaggaagtttcaaaggaaggtttgaaggtgcctacaggatctcctagtgccatctcacatcgtgggctctgctcctgttacgccagcactacgcctctcattgtcccagctgtggccccactggggcctggtctcgggtaggacatggtgggtgccccttcagagaacataggcagcaaactttggtcatgttcctgtggaaccatctccaccagggcacaatgtgcccccaggccctgggagcgtggctgcctccacgtggatttcagaggaagggcctcttagcagagctgcaggctcaggtccctagctctggagagccgctgggccccagcagagaactggtgtaggagtggggctcaggcactgagcacacttaggggcagtgtgggagtggagcaaatcaatgggagtggagccttcttagccttggaaatggtgcctttattagatagacctcagagagctgctttgccccttctgcaatgtgaggaaaaagtgacatatgtataaaccaggaagcaggccgtcaccagacactgaacctgccagctccttgatcttggacttcccagcctccagaactgcgacaaataaaattgtgttgtttataagcctcctagtttatggtaatctcttttagcagccagaatgtactaagacagaaatatagggaaaaggcttcttggcgttggtctgcacaatgattattttgcatatgacacccaaagcctaggcaacaaaagcaaaaataaacaagtgggattgcatcaagatgaaaaacttccgcacataaaaggaaacaaccaacagagcgaaagggaatgtataaaataggagatcatatttgtcagccatatacctgataaggggtgagtctccacaaatatatgaaaaattcatacaactcaatagcacaaaaccaaataacccaattaaaacataagcaaaggatcagaatagctatttcccaaaaggagacatacacatggccaataggtatatgaaacggtgctcagtatcactaatcatcagagaaatgaaatcaaaccacattgagatatcaactcacacctgttgggatggcttttttttcaaagagagaaaagttaagtgttcgcaagcatgtagagaaacggtaacagtgtacacttgtacactgttagggaaaatagtatgacatttcttaattcagcagtcccatatctgggtatatattctcaagcgaaatgtgtacgtctatgttctttgtagcattattcacaagagccaagatttggaaacaaccttaatgtctatctgtgaatgaatggttaaagaaaatatgtatatacacacacacacacacatatgccatatttataatatatataatatatatacacacatataatattcctgtatgcatacatatgtgtatagaatgtttatatatattatatataatattgtttatatattagaatataggatattgttatatatttatacatatgtatacatttatatacattatttatatgtacacacatatgtatatagacataaaaaagaattgctgcatgatctcacttatatgtggaatttaaaagaatcatactcatagaagcagtgagtaaaatggtggttgccaggagtgagagataagggaagtgaagaaatgttggtcaagggatacaaaatttcagttatgcaagatgaatgcattctagagagataatgtaccgcattgtgactataattaataatgccatattaatgatacatatggatatgtgctaagttaataagaaatgtaactatagttaacaatgcatattaaaatgtactaagaggctacatattaagtgtacaaatacaaacatattaaaaaactggtaaatatgagaattggtagatatgtttaattagcttgaatttatggtgattatttcagagtgtatgcatatatcaaaacatcaagttaaaccccttaaatatatataattttattggtaaattatctctcaataaagctgggagaaaagcatatacagtaatatcatttttcttatttatcatttttatttttgtttgtattgaatgttttattgggagataatacattttccttataattcgcgtttatgaggattttcatttactacaaagtgctctctgtactctagttttatattaataggtcaatataaagctatgggtcatacaaagctttaacttaagctagaatcatgttcaaatccaaactctgatgcttagtggctagttcatctttctgagcctccctttactggtgtaggaaatggagaatgtaaccaaactctgttagttctggtattaaatgaaataggatcagataggacttgaatagtagatttttccctaaaacaaactttaatttggaaaagtaaaatttgttttcaatgttcagcaacaagagcagagtgcatttgtaataaaggataactactatagatttaacaagtgctctcattgggtcagttttctttaaaagtggtgtttcatttggtataatttttaaaaacataaattcaagcactaactgctgaattattattttacatttaaaatgtgtaggctagatgagggctgaggacagtatttatggtatgtgatatgtgtcctcacaagatccttataataaaaagattctcacagtatagtagccaaatacaataatgagggtgtgatcaataactgagaaaaattatatagagatgttattaggaggttaaataggtaaaatggaggttagagtttccgtcagcacagaagagagaagagcatttaattacaaaaccttaactcatcccagttcacctggctaaaaaaaaaaaattaaaaagtttgtggcagaaaaagaatttggcagtatggacatttagggaagttagcaattttgtgagtgaaaaaatttagcaattttctggttatctgacatcatgaagatattttatgaatattttataaaaatctacgcatttagactatagaaggaaatgtttagtaattacacatttgtgatattttacgtactcagtggaccttgaaaaaacgtcagttgaatttttcttgcataaataattttacgtatactaagaagtattatatttgaaatgaaaaatactataaattgtttatgaaacatattttgttcaatgaaactgttatgtttttaaattaatgtttttatacaaggcaaagtttttctatttaaataggaagccatctgattttaagggtaatatgtacttcctgtataaaatctcgcagcaattaaactccaattgttaaattgtttattttgagtataacttatactcatgatggaaagttacataagcagtacaataaatatgttgtaaacatttggatgtgctgaactgtgatcttaaaataatgccatcaacatattgttttgatgaaagtcctagacaaatgacacatcattattagattaatttttctttccactgttcatcaaaatatatatccatataaatgttttattaaccaataatctatccataaaagttatttataccaaaatatgtatgcatacaggtaaaagtatgattcataaaatatttaaagtactgttaaaaaaactaagattatattattaatattatgcaagtaatgagaacttcaaacacaatataatttgtgcaaaaatgtaaatttcagaagtaagtgaaaatataattgaactgagatgattacatacctaagcttctaaggaaacttaaaggcaatttcattaataatggaattccctctgaagtcattcgtacgtgtggagctggcatcaaagtattaaaatgttctgcgtgtgtatagaaacagtaaaaaattatttttattttgcctgttgctaactcctgcagaagtcagtcagataattctctcaaaaatagacctgcttttgtttcttttaattgtttacagatcaaaagcttttttaagtgagaaacttgagggacttcactgtgttttcagatctatctgaggggattaacaccaagtgttattttggatgatcagttttacccttgctaagctttgtaatttctcatagctctctgagttgttgcacagtacttgacaatatgaacagttccattggggttaagtgataaagcagttctacatctggggagactgtaattgcttacgttgaataggacaaaaaccccatgaagagagccagggtttgagaaaggaaagagaacatgaataaaaataatcttactttagaattttgctgagcttaattagttaccaaatatgtatttagttgatgtcgttgctgcaattgttgtaaatattctatagcctctacttctcttgacagccaacaggaagtaatttataatgcattataggaacaaaaaattattttgtgtagttccctttaataaagtctggttctctaataaaaagagaataaactttcaaattcaaatttttctctctactatgatcatttccaaacttataaaaaatgtaaaaagatttatatttttctgtcatttttaagttaaagtgtttttaatgtatcttgacttttttgtcttttttgcctttatagacaggtgataaagcgttatttctaaaattcagttatatataaatgatgtagaaatattagtgcaggaaactagattctatagagaattcatttctgttgccgtgttaaagaaaaattcatgattgtttataatttttggaagaaccgtgttaagatttgtaaatcgtgctgactaaatatagctctaaaataccttaatttatactttgtccttaaaagcttttactagtttgtaatctagatctgctttctcctaattctggagtttgaatttctagtaaattacaaggcaagaacccatcccacacttcagtttaaggttctgttgttctgtttgtatatgcagatttagggaaagaaagtctcacattaactatcttcataatttgaggtacaactctattattgagtacacagcctttcattttccaagtggtagttttctttcagtccctaccttgggtgttcagaaactcttgtttggtaaaatgccagtaaattacagatgatttaatgtatatatcctctcatttaagaaaggcaagtcaaattacagatccaggctttgcctcctccaaatcttttccctctctcactttaatgtagtctcaatgtgtggagttctatttcacacaataatcttcatgttcacgcagtgttaataagcctcataataagagttattgtatcaaaacctgcattcacgaatcaaaaacaaactgacttcttgtatataaactttgcaaaacttacatcagtaggtttattttatacctcttccctataattttaaaggttatctataaaacctctctttggccagctttcagttttcatgttttagcccaggactgtaataacagtttagccatcagtgtgccctcttcgctcctttcttctgccaactgatgtgaaactcggtcagtacgtgggtaagccttgaatctgagaacagaaacatgtgaggaaacagggaaattccattctgagttgatccagtgtaactaaggaaatacttacccttggcagaggtagtggggcatgcaaagctcctcatagcgcctgtgaaatgttgaaggaaggggattgctgacaatacaagccagaaagagcttttgcctgaaatactcagataattcaagtaagatctgcacttgatttttttttttgctggggtatgtggggtgagtatcatctttattgtttaacctaattaataacctcaacttttctcacagtaggtttgccctggtactttggtagctctgctgttatcaatttttaacctacaaagatgaagaaatcatatctagaataatgatctctacacttccgatttatgtaggattttatttgcaattgaaagtgcatgtttaaattcttttgcttctctttttgccttgtattaagaaatacaattgaatataagcattgccagatgccatcaccaacgcagccaagtcacagactactgaatgctcttaaaatgatgttgcagctgcaccaggatatcacagaaatatggaaaggcataccatatatcaaagttggctgttttataaaagggcgtttattcttcaagtcttattccaaaacatgttaggccttaggacagccaatatgatgttatagcacagtctgtgttctattgcactctttaccctaatgaagcatgactagatatagcatggggcgtatgagcctagctcacctttgcttttgcttttaaaaatattcattatctgatttaattaataaaatattgtgatttttaaactcttgttaaaggagttcaagaccagcctgagcaacatagtgagaccacatctctattaaaaccaaacaaaatgctaaataaatgccttgattgtaaacattgaggaaaagaatggaacaaaaggaagcatcaaaacaaattcatgttatgctgactttcagcagaggctttacatcttaaagacagtaaaattccaatttactagcattttagcaaccttggttaaatttcctcttctcattccataatctatataaacaactctttatctatgcactcagcttctcttcagtgtaactatatacttttctggggcttaaattatataccattaactaccagttatcaagtgggtttgggtttcctgaaaagtttgcaggtcattaccctgtcagaaatcattgaattcaagccttggctatgccatttatccttgcagcttctaatcagtaggatttctgtgccaatcaatctattcccaattggcctcccttaaatctgaaataatgtattataatctgaggcttcaataaggcagtacactctaaaaagcaagttcagttttcttataaggttgagaaattgagaaatacgaaagtaaattttgccatttggaaatttaattttttttgttgattttagaacatctgtacaggattaagtaatgtctggttgatatgtgtgttgtggctattaatatttatctggtattaaataatttttatatattttttcttttaattttggacacagtacattcaacaatgtatttctttcttttctagaatgtgataatatagattaaatgattacaatacaaaatgctaagccagacctagtggcccactcctgaaatcccagactttgggaggctgaggtgggcagtttgcttgagcccaagagttcaacaccagcctgagcaacatagtgagaccccatctctatagaaaacaaacaaaatgctaaataaataccatgatcataaatattgaggaaaagaatggaacgcaaggaagtatcacaacaaattcattaagtatcctcatataatacagagaatatgttatctagtaaattataattatttagaaataatattaataaattatattacaatgttattgcatgtatatcatttctggtcatggtttatgtaaaactatagttctgcaaagataatcttaattacctatgatttaatcttttatatctcctaatattaattgattatgtgacttggagttactgtgtaaaccagacataacttccttttgattttcatcaagatattgttatatcccctagctgagtttctgctttctttagcaaaagcatttaaagaaagtggcaactataaaattctggtggctccatcagatgaatttgtgaagatgtaatattttgaaatctataattgcatccaaaattaacaagggtcaaataacaagggttgacatgacccagatatttctagtaacctttatttccttgtgccttttcatattcttccttagtgtcttattgaatccaggtctggtagagtatgtaaatgagaagaaactcagagtgaaaatacaagttatgagtaggcttcaaactagaattaaaacaacttgatttgatttgaaattgtagaataaactatttttgctgtagtttcaactttgtcacacttgtttgacatgactaaatcacctgacattggaagccaatctgcatattaaattccatgattctattaaatactatagaaataatctatgtagagtacttctacttgagacacatacagaatatatgcattttagcatcattaacatcattcttggtttttggatattaaaaagatttaactttctattttgagaatgtgtcacaaatgaaacgggtaattttctttgaaagtacgtggcttggaaagctaaaatagaggtgaagaagagaactattcacaaatcattttcttcttatatgacttatctattttttaggtatttcatggaaagatttcagtgaaattattcactcagaattgtaatagtttgatttgttttccttattaaaatgtgtccaattagatatatatgtatatatatgttttattttgttttgttttgtttttcttctagcaatggttgttttgaacaacctggaaccaaatacaacttatgaaatcagggttgcagctgtaaatggaaagggacaaggagactacagtaaaatagaaatcttccaaacattaccagttcgtaagtaatcatctctattttttattctcttttgtcattttcttcacttgcaaatttaatagattttaaaatgtagggagatgtttcaacacttttgagacatgaattatgtctttggtgaagtggtttctgaagacagtgacatctcagatttattaacataaaaataactttgctttagagcaaggcagaaaaaaaagagtgcactagaatacactcagtaaaaattgttcccgggaaattgtcctcattgcaaaagcgtccttcttacttatggtctgattaattggattgtagtcttcagactatattctgggagaagaaaaatgtctatgtaacatgttcaatattttgttctttttggaggcctgactattgaccttgttccacaaattatatgggctctaagtgtcagaaaaggaatcattatgttaattcattaaaacagtgactgcaggagaagccttgttctgataactatcatattttggggaattgtaagttaattgagtttacatagagtgaagattaaattttaaaagacttaacatttcctttatgttaaataaattactttaaatgtgagaaaacataataaatacgactgaaccactgttataaaaatctatgcgtaacactgcctgatatatatatctttatatatatatatatatcgttgtatatgtgtatatatatatctttatatatatatatatatcttttatatatatatatatgttaggacagtcaaaatggctgcaatatattatcttacagagtatctctctcttggtaatcataaaatctgtcaggtaagtttcttttctccattcccaatgctggtggttaagataaccagccagatatggtggcttacacctgtaatcccagcattttggaaggctgaggcaggcagatcacttgaaccaagaagctcaagaccagcctgggtgatatagtaaaaccctatctctccaaaaaacaataaaaaaagaatcagctgggtgtggtggtatgcacttgtactcccagctacttgggaggctgaggtgagaggtgagatcacctgagtctgctgaagtcaaggctgaaatgagccatgatcacactatggaactccatcctgggtgacagagtgaaaccctgcctcaaaaaaagaatgaagaaaagaaagaaagaaaaaagaaatgacaataacctgctgagaagaaataacaggtcattccggtttagagatatgaaatccttttcagtgcatggtctgtttttcttggcccttcacatagaaaattcttgcactttggtagatccctgttctattcaaaacaatataagcatcattgttatatggctatctctatgttgaagtataatatcaaaggcaagtatatgaatgaacctagaagaaaatgaaatattgaaacacaggtctataaaattggatactgcaaactttattcaaatttgcacccaggaaagaaaatgcttattaaagcacatttactaattgcaagtcattatctttactggtaggtatatattccatacagattgatgtattaatgtattcatattaataaatgcttacaaaacatttacaaactaaatttacattaagaaaataaaaatgatttaatactattaataataagagaaataaagttttacatttgtgcaatgctatacttttctcagagcatttgcatatcagtgaaaataatatatttggtcctcaggctacagttttggcatgacacttctagatttataatgttgctgcttcttggatagggaaaatgatcagaaattatatcacaaaagggcaatgtcaaatggtaaatccaggataacaccatatattttgattacattactgttctttttattaaaatatagtttctctaggtatctgaaatgtgtgcaaatgaagaaatgttgtattgtatatctaggtgaaccaagtcctccatccatacatggacagccaagcagtggaaagagctttaaactcagcatcaccaaacaggacgatggaggggcccctattttggaatacattgtgaaatatagaagtgtaagtaccttgtttattatcatatcatgctaggttttttcaaattaaattgagttgcactgaatttataaacatatcaggagagaatgtgtatttagtaattgtggtaataaatgctaatcttccttccattcctgacagtcatcattgtgatttatttttattttttttgtaaaatgtaagcatggatcatcaaagtattctcatggttttcatcttatgatttttaggtgtgaaatgggactagtaaacatttcagaaatgagatattatttcccctgttttgctgacaagcttctcattttatttgatattagtaacttcaggctaagtccctggcaatcatatgttaggtaatattattagaaaaatcacacctcaaaacaaattaatcaaataatttgacttacttatccatcatgtttaacaaagaatggccacggtgaacttgatgaagagggaatccttttcttcaactttaattagcactatccagtaaggatgtttggagagctaaaagctgcacacagatttttgatagcggttagaggtaaacaatgttcactagttgcagagtcatagagtgacactatggacaactgcgttttgccttcagaaaagatgatttcaaaagccactgaaaataatttcttcaacatttttttccataagtaccttggagtattggtgtctactgtaaaataagttaaaaatgaaacacaattttaagttaaattttctaagattcatacaacatgcgttttatgcttatgttgactgaatccatattagtgctatccaaattaattatattttagcagatcatgtttaaaataattactccatagtagtgtgtgggttaattttcagtattttctcatcaattttctaaattataatactgctgcttctaaatggaaagatctacattctgaggggtaataaaaaagaaaaatttgattttgaatggcatattttaataattaattttagatatcaaatcaatttttaaaatttaagattaatactcctttcagaggacaagtttttgtcccagctttcatactcaagtgaggtctcctggccattctcatttgcacatttgtaaacacggtagaagagagataatcttttctagggaggtaggcttggccagaattcatgaattggactgttagaacaggctttccatgcagattgttgctcacaattctaggatgaaaaaatttattgtacaaaatactgggggatagtaacagtttgtaaggaattctaatacaatcccacagtggactctaaaatgcaatgactagttgtgagacaacgtgttgtatatttttatttgtactgtattgtcagtagtggccccagtcattgatgtaatcaaaaatatttcttgagtagcactgcatctatttagagcaaagcagagtcacaaatggaaataatgacattttagacagccatatatttatgtatacatatacacagtttaaaacataaattactattttaaaaatctgacttcaaattcatattgatttctttaaatgtggattagaattaatcttttttgagaagttatgtgtgaaacacagatggatagaaataagtaagattttaagcataatgagattagtaagattgaagagactcaagttcatataatggtactcaataaattttacctttgcacatagttgctaaggtatagttgatacggcttactgataaagtttaaacaagaacaaattttgtctccagtaaagttactccttccgttttctcgcctttctctttctcctcccaacctaatggtaaaagtgcctggtttcttcccagttacccagtgtctgtgcttaccacgccaataaaagtatgtccttttccctcctcttctttctaatttccaaccctttctaactccagaagtgctagaggatctgtttttcataacacattggaaatgattgattgtattaattcatacataactataattgtctgataatcaatcaattactaagttatccatcttagagctactatcattttaacaggggacattgttttaatagtagaaatttaggcacctatggcaaattttgcaaagggaatgattccatatcctttgtattatgagataggcattgctcactcttggctattttgtattttgtaattaatcaaatataaagtgatactttttcacatttttttcaagcgccaatggaaagttagagaatttgagtgacttggtggggagagggaacagacatcagaatgtaattcataacagtctaaatatggatggcagcagtactgggcaagaggcaacccctcaatcactatctcatctcagctcaactgcccagctcttgtgccttcggatacagccatcctggcacagtttctcttgaccatatcacttgatagtatgccttctagtttcatcattaaaatactctatatatccctattttgttgttgtctcttctcttctccacctcctccatcctgtcaacatcatgctctgaggatccaattggagataccatgattgaataaaaaatgaaataactacttcaaaaagttcttgatcatctgttctctttatatgattccaaactacttcatctattagtttctcaaaccacatgaactccacagtggaataaagtgcaactgaataacttgaaaaaatggtttagacatattcaatatatttttaataaaaaatgaagaaaaaagtacatagaggaatctggaaaataagaaacagctctaagattttcacttcttgatttcttctttggccacatctttcaactccagtgtgcacagggctatattctgagaacaatgtaatttagacaatatattctttatatgacttgatttctagcagacactgaatctaagcctttaatttgggtttcactgggaaaggacaagaatagctatatcctattatagaaagtgtaaaactccctatagattatgaaccaggaaacaccattattctgtcagcctgtaatacagcacatggctttgttcactcacccattacaaagacagaatttattggaacagaactagagtaataaaagcagaatgagatatttctgtggactcttcatgaaaattaatgtctctaacaataaatcagtaagtttaaaccgtgtgtttggaaaataaagacaaacatattaatctcatgaaatgtttggaaaaaatcatgaagttatttttacatctactttgtacttatagtgtcaatgtaacttcatataatttagtacatagatttttacatgtttccatgagtttttcaccattttatttctaatttgatgatagctatgggatcataactatcacttagtgttggcatattaaatacatttccttaactaaaataattggtagcttaaaatcaattgtgaggaagtactatagggactagcatttgtaagtcttaattgaacttcttaagtaagttggagtccacgaggttgtacactatctcaatggccataggataagaaaggtaagtttgaaaagggcattaaaataataaataagtaaaatcaagctttggttcttaagaaaacattttccagttaataatgtttatgtatgtacatggaaatttatttaaagccattatagtttaagttttgaagtatttttaaacaatgaatacttatggacattaaagagtagcaagcattttagtaatttttctttgctgtaagttaagaggatgagttttattcttctttgtatagatagactatgtgttgtctgaatgaacaaatacagcaagaaatcaataaagaaattagctcactatgcaattataaatagtattataaatagaataattaatatgagaaataagaaacacaagaaaaaatgcactgccaatgtttatagatatgagaacacagaaggtaatgaataggaaaattagatttattttgccttaagtactatgtgggtggtggagactagcaacagattatgtagggcctaattttaaaaaagtttaccaagcatcagcacatggaacaaaggcaagtagaatctgttatgatcatggaaaaagagatttaaatttagaactcggctaaaatcttcaaacctttaaatcttccaaatgtatatatatacatatatgtacacacacacacacacacacacacacgcacacatacacacacacacacgtatatataattttatatacaattcggtgttttaaatttaagattaatatctttctcagaggacaactttttgtcccaggtttcatgctaacaatgatgagtacctgtttgtttcttttggatattctgatatggagacttttgtgcctctacccaggacagctctgaaggactcactggtctctcgatgaatctgacagtgccatggtattcaagccaggtcccttgatgcttctcgtttgcccatttgtaaactcttcttgaattctgtatatggtctatctgtatatatatataaaaatatatgcttgtgtgtatatatatgcaattatatataatatacaaaatatatgtataaatatatatatatatatatattatatataaaatccagactgatcaatcacctctctgacattgagagtagcaaatggagttttaaataatttctgggccttctgtgaggtcatgtaaatatgaatacctgaaccatgctaccagggaatccaggaaccgggaactgctttatatacatacaaaatcttaaatcataggacatgagagtcagaagaatcaaaacttcatcttgcttatatgagctcaccttctctattgtcctctcattttataattgttcagtttatatttaaaatgatgctgataatacatttcatgagacttcaaaaggagtcagtaaactgtttcttgttatgaataaaagtatcaagcagcccctgaaaataagaaaatagtgacccttacaccttgcctctaatcacttccctgtagagatgatagccaatactttcctgaatgctgatagtatgacttcagaatcactattaagaagtaccctgaattgccatatggccctgctattttctgaccaaaaaaaaaaaaaaggaattgcttaagagaagcgataccaaaggcaaatgaccattttttttcagtagctgcccttcaacatttaattggcttattaataatagccatattcagcaaatcatctcattaagttacctaggggaacgttttgcaactagattatcttaaattgttccctaggcatttcaacctttgtaaattagacactctacagatatgcatacttgagattttgatgccaggggagtatttggtaacacccactttaatttttttcctattccctaggaatagcaattaggggattaaaatgccttcttgcctaatgttgaaaggaaaatgtaattgatttatgctgggaacatgttagagctccctttggtttcttatactatcagcccaaatacttaaaatgatggagggccctttaatttatcatattaagggcttcaacaaataagagctaaatgattgttaatttacaagagactgccttgtgtttgtacagaagtttcaccttaaatgtctaatttccaaaaatggtatttttgaaggattacctgaaggacatgacatctatctatccctctaaagaatactttttttttttctggggtaattaaggtctcattttttggcttattttctggctctttcacccacatcttcactcagatacataacaaaactgaattccaagtatttccacaaaaatatttactcacatcaaccacttcatcgttacatagaaagtactgaatagctgaggtaatgccagggccacagggacatgcagctgtctgctgcctcatggatcccttgtcttcataccacccttcagtgtccttgccatacaccccttccttcccatatatgtgtgtgtatacacaatttataacttataaaaatacatgctacatgtatatatgtgcatattcatactgaatatgctatacatagcatttacaattatatgttgtgtgtgtttgtgtgtgtatatatatacatacatttaacatatcatctcaaattacttttgggttgactttttaagcttttttgttctatgtaggtctatatatataacacatatataatacattataatacatatatataatacacatatataatgcacatatatatatatatacacaatttttaaaaatttatatgaaacagctacagtgtttgcttatacatctcccagtgattatgcatctaaggcttaaaatcactgtgtttctttttggatttaaagctgtgtaaaaaactgacaccttcttgtcattaactcaattaggacaaatgaagagaaaaatggcgctagagtgtattatttccaggaagggtgatatcacctccccactggtgacctgcctagcccttgactttattaggtattatgtgcctccattccaccttctcatttttcaaaggcctcatgtctttcttctgggctggtttgcaaactacaacatgagggtattgcacatgtcttggtcactattgtgttcatgccttctagaaagtcctcactaatcaattaactgaataaataattgatgaatgagtgggtgaagacagagggtgttgtgatagctgtggctttttagcatagctgccctaagcatttcaaaattgcaactaggtttctttcttaaccttactgtccattgattaacttagaaaagttacaacctctcttctcagttattccatcgttcatacatctcataatactttaagtagtactggctacaggccatttttataaaaacagatattcctgagtttcaaaaatcaaggcaagtgcctcttgtgtatattgataacttgtagtgcttgttcatttaaaaccagggcttcgttaggggttctaatatcttcatttttacacgaaatagcaaaacaggccaaacttttctgttcctttgtaatggaagttctatgtcaccaaaaagtttatttcctttgtaataaaagttctgtgtcaccaaaaaaaatattaactagaaaaagagaatactagtatgttatcaaaattacaatgtcttcttgcctccttctgaaggacactccatgtttgagtactgtcaatttaatgcaatcatgaatttaactttcacaattatattttagagaacaaatacttaattgtcaccaaaaatggagaatacatcgttattctttatactcaaagaagcagtgttaaattgtggctcaacatagagtaatacagggctgagctatgaggttaaaagacatgtctgcatctattgttatagacaggctgtaatttatttatatttataccctgggaaagtgagatttgcagttgcaatgatagattattagatacatgatttcagagaaaatgtttcatttccatacagtttttatggaaacagttatatcctaaaatcgctgttatttttttaagtggttatgatctctaaggccctgaaatacacaacttactcaattttcctcattgcttttccaaaaacctgacagaagcagctgctaccatcacttttgttataaagagaaggaagacaagccagaaaggttaaggaagctttctgtgtttaaatttttaatacatggcacaacccaataatcacactgttttagataatttaatttataattgtatcaatttatatttcattagtaattgtagttctaatggtaattttttcaaataaagggaaattcaaatgtcatatggtcaaatttatattttagaaaaagaatgagatagtatttaagtgtagaatgtttgagaataggatggcgttgttttatattcttatgctaatgatatatttaaaacttagtaattttgtttgtatattattttatgtcataaaacatcatagtagtaaaaaataccagtgataatataaatctatcattcatatccagactttatttcaagatactttatctttcttccccccaaaaaactttaacaatagtccctggcaattcttttaatggacatactaagttttttctgtgtatcatgtttcattttcccattcacataatgatgaataatcaacaaaatggccaaaaaactaactgatatatgtgaaataaaaaaaaaaatcctaatggaggtaaattgtcaaccactgaataaaggattaatgacaaaaccactttttggctaatataaacaacattatattttatatagaaaaatgttggaaataatactggcttcattgacacagcaacttcatgtatccctgtgcctatgaaaattgttccaatatccaatataagtatattgttccaattccaatataatttttttaaaaaggtgtcactttagtgtatggatatttacaaactgcatttttattgctttcacagaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaaggtaagcaaaactatattcttttttagactgaacaataaatatgataccacctttttataacccttactgacttttcttattaataattaaaacaaactgaaatgtaaattccaggttctaattattattgtgacatatcatacacaaagtttctcatcgctcttgccatagggtattgcttaatttgtaaatatattttgaccccattaatagttggagtggtggagaaagaatgactaggagaacatagagagtaagagtgactgatgataatcaacgtgaaaagtgtctattgaggccatacgaaagctttgctaagaagacaatttctctgccaatcatgtggagactgatgatccaattcttgttagatttgaccgaaggtaatgatgagccaacctatgcctgaccaagcaagttgattttggaaacataaaattagtcacaaagaaaggcaggaacagccacaaatataattccataaagacctatacctagagttttaagaaggctcataaaatgggagaacactgtaaatcagcctttgcaacacactggttagattctaccattgataggtaacagtgcttacattgttacatcttagtatgttagtaatattatgaaagttcacaacagggatgttaaaacttttattcagataaatgctcttgaagtaaagatgcaaaaatttattccgactcaaaataacatttaactctgttcatgagttgctaaattggtcatatttctacatttattttccctcagttattacttttaatattttaattttatgcagacatgtacagatatttatgtatatatggtatattctttataggtacatatatacagaaaagaacagcatattaatccatgaaaccaagatttatttgtcttattatattagagtataagtatagatatataatatttttgaaactggaaaagaaaactagctagttcagtcatgtcattaaaccctcttgtaatttcaaattgatgttaatttcacatattatgattttgttatatcatacatcagttgtttagtaattgaaagcagttttatatgattaatctttcaattaaaaagtaattagtattggttataaggtttaaaaagtaattgatattagagctttatattgctaatgttaataaattctaccaaattataatttaaaattaggaagtaaaaagtccctggaaataacactggtatgttacattttaaggactttttttactattttcaaagcccttctgcattgattatgtcattttattcttaaatctgagctggataaggaagcattattctcattttacaaatatgattttaagaggtttaatgacatgttggaggtcagaaatatttctagttatatgacaaatctgatgcccttacaagataacacatctaaataagaatgactgaatgtactatcgaattcattacctctctatgtttgaaacatcagaaaccacttctacaattgtaatgaatacgtatgtggtaattatatttcatgcaaatatcaggaacatgctatacgtattcccatactgagccagagcctcctccaaaggaaaattgcaacagtatatactataatctcccaaatttttaatttagtgtatatattttgaaacataatgaattaacttaatccgtttaatttaataatgtattaaatttaatatatgaagtagaaggcaaaattttaataacatagataaaacataaaatcaaaaaaatagattttacacagattactaaatgttatacccccaatgactctgctatctttgtaagaaattgttggccgggcgcggtggctcacacctgtaatcccagcactttgagaggcccaggtgggcggatcacgaggtcaggagatggagaccatcctggctaacacggtgaaaccccgtctctactaaaaacagaaaaaaattagccgggcgtggtggtggacgcctgtagtcccagctactctagaggttgagacaggagaatggagtggacccgggaggcggagcttgcagtgagccgagaccgcgccactgcactccagcctgggagacagagcgagactgcgtctcaaaaaaaaaaaaaaaaaaaaaaaaattgttgatgataaaaaccaacaatacgtgtagacaaaaggttgaaaaaattaaaaggtaataaaagcagatatgaaggcaccaaagtaaccaagacatgctgtaattcatttcctctctctctatatatatatatttttcaatttgagaaactcgtgtcctgagagctttgtaggcaagacctggaaagaaaatggatagaattctggtttatattcccagatttgttcctgtcacataacttgtcaaaataactgtttcctcatctctaaagtgagttccttctggttctgcaatgttaagatctatcatttattaatttaagaattatttattggagtacttctttgtgacaaacccttgaatgagtacaaaggatttatctgtgaaaaatacagcactgacccatgtcccccaaaatctccacagtctggtagagaagacagatattcaacatgagttagaataactgcaactggccgggcgcggtggctcacgccagcaatcccagcactttgggaggccgaggcgggcggatcacgaggtcaggagatcgagaccatcctgactaacacagtgaaaccccatctctactaaaaatacaaaaaaattagccgggcgtactggcgggcgcctgttgtcccagctactcgggaggctgaggcaggagaatggcgtgaacctggaaggcggagcttgcagtgagccgagatggcgccactgcactccagcctgggcgacagagcgagactccatctcaaaaaaaaaaaaaaaaaaaaagaataactgcaactaagagagatttttcttagaaggtgagtttccaaaggaaacatgcaggaatgaactttccagggaaaatgtgtgacgtggaaggtatctctgggacaagaaagagcatgatctgttctaggaggtggaaaaggcatgtgtggaagagaacctggaagtgtgtgactatagataaggtcagagagggaatgcaaaccagataattcaagggcttttaaaaacgtaattgtaaaacatcttccaaaagaaataaataattgtaagcagaaaagttgtatgaagagataggtattataaacagattattctttctcttatgggtaagagcaactgatggatgaacagcggtagaaaaaataaaagaacgaaaaatttcctgacacattataagtgtagactaacgctgcctttgcaatagattggattcagtcagtaatgacttctaggtttcttgcttgggcaactagaacattgctgatgtcatttctcaaggtgaagaattttgtaggagaagcaagacttggagaatgaggatcaaacatcagatccatttagtatttgttaaatttgaaatatcaaatcgttggttagatatgtgggcgtatggaaatgagaagataaccatggcttggaaacatacaccatgatgctgtcagtgttaacaggtgaatggtatgtgagtgagggtaaacccgtctaagcaatgcctaaaatatctgaagaggggttgatgtctgtagtactcatttgtgtttgccagtaactagaagggcgactggcacagcagtgatttccagagaatatttcttgaattactgaagagtagaaagaagttaagaactgagttccaaggaactatcatattatactagaagaagaaaccagatcactccacccctcatcatgagactaacactttacaaacttactggaaaaacaggagcgtagtatcttggaagttaacaaagggtcatatttcaagaagaatagatgtaaagtgtcaaatgctgctgaaaggtcaatggaactgaaccagaacagatgtgaagtatccctatcacgtgcagctttgctgacgtcattgagagataaattaggtacaagtgggcagagaattgtatgtgaggttagggagtttagactccatatttatttaatgctttcaggaagtttttctatgaaggtgagcagaggagggaaaaagccagtgttagaaggtcttttatgatgaaaaatgctagatgaaacaaatcaaggagtcgtggagcaatcacacatacaggcacacagacaaagccatctgagaaggtaggagatggtattcacccctctaaaccatgtagctgatacaaagccatcacaacttatcaaaaaaaggggaaaatgaaatatttattttatttgtaaaaatgtcacaaattcagccaggcgcggtggctcacgcctataatcccagcactttgggaagcccaggccggtgacaaggtcgggagtttgagaccagcctggacaacatagtgaaaccctgtctcttctaaaaatacgaaaatgaaccgggcatggtgacacccgcctgtaatcccagctactcaggaggctgagacaggagaattgcttgaacccgggagttggaggttgcaatgagccaagatcgcgccattgcactccagcctgggtgacagagcaagactccatctcgaaaaaaaaaaagttataaaatcgtgtctaatttactgttactgaatccggattgctaaggcctcatagaaagtcatatcagaaacaaaccataaattaagaattgtttgatttagatctaggttttgtgaggcaattttaaaggctgtgatgatggggaatttgagaacctttcagatcttatagagttaacattatatatttgcaaaatatgaaaaaagatcatataattttataacattttatttttcattttaaaatgaaatataaattcaaacatattagaaataagttatctgtaataaactagcacatcttaagtcttttcatttaagttagagaagatatagagtttaaaggttaaagtggttttaatttatttttatatttcatgcattgtagactgtcaaaataagttttctggaattttgaatttaaaaacccattacttatgtatattagatatatttaactttttgtaaacaatagggtaagtctagagaacatttatttgttggactaaagcactattttttcgttttttatcaacctactccctttacattcatataaaatattacattgataacaataatttttcttgtaagtatgctagtggatactacatttcttcttagtttataattattaaaaaataattttgtaattaatatttttcatttttttcttattaaagatgtacttattttgaaagatatgtattttgatttatttaaaatggagtttccataatcaatcgtgttccttttcagaatattcatgcagcataactccatcttattttattttataagaaacaagaatattgggaaactatagcagattaattgttataaaatgactaccaaactatggatttcaaggctgatagcatggcatttattgatttgttctgtaatcttaatgactaaaaatactactaaacttctggactggatataatctaatgtttaaaaaaatccttggaaataaataaacttactttgaaaaacattttcaccatttcttttggcctgccacatgtttgataacatttatatttaaccaaaaaagacgttagtatctttcagtaactgcttccttcttttcctgaagacatgtctaattttaatattgactatcaatataatttgatgacaataattctgttcaacattttttatattcaatgataaaataattctgccctctgggaacatgtaatgcatacataatacatacaaaatagttgtttagatttaacaagctaaaaaaaataatataaatcaccacaaaaaatattgctaaaatatttcagttactttgtattttcatgggcttttaatttgtacttccaatgaactatacagtaaaattattttgatcacctcaactctagtttcaagcaacactaataaatccttcatcactagataattcaacatgaacagaaaacaactttcaaacacatggcgaatatgaaaatattattttaggattacatttatggttgttttagaacataagtttaaaaattctaaaacaatggtgaaatagaagtccaattacctggggaaacttcatcttaaccctctggaattttcagtctaacctaaatattgatactacacctgcagcagcatttagtttagcatgtagtgaaaaagtaagtctaaaaaatattttcataatctttggttcctaaaattgttttaaaagagatgcagtgacatatgtctggagtttgcttatggccaataggttaatgcttctagcttctatgcttattgcaaattttaattatgtgaatatgcaattttcacttatatttgttggtagcttgtttattattaaaatagaatggcttttattaaatatatcctaagaaattacggtagaaaaaattaccatcaaacattgtgggatatattgagatcatattaaaagtagcactgtgaattcaccaatagcacagtgaaatgactggtgacttttcccttgtaatttacattttcaacttataaatgaaagatattcacatgtaagggatcagtgacagaattaatttctgagtaatgcagaataaacatcaatattgacctttgtatgtttttaatatgtgacaatacatagaaatgttttatacaagattttagccattcttgttttgtatgaaagtattttttgtaggtttgcattaattgttaatgactttgtgtaaatcttgcattaattattcttttttctttcctactgtcacgttttttctcttttgatttcctcgtttgtaactctaccctttattttcttaattatttcattcttattctattttcaaaaacaattttcatcatgcagataaatgctgtgaagcgaataaaggcgaaaatggaagccagtcgtggcagctgaatgctgctgggttttctttcattatagccataagtttgtcttgcgtgttttaatgtcattgttatatcatatggtatatcctcttatgccctgaaaattaaaaaaaaatagtaatagcaaggcttatctaaaattataataaaatatttcctaaggtccaattaattatgcatgtatcttcacccatgaatgattaagctttttctccttcccccaattatcaaccttttaagtggataatttgtcagaaaatcaaatgaaggaaattcaatcgggattgctactttcagctaccagttcactgcataacatactttattctaaattttccattaattcctaaagttgaccttgttaaatagcatgtcacttgtacttgaaacttaagcctttgctacatctaatctttcattattattttgcaaataattaaatatccatggccatactttgtaaaaatcataattttattatgtagaattgtggatcactactattgctttttttactgttacttttaagtataagtttccaactttatgaacatttctaatatttcaatgtgtttaccatttatataaaacataagcattatattttattagatgtgtatcccaattgtgctgcttattttccctttgttgaaccaaaatgtcttaaggaataaatgtgaaacagtttcctattttaaatttgaacaccgattaatttttttcattaagtgaaaatatctctgcaattttcccagaatgaatgttaaattaaatttgtatatgtctaaaaagttacacccaattcactggatttagattacattttgagctgacctcaagtcctattgttctaacataagtagttatttattacatttttctggacatctggtagtcagaatccttgcaagcattagagagagagaagaaaatattatagacactcctttaaagaagttgaaatcaagatgggaagaaattgagattggaactagattccaaatttcaaaggaatttcgatttgagggagtagcatgaagaatgatttttggtctttgcaaattttcattatgtgaatatgcaattttcacttaagtaatctttacctaagtaatttcaaaacaagtaaagagtgtttgtgtttttcacttgcaaccacatcttaacaagtgacttttactacttatttatttaggacaataggaaacaaccagatgtacatatatgcataaaagtgaccataacatacttggtaaatcaaatgattgggttctggactctgtgattcattcatcaaaagctatcattttgttgaacagaaatatttttcgtgtctctttttaaagagatagctacagaatcttttcatatgagggctaggcctctctttcatagtagattttcttttaacttatcttttccaaactcctagctgtcaactgctatcctttcttgtaatctagtaatagacctgtagactgcagaagcaacccatcaaccgataaaacacacttctggccggctgggcgcggtggctcacgcctgtaatcctagcactttgggaggccgaggcaggtggatcacgaggtcaggagattgagaccatcccggctaacacggtaaaaccccgtctctactaaaaaatgcaaaaaattagccgggcgtggtggcgggcgcctgtagtcccagctactcgggaggctgaggcaggagcatggcgtgaacccgggaggcggagcttgcagtgagccgagatcgcgccactgcactccagcctgggcaacagagcgagactccgtctcaaaaaaaaaaaaaaaaaaaaaaaaaaacttctgcttccctcctttctcccctgctgagataaaacgatatctcaactcacacattatggaaatataatccatttatagggcaagttttgtttttaaatcaccataaccaatattccgtttattaaataactatcattgcatattaaatttctcgatatttgagactgaagagtttatattggttactaatttgtagaaggcgttgataaaaagatttctagtaacacctccagaaactgttttttacattcattgtaaccttacttgatctttccaataaattagagacatttctgtgagaatttcatgtagaaatgatcttgacttaggaatgacaaaatatttttttggagatcacggaatacttatttagtaagttagtgcaaagtttatttatcttgaagttttacatatcataactcaaggtcactaagtgatataaagaacattcaaagtgaggtatacacagaaataagatatatcaatttggcattttgaaaagaacctaatattaaaattatgttagcagagttatatacatttaaagagttgtttgttagattttaagcatctaagtgtggatctagttttagtccttaactttataagcagtctgtcatttggccaaatgtttattcttacatgaacacctatttcacaactctgagatacacataaattcttttaaaaatattctcagagatggtaaaataataggctttgtgatctgccttatttctctaagaaattaaaaagtacaaaactaaacaataaagctattgcattccaataaataaaaccttagacattttacatcctaggattttttaaaagttttaatgtgttgctgagttatcttttatattatctgaacaatactgttgttatatgcagccataaaaatcagacagtttacttgtttattttaaaaatgagtttgttacttttttggctttactattatttcatctgtctacccatctaagtaaatgtgattactggtaagcaagacataaaaatttaaacttattttaagtatcttcctagtaccatccaatgatttttttttcatacaatggagttttacataaaattctgtctctgaagatgtataaatttgagcttgtgtgttgagtgtaagattagtcattatatataatcagaaatatatgtctatgtccaatggtgtgtgtattgtatcgttcactgttaaaatatttcaaaagattgttttgaccgtattaccagttatgaagctagattgatttacttatgcatgattgccattatctgcatgtggaatatcaggatttttaaaatatagatctggatatctccttctttctcctcccaatctcttctagtctgtcttctttcctccattttacagtcaacgttactggcctctctaccccaatcaaaactataattactcatcagttcacagtaagacccacaagtaccatgtttcagatatgctaacagagtaggcctaggaggtagcagtaaattctttcctataaaatgtattcttacgtggaaaaaccttaggtgagttgctatttttgttcatttctttcctaatactataggtcattaggacggactaagtttaattttataaactctatattcatattatttccagaagcattttgcaaatgcacatatatgccttcattcctggtatacatgaacaagattgaaattaaaatatgtaaacattttaaatatgcctatctatagaaggggttagattgatgtttaatatatatgcaattttcacttacatatagcaaatacatataaagacaaataattttattgcaaataaatttgactttttaaatattcaagttctttttaaattaacaaagttacaagtatgcatcctagtgcacatgttacacacaataatatgcaatttgtgtcaattgggaaaccattataatttaattataatattttctgtgtaagaatactcattcattatgtttgagttaaattaaagctaaaacaagaaaaattccaaagtagtttcaaccacgtacaattaaatttatgattagtcatttatgttaaatgaaatatattgtacaagaaagaattaaaccatgaacttttggatctggaggtattcttagatacataaaaataattttaaatattaatatggtatatttaccctgataatggagaaataaaaccttaaaattacaaattattttaataattcaagatggatactgatatcaatacaataatacaatatatttgggtctagctttcaagactaatagccagtattatgcatgataacatttgagtttgtagtaattaagaaatatccctagtcatgtaaagttttctttaaaggtttaaatttgatattaatatgatataagcaacattaagagcttgaaatgatcaattctggtattaaactaaatattatcacatatatttttgtctggccttgtagtattatgatttcactcactgaataaagataaactataatattgatcatacctaaatatgtaactttatgtgttttattatgattaatctgtgtaagagataatgtaacatcctttaaatgatcttttaataagtccaatttaattatgttttctttttctattttaatttttatttatttatttttttattttcttgagacagactcttgctctgtcgcccaagctggagtgcagtggcctgatctcagctcactggcacctccgcctcctgtgtacaagcaacactcatgcctcggcctgcctagtagctgggtgtgctactaggcgtgcagccaccacacctggctaattttgtatttttagtagaggcagggtttcaccatgttggccaggctggtctcgaactcctgaacccaattgatcctcctgcttcagcctcccaacatcctggaattacaggcgtgagccatggtgcccagcctcatgttttcacttttttaaaatttattttcttttatcctttcttactttcttctaatgctttatttttaattttctccctttttctctatttctgtctcttcctcctttctctttctctccatttctctcttttgttctgtctctctccctctttctctctctgtctctcttatgcttcctttctaaatttttggccatgaatgaatggaatatatttcctctattatgtttctgttcattgtttgtaaattttaaaatactaacctttgtggtatagaaatatgtcataaaagcttcagcaaatctaatatattggatagatagctgaaatctgcatatttcaaataactgaatatacagatattctacaaattgtctttaaaatgattacaacttatgttgaaattggtgacgaggcatttccaaattaatctcataaatagtattgtttaatcattaatatttgatagttaaacataatattcagaatatatttccacagtaaattttgggacttaactaaagaaaaaaattaacacttattaactcgttctcttaccaattaccatataaattggagtattattctaaagttaatatggtttgtcttttaaatacaaagttgtattattccttctacatgttatacttacataatcccaatttttatctaaggaaaacattccctcagtttaaatctaattttatttttttcaaaattagacaaagatgagagtttaatatccatgctttgttttccaaaaacctttagttttgttgtctaaaattaagaactcaacaaagatctcttgtaataattcaacatattccctggctattaactaatttccaagcctgaactgtcagtaaatgttgcacatagcctggaatagtccataacatctgtattagctaatattctgtaaaactaaaaaaaaacaatatccaagaaatgtaaaaaataattatgtttaagaattctattagtgtttctgagatggtcttaactgcatttcatctcctttgttggtagactattatttcatctactttttaaggatactttcatccaagtagaattaaacttaattttaattgtgaactaatctaatattggttgtattaaatttagatatattgaaagttctaaaactatgtatgcttaagttaaattcaattagtctttatcatttcattttagttagtaaaaatatgttacacactgtaaagaatgcataataatgagacacaacttcagtttagaaaatatatttttatttttattctatgtatgtactgaataggggctacgacataaatctagctagtcttattttttttcctaaaaagcaagcaattacaactactgttttaaatagtgtacacaattcatgtacccctttcaagaatatttttctcttacattttcattgatgtcatgtataacgcttctgttttaaagtacttctgatcatttaattgcattcgttttcatcatagcttgttttcttgaaaaaaaagtatgctataagtgtattgtcctcagtatcatcttatttaaaaccctcaacataatatccagcactgtgtgtaatcctatgcgtgtgtttcatagtatattaaatgtcattttattttctgtacctctgtgtctccattgttgtaataaagaaaactgaggaaaagctttgttatacgtgttttctttattactggtacagccttttttgtccttgtcgagtgttgtcatatctaacttgatcaaatttaatacaaacatttatttacttaggagcaggtaataaacttatactcattaagttactcaatttttggataacccatacatcatcagcagattcataacaattgtatattgtaaaaataatttcgtgacaatatcaaatattgttacttccattgtaaacttgttctagtgtcttcataaaaacatcgatctctagtgggaggccaaaataatcatatatttcaataaaacacatgaacatagttaacaatttcagtaatataaagattgttaactagtctccattgctagcaaaagtccataaaggaaatataaacacgtaaagtgatttttctccagttcctttggtcatttcttttgttttgggcaccaaatgaataaagttgcagaaattgattaacattctgtgcttatccactgcaaaggtatgaaacacaaatagtaagttgaaattttggaataatactataagtaatataaaaattatttaattagcttttatagtgtaaaaataatttttgacatagatataaacagaaaagtcatatttttcttttagagcaaaatgttacattgcctgataaatatgaaatgatgccaaaattcaaaagagaaaatgttcattttcaggattttggattgttttggagcatatttaatttctcttattccatgacagtccagtccaaaatgtatattttaatatatacattattatacaccttttgaaacatgcttgtgtatatttcaaaatgaaaattttaatgcatttataagtcttatatattgtaatacttatacttcttttaaatgatacaatagttatagtagtttgaaacatacaccagaacagttatttctttttattatttttgtttttatttttcctgaatccccttgataataggatgatatcaaatggagggtatcttggaattcttaggaatttgtatgattactgttgtagtaaatatatattactttattaattttttattgttctactattctgggccattgtgaagaaactaaagagatttgagaaaatctgaagctattataaccaaactctattattttattatatcaacaaactgaggatcagaaaaaccaaatagtcattgatatagtcaagcaactttgattctcagttttcctcctatctttgttgtattacactaaatcaaagttggtacaagtaaatttctgacctataagttatatggtcatatgtcttaggtctagttcctttgctattttcttgattggcctgtggagaacaacaacaaaaaatccctatgtgtcagaggaaaggctatgtgtacaacaaccacggtttcatccattaatcacagtatttctattagtcagcttttatctttctcactcaaacttttacatatagctgcttccctatgaccaaggtaagtaagcacacattaagtttatggttttaaatgaatatcaaattaaattttcatcactttcttgttttttacacatattttgataacaccttactaaattacttatttgcattgttggtagagataggtaatttttaattaatatatttttatttactgtccactaaaagtaagatattttcatctcaatatgcatcctttttattttaagaattcaaagtaaatagtttcaacacttacaatttgcatagcagctatgtgtttgcttctctactgatttcttatttaatattacaaagagaaacaaaatgttaaaaacaagtattcaagatagaggactttattttttctgtttaaatgtggttaaataaaaaataaattatcttcaaattggcatttctgttttaaagaatccatgaataacacacctaaattttactattgtttctagaatataatttcacaatagctgaatgggatatacttgtatgtaatgtgaagtgcaaactacccttggctcttgaaaaacatcctatttcttagtgcatgttggcagaaaacattaaaatttgtatggaatttttatataatagcctgtgactcacggtcctgtcaaatggctcagtcgtgaaagaaagtttaagtgaacagggaaaaatatttatctaaaataggatgtggtatggttcactgctgaattctattacataaaaacaggaagctaaaaccttttaaagcatctatatgtgttactcctcacttaatatgtggagtttttttatttgttaaaggacagaaaagtaaaagttgtttttataggagataatcaatctaggcatagtagccctttccatgcaggtaatagagatatcaccattgcatgttttcccttttaaatagactttagtttttcaaatacttttagatttacaccaagattgaatggaaactaaagagggctcccatataccatctaccccagtcaggcacaaccttcctgataatgaatatctaacacccaagtggtacctttgttacacttgatgaacccacagtggcacattgtaatcacccaaagtttacagtttacattacggtgcatacttggtgttgtacattttatggatttggataaattaataatgacctgtatccaccattttggtaccatacataataaattcactgtcctaaaaatcctctgtgtcctaaaaatcctctcttcctccctcctttctccactagttcctggcaatcactgacctttttactatttcctaggtttgccgtttccagaatgtcacttggtcgcaattttacattatgtagcctttgcaaattgatttctttcaattagcaatatgcattcaaggtttctacgtgtctttttataatttgatagctggtagcataaaatgtcttcagtcagatgcattatataataatagacgtttataaaccctacatgcttaaaatatgtagttttaataatgtagaattgatgtttttatataactctaagcagaaattgaaatatctaagatagaatgcagtgagtatctaaaactgaaaactttaaacatcttaataaattaccatagattccaagaaaaataataatacgtatcttctgtgtatttgctcacatttttcatttattctgttacatgtttagaaaacgcagaagttttataaatagttaggaattttatattggagaaaattaaacagtttggactttcgaaaacaaattataaaatatgaactgaagtataatcatatagagatatgtttcaattttgtaatatagtctaggaaaataattttgtttgtacaatgaaaatatatttttcattttctatatatggagcagcctttcaatgttgacagaaaaataaaattggtcaggtgggggcttaaacaaagaactaaaaataaaattattcagttcttttacactggctaatacatatttgggtcatattcatgcaaatctttgaagctgccttttctactaatcaatacaaacactagttgttttatagcaaacaaactgcatccatcaaagtcaaccagaaatataaccaaatttaaacagtatttggaaaagtttagagttagtaagataatagcaaacatcaaaagaagaggttcaactggatagttaaagaacacaaaagatattttatatgtgccaaaatgatctcagttccaacatacataataatgtgaaatgtcagtgtagataagataatagatattttgttgtgcaaagacttcagatattttatgatttttcatggtttacagttgtaccacatttattaaaaggatattttaaaatatttatttttaaaatttttagtactttgtgatatttatcacaaaagagctgttatgtatgaatttgtttttagccaattttttttcaaaataagcacagctcagtttctttctttttcttatgttaaaatcagttactttaaaggataacaagaatttgacaagttctcatcaacatttctatacaagcataataaacttctattttagtggttcactttttacacaagattgttctaaaaggatagctaaaactataagagggattgtgtagatattttaaaaagcagggcggccatggggggctacttaaaattccattccaaataaatatatagagaatagttatacataaatataaacgtatatattatacaatttcatagtattttatcttatttagtttctatttttaaaatataccaatagactttaattatgtaattttaattcaacaactaatcatatataaggggctgagtctatttaattcttcaccttttcaatccaaacattatccaaggagttctcattcttatatggtgtgtggaaatgggcatggaataggagagaaggagagagggaagactggacagacatttaatagccattaccatagcccaggccgcctctagctctttccaaaccattgtgacgattctgcttccctccaatgactccctaccatcttttggaaaatgatcacaatttctagtttgtttttggtgctgtttgtcaattttgatttggttgatctatttatttgttactgaattcacttgcaagctccatcctctttaacagcatccttcaccactaaaattccaatgcccaccaatcacctctaatatccatgtatgttttctaatgtcagaatcacacacagtttcatacatctttttttattcaagccatgttcagattaaaatggactccttacgtcaaatgggaacctgattcttattttcgaaaaccatctcaaacattattttctttattatgtttccttgaccattggtcactaatttatatgcttctccctcctatttgctaacctcacattattttttttgccaagaggtaaacaataaattacactgcatattaatttctaaatgatgtatcttactcttcccaatacattacccagtgtatgtgtgtgtgtatatatatatgaaatatatatataatatataaaatatatatatgaaaacatgccctttaacaaagtacagcacaatgatgaacatatgagtgcacgtgtcttttgggtggaatgatttatatctttcaggtagatacctggtaattggattactgggtcaaatggtagttctgttttaagttatttgggaaatctccagactgctttcctcagtggctggactaagttgcattcccatcaacaatgtataagcattttcttttctctacggcctcaccggcatctgttgttttttgactttttaaaatgattattctcattggtgcgagatactatctcattgtggttttgatttacatttttgatgattaatgatgctaagcattttttcatatgtttaatagccacttgtatatcttctttttgagaagcgtctgtccatgtcctttgcgtattctttaatgagattattcatttattgctggttgatttaagttccccatagattctggataatagacctttgtaggatgcgttgttcgtgaatattttcccccgttctgtagattttctctttgccctgttgatcatttattttgctatacagaagctctttagttgaattaggtcccacttgtctattttttgttttgttgctatttcatttggagatttagccaaaaatcccttgccaaggccaatgtcaagaagaatatttcttaggttgtcgtccaggatttttatagtctgaggccttatatttaagtttttaatccatcccgagttaagttttgtatatggtgaaaggtagggatccagataaaatcttctgcattgggctagccagttatcccagcatcatatactgaatagagagttatttcccccttaccttgttgtaggtgaggtggttgtaggtgtgtggcattactttgggttttctgttctgtctaagagcattcaagccaggtgcctatcagtggtagattgtataaagaaaatgtggcacatctgcaccatccaattctacacagccataaaaaaaatgacatcatgtcctttgcagcaacatagatagagcgggaggccatagtcctaagcaaattaactcagcaacagaaaacaaaatatcacatgttctcacttataactgggagctaagtattgagcacacatggacataaatatggggacaacagacactgtggactactagaggatggggtgtgggttaaaaaactaccaatcaatcaagctgtgtgctcgctatcagggtgatatgacttccaaacctcagcatcatgcatttccgcatgtaagaaatctgcacatataccccctacatcaaaaataaaagttgaaattctaaaaggtatacagttttacaattataaatgccattcctataatctacttgtttatagttcccccatttttaaccaaatattctcaattagctactttttcttgccctgaatcagatattaagaaaaagcaaataaaaggatatggttatcggtgctacctttttactgttccgaatccctgataagcttcctaggattttgaagtgatttgaaggaaaattttggattgccactgagtttatttacaaaacaattatttatacgtgtaacaacattttgacaaaacatttaaaatcattagagaatggagactcagtactgaagaataagtgttgggaaatacatacatctaccccctaaagaataagcattctgggaaaagaaattcggtagtaagtaataaaatgtctacatcaagactgttcagcaaagtacacataaaatggtacattaaaacgaccttattgaaagttaccaaaaatagcctgaggatgtaaaacatatataaataagcattagcctttttttatttatttaagtaatgttgaaaattgttgatgaattttactcagaatttttaaaacctaaagttttcaaattccccaaataatatgtggatgctgtaaatagtattgtaagggactaaaagagctggaaattatgtaaaatgattttacacaatctacatcagtgtattaatgtccagtataaacttttataatttatttatagatctaaaaagagttccaatgaactcattatatacgtatgtgaaaatagagcaaataacttgtgtgtgattctaaaaattaaaaatccctccaactggccacacacaatccataagctggtgtaatttcatcaaattaagtgctgtattcctgattataatttaattttgatttttaatgtttttaagcattattatttttaatattccaaaactcatttcatagaatttatctcttaaaaagacactctttgcagttttctcttcatagataacaatgcttttttcacagccatcacagacattactagcattacatactttttcttttcaaattattcattgaaaattacaggagattacatgttgtacccatacagctctcattcaattatttctgtaacacatgttgtacccatacagctctcattcaattatttctgtaagcagttttatatatgatgactgcgaacttgagtgaacttaaaaaagttgccaataagtgcattttgtcagggagctgaaagatgtaatgcctttttataatctcataaatactctgagctgtccagagggagccgagacataccagagtaaaagattagaacacaaaagaagtacagtatttattttggggaggtgattttgattcactttgtaacaatcttttaaaagttataattttatgttttattacaatgaagatgaattgatctaaaatattggacaaaataataatacaataaatatgttaatgatcacaaaaacgtaataatgtactagggggcaaaatgaattatagaagaagagaatgcctcccaaaatccagtatctccttatctcaaaactgagcaaaagccaaagtcatatatgagtgacagtaagagcattagtaaattatatggacttcctccatcttcacatgagttttaaaaagatgaagaaaaattttatagtgtcaattaggaatatagcaatgaccaaaaccaaaatttactagctaagaagtgaagaaataaaaaaggaataatattaaaatttttaaaaacttgttgattctggccacagtaaaatgcgtagctaaaagtagaagaatggaaatgatctgaagccttaagccttaatgaagataacatattaaacaaataacataatgttttgtttatttgtttgtttgagacagagtctcgctccaggctggagtgcagtggcgtgatctcggctcactgcaacctccagctcccaggttcaagcgattctcctgcctcagcctcccaagtagctgggactacaggcgcgtgccaccacgcccagttaattttttgtacttatagtagagacagggtttcactgtgttagccaggatggtctcgacctcctgacctcatgatctgccctcctcagcctcccaaagtgctgggattacaggtgtgagctactgtgcctggccaataacaataaattttaaaacaaaatgtttgtacttgctaaaatctaggaaggttttgtataaaagtggagaagttctagtttaaaaaaaaatactgctataagcaacaagtaacaagaagctactctaaactgaatgtttttaaaataataggtttaacaaatgaaataataacatatgtatataatgacttggaattcccaaagtactttcttgcttgagcctaaaagagcattttcattaagataactagatatgtatatcaccattttaccaacaatgaaactgggaatgaaacaacaatattatttagatatttccaattgtattatatggaccacaaaatgggtgaaaaatataattcactctgaagatataaaatgttagaatttccaagtgcatttatatcaactcatctttttatttttctgttttataatgtgcattacatatttcaatatatattataaaatactacctgtttataatttaaaataaaaacacccatcttggaagtggatactcagctcttctctagatatatacaggaaacaattttaaaagttttctagaaggaaggaagaatataaaattcaatcatggttgctgttgagtgtgctgtttatttttttaaattttgaatgaatgtcaaatgatatttttaatcatccttgctaatgaaatttgccatgatttttctcttttttctctaattgatacaattaaaggagtattgactaaacattggaaacctcaaaagttcaaacacttctttcaaataaggagttttaatgtgaattaaaattgaataaatctatccatttagggatgcactacaggtagcaaaaatgcaagaggccccacctggtgtgatgcagaagaaaaacctgttcagagaaatggaaatagtgttacattgtgctcggattgctagtatcagtggttccatataaaattcagtgaattttataacttgcgtaaatcaaaattttcattttccttttttctacctgtaattacaacacatgcaaatgcgatctgaaagtcatgttctttcaaatatataaagataaatattttggaataatttttttcttaccacccacaaatatataaagaaaacatttatacatatatttctaattatctatgtagtttaactgagagaagtctatcaaagtccaaacatgaatcttaactcatttaaactatttggtaagtaagtttgtgattaacatgtaaggtcttccctgtagaagataggaagttttgttaatataagacatctctcttcacaactccataatgttgaagagtactattttatttcgtgacaagtggcttctgttaagaaatgtaaaggatgctgtttggttttatactggaagaacattatgaatacagtttattctcaatatccccaccatttttaaagccgtgagcatttaattttaaaaaaattatttttgaacactattttgctcacctagtctagtatctgctttgattgattctttctacattctgctacacattgactctttgaactacattttactctttgtatattcaagggaattctatggaaaatgccacaaaacaaacatttaattcatcaatttaatataatatccaggtttataaggaataggtaatcttggtagactgcttgcctaacataacacaacaagaagcgttgtataaatctcagaaatgttaattggtttttaaagtagtgcaatgcatttttctttaaaactatgtattatctcagaatgtgtcttccataacgcaaaattttgccataatgttaactattaccagtatgcccttgttaatataaatatcatatccattagctcctttgtcgtgtcttttgtaattcaatggatgaaattatataagggaatttataatgctccctaagtaaatatggacttgaagtataatatttctaaagagttatgttaattttattaattctattttagtacattttaggcaacccttctggttctgcactattttattagacagtcaatcaatgtttgtgaagcatacatggattaatgttcctttttttttttttgctatgtagctgcagaagtctttagactatccagatgtttgacttcttaagtagctgtcaattctgacctagatggagccctgctgcagaaagatgcctactccacctttctccacaccagaaatgcaatcaaaacaagactaattgactgtgttcttgtaatttttgagaaattgccctttaagtttcagtataccaaattcaaatattaaaaattacaatcatagttttacttcagtaatttacaaagccattcaaatccaaatcagcaatattttaagaagtatccctgtgaagtccaacactgataatacatttcccagaaattggtaaataagagtaattagataccttccaaatttttaaaaagtctctatcccctggaggaaacatttctactgactaaagtattttgcgagaaaaattttgcctagttgttttgcttgactatattaagtaaatttaatgttttcaacattttgacactttatattaagtatttctcaaaccattttgaatagaagttagtgaaactttagactatactcatgcctctcaaagaagatacttttggggtatgttttacaatggataatttctaaaaatattttttgaaactctaaagaacagttattaattctctcaattttctatccatgtatcaaatttatttaattgtaggattaactctgcactatttaaatgattcaaatttgaggtaattttgaagagtatgttttaaaatattcttaacttaatttcacttcataagattccacaaaagtattgttgaattcatgtctattgaccttaatctacaaagcaaactaaaacatcccccatgattagatatcaccaggtagaatttcaagttgcaggggattttttaatcttctttagtttttcctcatatacatgtatgtatttgctatagacttaggccaaaattttccaaatatcatttgatgttagggagtatattgtactacgaaggacgaagtaagaacatataattaagagtcatgtagacttatcaccaatgtggaaagataccgtacgtagtaatatcatcaacaccaatcagagttatttaatgtcttctcttttcatatgcttaacctacttgcctgctgcatccaacaatatctcttatgaaaatagctaccagtattctggaaacagcaaccaatcaccatcttaggactctgacttttttctccatgtctttattgcagctttccacgtcctgaaattaattttcagtctacctggagaagatgatacatgcacatagaaaaaagttaaataaaacattgaactatataaggagtcaaaaagcatggctagttttatgaatctaatagtgcagtggtttttgaaaagctagtattatcaaatataatacatttcatggacaaatattttaatattgcagttgggatttaatttatacaacagaaacatgaaaagacgcatacaatagtccctgctttagccagagatacattccaaaactctcagtggatgcctgaaacctttgatcgtacttaaccctacatatacagattttcctctacgtacatacctatgataaactttaatttacaagttaggcacagtaagttaacaataatatctgttattaaaatagaacaattacaacaatttgccagcatcgctaatcttgtgtataagggccattattaagtaaaataagggttattgaacatgaacgctttgagactgacaatagagggctgaaacagctcctaagtaactaagaggtgggtagtgtagataacatagacatgctggataaagggatgatttgtgtccctgtcacaacagagaggaatagcaagatatttcatcgcactactcagaatggcctcaaattcaaaatttatgaattgtatacttaaattttccatttgatatttttggaccacagttgactatagataaccgaaactgcagaatgcaaaactggatgaggagggactactgtatataagacatttgaatgaagcttggattctcatactttaatactttgattttatgtttggctgaaaatttgaatgcaattacaagaagatatggggaaacagatttagaaagtcaatttccaaatttcatggggttagagaaaatgcagctcagagggaaactgattctcacagttgcttttaatagtaaaatataaaccaaatatatttttaactttttatattctaaattatttattcttattcaattatgaagcccatttttcataacagcaatacaaaatgatcattaaagaggaagcttaaagcagaaatataagttagataaataatttacattgatgtttttcatttaaatagttgttaaatagttgtacctccaaataatattaaaggtatatggatattgacatttttctataagaataatacatattttaatgtatttgctgtattgctgtactgtattttatccatatcttttcattactcgttggtgaatatccaagataaaatgttgactctaacacaagtataaaaagtatacaacctggagttaattagtgattcacgtgtacagttctcattttaggggttagtatgtgacttaggccaatgacctctctggatctcagttttcttttatgtaaattagaactgataatattgttttcctaccttataaagttaccataaaatttacaccataagtcgtaagtgtaagtattctgatgatcttaaaaaataaaaaatggatttacaattatttaaattattacttatgctcaggtttgatttcctaagtaataaaaccatgattaactaataaaaatgaatgttctggatgttattgtgaaaatacatcattagtagtgcccgaatcttaatgatgtcatttcatatgtgcttatggttttatttgtgaaacgtccagagtacaaatagtggactttttatgccagagtaaattggtgagagaaaataattaaaatacttaacttttatagttgtaacagcctaacctcatgagatatgagaaagtataagcatttaaatacatcctcaaggtgacatttaatatatatataatatgtatatacatacatataacataactttcaaaagacaaaacttataaacttattatttttcaattttaattttttttcagagaatagtacatttgtatatttgtggggtacatgacaacttttgatacaggcatacaatgtgtaataatcacatcagggaaaatggtgtatccatcacctcaagcatttatctttcgtgttacaaataatccaattatacttttagttatttttaaatgtataattattattgactatagtcatcctgttgtgctattaaatacctgatcttattctatttttaacacaaacctatttgaagttcacttctatcctctgcaatgacaaaaagatacttattttttcataaaaataacttcaagcaacctacgattgtaataagtttataaagttaattttctatatatagaaaaaagtactagctattagtattttagcaattcttcaccataataaaatagggctcctatatggttaaaaaagagtaggatcttaatctgatgggatcaatggccttaaaagaaaaggaaaagagagttctctctgagtctctatcccacaagtgatcacacagtgagaaggaagctgtctgcaaagccaggaaaagagccctcaccagaatccaatcatgctggtaccttgacctcaaactctaaaccaccataactgttaagaaataaatttcttttgtttaagccaaaaaatgaagatgttttacatatataatttttctgaaagcttttctaaagataaaaatgaagcatataattatactagtttaatgctaaaaaggtcacaggatgaaatacttgtcatttaaaagctaactagccaaacctgaattattaaaaaaaaacttactttagcctcaagagaataatcattacttaataagagatagtcttccactttagattactgctgaaaagatgtgcttacagaatagtttaatgtttaacattagataatttttagttgaaatatcatttttataatactaaatatcaattttataatattaaaataattataagcagtacttgctagatttttactttgtactgggcaataagtgctggaggttaagtacattaccacattcacacaatcttctcaacaaacttgtgacctatttttggttgttatttttattataactgtctccattttaataaagaggcacttcagtctgagagatactagatggcttaccccaaaagctaatgatggtaagtgatgaaaccaggcgtttcttactcctgatgcagtgtttttaagaacaaagcaagaatcttcatacttaggaaaggtaaatgggaatgtgtataataaatcagatatattgtcattgatctataggatttattgcctagaactatctgcatgtgagaagaccctaaacgaagtagcagaagagtgatccattcaaaccaataggatcatcatgtgaatgtatacaccagggctaaaccacaattgtatatttttttccaattttttttcctgagctttagttgttgagtaatgtgcaacatatctaaaatgaatacatttgaaattgaagaaaatattgtattttcatataatcaaacatgtttcataggtaagttgatttcactgtattgtaatgatagattcagaagtgagtcatttatatttggaaatggataatggaagaaaatatataccatgattttttttaactgcaaacagaaatcctagcttgcttgatatattatttttgtagcatgaggcaatagttcttttttaattcatgcatagagatatacctttgaaaaactgataactaatctttggaatctcattctacacttgtttattgagattttgcaaactaaaaaaaaatattaaatccccatggctgagaaaatactattctttctctagttattcctcaagtggtttcatgtgcaaagataatagttctgtcgaaaccagaaaattcccggatactagctaagcaattttactaaactatcaccatctaagtagcatgttaaaatttggtataggaaggtattgaaattgacattaatacattattttttttcactaccttgtgtttatcactagtttttcttcatgaaaaacaaaataatttcaataaaaattatacttgcttggacatgagcattctaaatttgttaattcagtgactaagtaattctcatttgccgtatcatgatgacattgtagaagtatatttgcaagtgtgaaccacaaagttgctgggatgaagtgccaggcaaaatcacaaattgaatgattttttttttcaaaactgagctgtttgcttttagaattataagaaataaaaataacttaaacctattttttgaaaaaaaaaataaaataatgtagacatgacactcagtcatcctacagaactagtattcagacaagtctgacatactcaaagtcgacctgctagtgcttgcttttgtatgttagcagttgttctgattcctttggatcactatttcctttggatcactatttcttcaagtcattattaaaatattaaacctaagtttaaaaatatcacataggaaaactttttatacatatataaaacaaatacaggttttatatacatattttttcaggagtggttttctcacagttcaaatttacatctatacccgtatctgtcacttgtgtttcacatcagttacatatttgaacatgcagttattatgctgagtaataaatgcattttgtcattaaaaagactaaactgggctaggcacggtggctcatgcctgtaatcccagcactttgggaggccaaggcgggcggatcacgaggtcaggagatcgagaccatcctggctaacacggtgaaaccccgtttctactaaaaacacaaaaaaattacccaggtgcagtggcgcctgtagtctcagctactcgggaggctgaggcatgagaattgcttgaacccgggaggtggaggttacagtgagccgagatcgccccactgcactccagcctggtgacagagcaagactccatctcaaaaaaaaaaaaaaaaaaagactaaactgttatgcaagctaattcttaacatgtgttaagaatcattttgaatgcctatcaaattatatttcttccttattcttctagataatacattatcaccagtttatttcttttcattgttattattttctgatccatattgttatagctgcggagtctaccctcagattctactacaaacacgtaacacgtgattcatcttcattactacttgctccacttgccatttcaattttatcaatcagaatacttcatcttcttcctattcacctctttcatggttactttctttatgtcttttgggatttcctgcaaccatatgccaaagaaaagtggcttccaccttctcctaccttctcatggtagaaactaacaaaaggtcataaataccatagctataaaatgttgcctttaatctaatatatttgttaaaatattaactggagaaatacaggtgatccatttcttgccaaatgatgattcctaaaatattcataaaaaggtatatttaaatacattctctgttaaaataacgcgctcagaaccatccattttcaagtttaagttttaaaactaacataatctcatatagaagatttatttaacacttttcacagaagttttgattataattttcttttaacattatgatctattaatgggtgtcattttctgataaagtacatttagggatatgataatattcattatcttccccacagggattcaagaggtatatttaaaagaagaggtacttagacactttttctttgttaataaaaaaaaaagaagtttgaaaaagatagtcacataattaacaaatcaattgcttaaaatattgtttgaaaccagggaataggcgtcaacaatcatgaaattgaattctgccggttactatgactttattctgtctcttaaattgaattattggaaaagatttatttttaaaataatcatctaatattttctaatttagaggtttaatactttttttccttttttttttttttttttttttttttttttttactttttaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgtgagtatcaggcatctacatcatgtcatattaaacaagcgccacagtcaagctcgagtgctttacctgagggcgttgtagggtaaaggagtagggtaaagagtttgattatgcaacattggacactgcactgcctgctctctgaccttgaaactatgtatccttatatataacctagaacaaagtgactttgacaacagtttattcaaaattaaacctcacaatgggatcttcactgaaaagaatcactaccatgatttatagatgataaacatatagatggatggatagttgtgcaaatgtattccattttgatttattccaccggttttgtttatattaaataaaagaaaggcttcaacaataatctgagctaaaaactcagttgaactgagttaaaaacaacaaaattgtggcaacttctacaaacgtaaggcatgattacaacaggcttcatgattttttgtatagaaaatatgatatgtgctataaaatacaatattacagattctgaatatactattctaaaatttgatcaaaagttgattacttgttagaatttggagctctctgtgtagttctatttagttaagcagatataattttcaagaaagtatgtagatcgattttttagaaaattattttgtcctgtaaaagggaaattacaatgttttaatatttccattttgttttattgtgtttgtctttacatagatatagatctaatttcaaaagtagaatatgatcaatgcaaaaaattcagcaagcacaggaaatcatacacaaacatatgcacacacgtttgtgtgttatgtgtgggtttgtatacatatacatgtgtgcattaaacacagcaatcaaaaaataaacagtcttaagagttcaggacattccctttattatttttaaccttaagtcctttctactgcatactttttctgacacatacaaaagtgttgaaagactttaaagcaaacaactagttgggttccacaattaacattttgtgctattttgtcatatgtttattcatacgttaatcccttatattttcttgaatttcaaaaaatcatcacacaacccctacataattcaacttgcatatcattacatacagtctaaaaggtgtttacatttatgtaagtaaagccacagaataaaatgcaccaaatgtttcagttgaagagttttgacaaatgtttttatatgtgtaacacaaagccatatcacaattcagaaccttaccaccacattctggaagttctctcatttccttatccagtccacccacattaacctccctcacccaggccattgctattcctgatttttcaccacagatagtttttgcttattttggaacttcacataaatggattcctgcagtgtctacccttctgtatctgacatcttcaaaaatgttgtattaggaccattcatgttttgtatttcaaggactgatgcttttttattgttgaatcatttatattctttttctatgcatctgttgaagcgtggaaggtctcatactgttttatagacacatttgtcttggctttatcatataattttgttccattgtatcatttacaccttaaattttaaggataattcttttatttgaaaagtttttactttaaagttttggcttttaaaatatatgccaaaatatatatcattttttacatatttctgcgtttttgctaattgttttaacatttttactctcatggaagtataatattctaaaaggcttagctattatcagtgtacagtttaataaatattcacaagctgagcatgcccatttttaacgctcaaatcaagaaaaagaactttattatctacgtctcctttcctgtccctattcaatctcgtgctaagcaatatcctgacttcatagcaccatagattactttttcctgttttgtactttacataaatgagtttatacttgttgcatatggggtattttgatacaggcatacaatatgtaataatcaaatcagaataattgtggtatctgtcacttcaaacctttatcaattctttgtgctaggaacacattccaattctcctcctttagttatttgtaaatatctgatacattatttttggctgttgtcaatctattgtgacaccaaatactgaatcctattcattctgtctaactgtattttcatacccattaactgttcctacttaatcccccattcccccttccttgttacctttgctagcctctgctaacaattattcttttctctttctccatgagtttaagttgttgttgttgcagctcccacatatgaatgaaaacacacaatatttttctttctgcactgacttatttcacttaacataattttctccagttccaccaatatttccacaaatgattttccattgtgtatttagcaaattttcatccattcatccatggatggacacttaggtcaattccagatcttagctattctgaatattgctgcaataaacatgggagtacaaatatctcttgattttttttaaaatttttgatatataccaagcagaggaatcactggatcacatggtagtttctatttttagttttttgaggaagcttcatgctgtcttccatagtgacagtattaagttacattcccactaatccacaagtgtataatggttttcatttcttcacatcatcatctggattcatctttgcctgtcttttggatacaagccattttaactgggatgagatgatatcttattatggttttgatttgcatttctctgatgatgatgctgagcattttttgtatacttgctgtctacttgtatgttgtcttttgagagaaatgtctatccagatcacttgctcatttttaattggattatttgttttgtttttttcctgttttgttttagatgctcgtatatactggttattaactccttgtcagatgggtactttataaacatgtcctcctattctgtgggttgtcacttcactttgttaattgtttcctttagtgttcagaagtttttcagcttggtgtgatcccatttgtccatgtttgctttgtttatgcttgagaggtattactcaaagaaatttatgcccagatcaatgatctgaggtgtttcccccatgtttactctagtactttcatagatttggtcttcgatttaagtcattattctgttttgatttgttctttgtatatggcaagagataggggtctacattcatcatctatatatggatgtccagatttcccagtaccatttattgatgagacttccctatctccaatgtcttggcagctatgttaaaaataactctactgtaaatgcatgggtttatgtctgggttctctacgccatttcacttggtctgtgtgtctgtttttatgccagtagcatgcttttttgtttattatacctttgtagtataatttgaagttaggtaatgtcattccttcacttttgttcttttgagtcaggatggttttggctcttgtgggtcttttgtgtttccatatacattttacgatctttttttctatttctgtgaagaatgtcattggcattttgataagaattgcattgaatctgtagatttctttgagtagtatggacattttgacaacatttattgttttaatccaccaacataaaatgccttttaatttttgtgtcatcttgaagttttcatcaatgttttatcattttcattgtagagatgttttacttattcacttaagttaattcctaggtatttcaatttatttgagcttttataaatgggattactttattggtttctttttcaaattgtttcctgttgacatgtggaaatgttactgattattgtacgttgattttttatcctgaaacattactgaatatatttgttagttctaatagtttttttggtggagtttttagcattttctaaatataagatctgtcatcataagaaggattatttgactccttcctttccactttggatacattttatttctttatctttcttaattgccctggctaggacatccagtactacgttaataccagtggtgaaagtagacatccttgtcttgttccagatcttagaggaaaggctgtccatttttcctggttcagtatgatactagctttattatttattttcttctactaattttgggttgggttagctttggctcttccagttctttaagatgcattgtaaggttatttagttaaagtttttctgctattttggtgtaggtgtttattgctgtaatatgccactcagtactacttttgcagtatccaataggttttggtatgttgtgtttccattatcatttgtttcaataaatttttaattttcctttttaatttcattgacttaatggtcattcaggagcatattttttttaatttccatgtgtttctattgtttccaaagttcctctttttattgacttttagtttattgttttccgttgtcagaaaatatgcttgatatgatttcaattttttggaatttttcaagaattgttttgtggcctaacatacgatctattcttcagaatgtttcatgtgctgaggagaagaaagtgtattcttaaaaacgtggatgaaatgttctttaaatgtttattaggtccatttggtctatagcatattttaggacttatgtttctctgttgattttctgcctggatgtcttgtccaatgctgaaagatgggttttgaggttcacagctacgattttattaggatctttctctctaggtcaaatactatttgcattatatatcaaggttttccaatgttgggtgcatacatatttataattgttatattcccttgattaaccaacccctttatcattttataatgaccttattcatctatttttacagtccttattcaagcattttagtcattttctattaggttgcctttcttttccttactgttatgcaggtgtgttcttttatacaacatgctctacatatataacctgggctatacatataaattatgtatatacaatttattataagtatacataaacctatatatggtataattaaatttatatttataataaaatatttacatatgaaatataattttacatataacctcttttcttatttttttaactggcaaaatgttgtctctggggaggctgaggcgggtggatcacctgaggtcaggagttcgaaaccagcctggacaacatggcgaaaccccatctttactaaaaatacaaacattagctaggcatggtggtgggtgcctgtaatcccagctactcgggaggctgaggcaggagaatcacttgaacctcggaagtggaagttgcagtgagccattgtactcctggctgggcaacaagagcaaaactttgtctcaaaaaacaaaaaaaaaaaaaaaaaaaaaaaaatgttttctctggtgaacagaagtgcctgatcttcatgtagtttaatattttaatttgtctcttgtcttattttttaaatatttgcctatcctgaggtcagtaaggccctctatattttccactaaatctttatcatttcgcattttacctttagacatacaatatacctgagttaggactccacacacttttcagttagtattttttaaattatgtttagaaaatagcactagtaattttagtaattgaaaatgtcattcttttctcatgaatagcagtgccatggttgtgacatctcagatgacagaattcaaataggcctgtttctgttcttcttattctattccacttttcactttctctatcctttcaccaatgccagactttattaaccactaaatctttgccatggttgttttctaactgatagaataagttctccaagtttgttgttcttcaagatcgttttgctagtcttgactcacatatccatttaaaaaatttaaattatttatccataaaaaaatttgcaattacaaattttaaaaatgttacaatttgtattgggagtgcattaattttgcagattcattgaaagacaatcaatatctttgcaagataaactattttaagcaacaagccaataataacttgtgtgagctttgtaaataatctagatttacttatgaagtgaaatttttaaagtaccttattctttcacatgcagtccttttgggttgctgaatatgtttaagcagatgttgttctgcacgagtccaaagagggctattcatgagggtcatgacaccacttgacttgtgagaaaatgagtgcagtaaccttaggaccaattcccttacttcagtaaagagttattcattagaatgcattataactaaacaataaattttttaaaaaatgtttctacctataaccacttgtcttaaaatatatgtactcatgaaacatagtgaaatcatcaagatagtctctaaattttaaacataattatttttattttttgttagaaccaaagcaaattgctttcctaacaagatattatctctaatgtactttttaagtttgaaaaaatgctgacttttcccaattctcatttcattgaataaagtaatttcgatagaattaattcagtggaaaatttaatttactacctgtaataccataattaaaatccaatatattatggacattcaccctgggtatgaccatgaactaatactgataagacactataaacaatgacagcttaaacccgtgtaaagtactgtataatgaccacacttagctagaattaactgttgggtttaggtgtttgaaatcttcttattaaattttatcatttataactgaagaagacgtcaattttagagtttttgtattccttgcctataaaaatagaccatgggccatgtaattttaaactttctttacaaatctaaaattatgtcactccaattatgaattgttcagtaaataactctacagttgttaagatctcaggattttgagggagccacacagaagcataccgtatgtccatgtatcgaatggaagtagaaatgacaaaaacacaagttttagaaaacaaaaggaacaaaaggcatcctacccttgcaattactccccaaagaaccacatctacagtttgtactctttcgtgtctggcttcttacagaaaagcttgtattactcacaaaaggagagtaaggtctacagtctctgagaaataagaataaaaatccttgcacaggcatttcataacatcagtgctaacaaatggagagaccattgagataaaaattagtttggcaaataattattagtttgggaaataatatattttaataatctaattataaaagtttttttttcaattctaaggcagaagtaatcattacttttcttaaaatgaaacgccatatgccaactgagatttatttttcaaaattgaaaaacaaaggcttttaatccactttttaaatattgaaattcttctgaatttctatgtgcctaaaattcaagaaacttaactgttaaatgttcctgtaatatcacattttattttgtataccagtgtttttttctcttctcttttttcgaatctggctctttctattgagaaaatctagaagtcaaccatctgtattttttttccactttcaacttcctccctcactgcttaatctcttctatttttggcttatgcttcactaaagctgctcttttcagtcgagagattttatgttgatcaaatctcatgtcttactttggttttcaaattctcaaaccatcttggagaatgtgatattgtttacatgttccctcaccgacattctaccatccccttccaagactctgtatcatcttttttctctgtgtttcctcctcagttctctttctttatgtataatttatcccataactccaaatatcacctctacatgtgtgaataccaaataaatgtctgcgtctggtccttatcattctcttgggcatcaggatgcctgtgtgtgtctatttctaaacaaaatggcagtaattgagaatgtctgaaatctaacttagagtgattactcccaaattattttctgtttctgtggtcctcatctctgtcaatggaataagtatatttccagttccacttcaattccacttcaaatgcttctagctcaataaagattttctatttcatcaacttggctaaaatcctgttttatctgtgtactcctgtttcattccatttgtcatattcttatatcctttattacatatttttatattcatttcttagcattgttttaaataagccattctgaataaattacaagctcattgattattggcattggctcatattaacattaacattctaccaaatggtctttttctgtcacatataagaagacactagtttcttccttctattctgtagatagtatgcaaggaactagagggatagaaagctatgtgttcttcttgtgatatattgttttcaaaacctaactcaaaagtctcatcagttttccctcagtaagtactgacttaaaactttaacacagccaggggcggtggctcacccccgtaatcccagcactttgggaggccgaggtgagtggatcacctgaggtcaagagttcaagaccagcctggccaacatagctaaaccctgtctttactaaaaatacaaaaattagcttggcgtggtggtgcatgcctgtaatcccagctactcgggaggctgagacaggagaatcgcttgaacctggggaacgaagatggcaccaatagactccagcctgggctacagagcaaggctccatctcaagaaaaataaaaataaagtaaaataaaactttatcaccttgtaagagagtaccattttcagcctatttttaagtagctgtgaaaagattccaagaaccagtggaaaaataaatgagcttgaatcccagtacacttggagaagtcattctgacttctgtgaacatttgtttctttcttcataaaatgagaatttacagttctgctccacatgttgtgtgacataagtaaagaaatgcatgcaatatatgtaaaattacccttataatgcctggcatttaataataatttatgcatcagggttagaaatacaggagaatcgattcttcctagctacattttttttacatcaccaagcctttttcaactttactagattgtttgtctatgaccatttgttatgtatgttctgtaagggatatttttacttcatgagatgataattagataacatatttcagttcaaaaattagattcaactgttctcaaacaaaatgcaaactgcatatttattggacatggaataaactaaagaacaaacataaattagcctctactgcacactaaatgagatacaaataagagacatggtaaatacagtggaatcaattcatttccaatattttttgctttcttcgtcattgccttttatgcctcctaataattttctgtacttttacattgtcttcctaactaaacaaacagatcacaaagcttagttttagttgttttatttaaatagaggcacaagataaaaacacatagaataaatattatatataataacatcattacatatactatatattatgctattatatataaaggtatagatagagatatatattaaattttataagtcttctcttttgcccatccactgagcaaatatttatggaataaatgccaggttataagcacttttatagaacttaggaacaaattagtaagcaaagcaaacaataattttgttcacatggagttcaagttattgtggaagatggcagttaataaacgttaactaaaaatgaaatgtccagtagtgataagcactaaatgaatgaaaggcaggatgttaagttgttatttgatactgtgtcataaatacctctcagggaggtgacattaagcttaagggtgggtaataaggagctggtaatacaacaatcaagggacagaacattctaggcaggtgtaaattaatgtaaagattctaacatggggatgagcttgctatgttcaaaggcaaatgacgcttattggtgagagtcagagaaagagaaactggtataaatatcagattgggaaattatctaggggccaaagtattattccatcttcttgggtcaatgaaaagggtctgaattttgtttgaaatagaagactactagaagagttttaagaagatgacttttgctattgtgtgaagaatgggttattggacataataggtttaggggaatgatttaaaatcagggagcccagttaagaggagcttgaagtaatccagatgaaaaaagttggggttttttggcccaaggcagtggtattacacttatataagagtgagtatatttcagatatagttggggtagtgtcaatcacctgattgattttatatttggattagggaaagagagaaatcaaaatgtaccttcatgatgttgtttggttgtgcagacaaccaggtgtatgcagttgtgctgtttatttttatataaccctgttatttgttaatttgtccaccaacacctctgtttttaaaacctgctgagtttaattaaccttaaggaattgggaaaatgaaaatatgtggttaattccatgcttattattgatcacacaatttttatataaatttcttctgctttggaaaaacagatttcagctcttttcaaaaatgtagtgttcaagtttgaaaaagatataaaatcttaatgaggaatagggttaactgatttgactgttcggatttatactatcttttacacatgatcccaagcattctgagactagctctttcatgttttcaaaacttatgactatgatgatttattaaaactgcattaattacacctaaagcatttttgttttaagagcatctcaaggcagagaaaaaaaaattaagatcagtgtcatagaggatagtattagtgtaaagttctattttaatttggttcttatcaatttaaattactatatatcttacattctcaagggtttttcttatcaaaatgactaataatactttttaatcaaattatctttttactgttatttactcaagcataatttactaagcattaatattaaaaatatttattaaacatctatacaacaagagacaactctaacttctgtgaatacaacttgtgaaaaagcagactcattcctttctatcaggaaacttttattctggcaggaaccacattttaatttaaaaaaatcaaatgataaataatttttataaatgttatgtaaaataaataatttacctactcatatttatgtaagcaagttgtgaagaactaaagcataaggaagagtaggaattaactagctcgtgtgtgtctggtggggtgtgtggaagatggttcttcaggcagagggaatggactgtgtaaaaggctttgttataagagaaagtaagatttgatacaaaaactgaagaaatatgtatgaaatatcaattgtattttctgaataacagtgacaaaacaaaccaaaacaatactcccggttttcagcccagcatgcaaagagattaaaagttgccactctctcctaacaaaccaaaagctaaacaaactgaaatcaacaattcttagattcataagaaaaatgtggtgttagtgcaaactaccgtcctgaaaattgaagaggcagagaggcagatgcagaaaatcacaacttatcagagcagaaacctgtaagcagaaacgtctgtgagaaccagttcaggaataggaaaaaaatgtaaaatgttattgatgaattggtagaggctcgatgtggacaaatctgtgagttgaaaactccaggatgacttagtcataggaggtcctatacttctgagaattttaccttcaggagcttaacctagttgttacaatgattattggagaagtatctccttatgtttctggaaatagaagggggaagtaactacattaaaatatatcagaccattctgttcttaacaaagtctactctcagaagaaactgtttaaccagagcctaacatggggtttttaacagagcctaactgacccggagaatggaaatagccaacaccacccggctctatgtttccccctggaaatccccaactccagtccactctattcattctgtcccaccaaggctgtgggaggatctgagaaatgcttgtgaagtttacagccagaatcacggactcactaaaggactgagacctaatcatgggatgatagtctcttcttctgccccacacattacctccaaattactaaaggcctattgattatatttacccctactcagtatgttatgtccagctgtcaggaaaaaaattacaaggagtactgaacagcaaaaaacacagtttgaagagagaggcagcattagaaccagatttagatatgatggcgatgttggaattatcagactaggaatttaaaatatcgatgagtaacatgctaagaactctaacaggtaaggtagacaataagcaataacagatgtgcaatgtatgcaagcacagagatgaagattctagaaaagaggaatgtctttgataggcttattagaatagaaacagctgaagaaagaatctctgagcttgaaggtatctcagcagaaactgccaaaatggaaaggcaaagaggaaataagaaaaaaaaagactcaaacaaacaaataaactaacaaaagaaacagaacataatatccaagaaccatggagtaaatacagttataatatgtgcatattggtcatattaaaaaacaaagacagggagaaataaacagaagaaatatttgaagcaataatgacagaatttcaccaaattaatgtcaggcaccataccatagatccagaaaattcaaatgtgtaaattcaaacatgtaaaaagaaaatgcccacatatatacatcatattcaaactgcagaaaattaatgtgtatatatcaatatataaatatagatataaatatattattcatattcatatatatgaatgaatagtatatatattttatatatgaatccatatacatgaataagaatatatatgaatactatatttatatataaatatgaatatatatgaatgaatactatatatatgaatatgaatatatatgaatgaatgctatatatatgaatatgattatatatgaatgactattatatttatgaagatgaatatatatgaatactatatttatatataaatatgattatatatgaatgaatgatatatttatacatatatattccttatctatatagaatactgaaaggagcaagagagccagaggtaaaaacgcccttactgatggaggaaaaataagttttacatctgatttttctgcagaagccataaaacaagaagagagtgaagtatttttagtgttgagagagaaaaccccgctagtatagaattctgtctctgtgaaatgtgaaattatccttcacatgtgcagcagaaagaatatcctttctcagacaaacaaaaatagagggtattttttgccaatagatctgacttgcaagaaatgcttgaacaagttctttttttctttttctttttctttttttttttttttttttgagacagagttttactctgttgcccggtctggagtgcagtggtgtgatctcggcccactttgacctttcccttctgagattcaagcaattctcctgcctcagactcctgaataactgggattacaggcgtgtgccaccacgcctggctaatttttgtatttttagtagaggcggggtttcgccatgctggccaggcgtgtctgaaactcctgacctccaaccacctcggcctcccaaagtgctgggatttcaggcgtgagccactgtgcctggccctgaacaagttcttcagagcagaaaaatgctttaaactagaaactcaggtctccaaatcatttgatcatttttaaattggacttgtttatgttttgttgttgttatttgttgttgtttgttgttttgctattgaattgagttccttaatatatcctggttattaattccttgttaattgaatagtttgcaaatattttttcctattctgcaagttgtctcttcactttactgatggtttcccttgctgttcagatccttttaagcttgatgcgatcccatctgtccattttttgttttggttgcctgtgctcttgaggtcttactcaagaaatctttgcccagaccaatgtcctgaagaatttccccaactttttcttctagtagtttcacgggttcagatcttagacttaagtctctaatcaattttgatttgatttttgtgtatggtgagagataggggtctggttttatgcttctgcatatggatatctatctagtttgcccagcatggtttattgaagaggctgtcctttccctaatatatgtttaaagaaaggaaatgcatcagagaaagactaagtgaaggtaaattaaaaacttttacttttcttattcttattcataagattattgaaaataatggaaacaatgtattgtattatattatgtgtatatactacgtataagataaatgaatggtaacaatgatataagggatgaaagacttagaaataacttatcataaagaactcttgctacccattaagaagtacagtgttatttgaaaattgacttcattcagttcattgtaaatgtatattgaaaattcttgaacaacaaataaacaagttaaagaaagataactgatatactaaggaaagaaaattaaatcatataaaatgctcaattgaaatagccaaagacagaaaaatagtgaaagacaaaaactgaaataaagaataagggcaacaaataaaatagttacaaatatagtatatattaatctattgtatcagtaattacctgaaaattataattatctaaatagctcaattgaaaggtagagactgtcagagtaaataaaaaaaaacgagacccaaccagatattgtccacacacacacacacacacacaataagaataatgacacgtgaattaaagataaatagatagaaaaagacatactatgctaacatgaatcaaatgaaagcaggaatggaaatattgatgccagatgcagtcaacttcagagcaaggaaagttatcaggtttctaaacgggtattacctattatcaggtttctaaacgggtattacctaatcataatggggtcatttctcaaggaaaatatagtgatctttaacatgtatatgtttaacaacaaagcataaaaatatgtgaggcaaaaattaatacaacttaatgagaaatacaggtgtccacctttatagctggagactttaacgctgccctataaggaactcattcagcaagcagaaaaaaaaaaaaaaatggaatacatgaacccaggaggcagaggttgctgtgagctgagatcgggcaattgcactccagcctatacaacaagagcgaaactctgtaacaaaaaaaaagggggtgtggggggagaatacaaagataaaaagaaaaaaagtaagaaaaaatgggaaaatttgggaaaaaagagaaaaaaataaaatcagtaaggacgttgcttaaccaatcaagttcaatcaactatatatgtcatctgtagacgaattaatccaataacagcagaatgcatacacttctcaagcttgcctagaataggcaccaagatagatcacaccctaggtcatatgacacactttaaaacattttataaataggaatcatactatgtctgctctcataccacaatggaattatactacaaataaataaaagaaagctagaaaatactccaaatgcttgaagattaaacaatgtacatttaagtaacacataggtccaagaaaaaatctcaaaagaaatttttaaatattttaaactaaatgaaaatgaaaacacaacaaatcaaaatttgggggatgaagtgaaaccaatgtttagagggaaatttccttgaatacatatattagaatataagaaagatttaaagtgaattatctagacctctacctcaggaaactgagaaaagaagagcagattaagttcaaagtaagcagaagaaaacaaataataaacattgtagaagaagtaaatgcatttcaaaacaaaatcaatagagaaaattaaaactgaaagctggttcttttaaaagattaacgaaattgctaagtctatacctaagctaactcagaaaaataaaagaagacagagatagagaaagaaaatacacaagaatatcagaaataaagaaggaataactactatagacagcattgtcattcaaaggataataaagtaataccatgagcacctttatgccaataatttgataaccaaagtgaaatagagaaattcctcaaaaggcgcaatcagctaaatgtcacaaaggaagaagcaatctgaacagacctttatatccatcaaacaaattgaattaataatttatagtctccccagacagaaagcaccaagcccagacaagttcactggtgaattctaccaaacatttaaacattaaattatatcaattatctacatgttatttcaaaagatagaaatagagagaatactttctcattctatgaagccagcattactgaaatgccaaaaccagacaaagatatgacaagaaaaccacaggccaatatctttctaaacatagatgcaaacaccatttacaaaatattagcaagtcaaatccaacaatttataaataaactatatatcacacccaagtgggatttatcccaggtatgcaagtctggttcaacgttaaaaaatcaatgtaaatccaacacttcaagataataaagaaaaataatcataaaatcatattaatatatacataaattatttcacaaaatttgatacccattcataataaaagctttcaataacaatgaggggtggaccttccttaacttaataaaggatatctaaaaaactacaacttacatcattttttacatcttagtgagtaactagaagctgtccccactatatcctctctcactaattcttttcaacagtgtactggaagaactagcgaaagccattaagacaaagaaaggaaataaaaggcatattgattgggaaggaagaaataaaactctctttgtttgcagatgacatgatagtctatgaaaaaagtctgaaaaaacacctgggtatagtcaatgattatagcaaggttgcaggataaaagattaatatgcaaaaatcaattaatatgcaaaaatcaaaagtataccagcaataaacaagtgaaatttgaagttgaaacaaaattattattttaattagcaccccgcaaaattaaatactcagccgtatagctaataaaatatgtacaagatctatatgaagaaaactatgtaacttatgatagaaaataaaagaagaatgaaataaatggagagttatttcatgttcatggatagaaagactcaatatggacaagacatcagctcttcccaacttgatctgtagagtcagtgtaatcccaacaaaatcacaagtcattatatgaatattgacaaattgattctaaagtttattacatagagaggcaaaaagacccacaataaccaaagtaatattgaaagtgtaaatgtgtaggattgacactatccaacttcaatacttactataagctacgataaacaagactttgtgatattggccaaagagtaaacaaataaattaatggaacccaataaaaacctcagaaatagacctacataaatatactcaagtaaactgacatgtcacacatagttaaggcagtactatggtaaaaagatgttattttcaacaaatggtactggaacaactgtaatccataagaaaaaatatatctagccacagacattatgcacttcataaaaattaactcaaaatgtaatattgacctaaatataaatcaaaaaattataaaactactagaataaaacatggcagataatctagatgaccttggttttggtagtgaatttttggattcaacaccaaaagcacaatccatgaaagaaagattttttttttttttttgagatggagtctcgctctgttgcccaggctagagtgcagtggcctgatctcagctcactgcaacctccacctcccaggttcaagtgattctcctgcctcaacttcctgagtagctgggattacaggcgcgtgccatcacgcctggctaattttttgtatttttagtagagatgaggtttcaccatgttagccaggatggtctcgaactcctgacctcatgataagctggactagtataaaattaaaaatttatgctctgcaaaagacattgttaagtgaatgaaaagacgaatcacggaatgggaggaaatatttgcaaaacacataactgacaaaggactattatatgatgtatacaaataattcttaaactctatataataaaaagaagagcccaattagaaagtgggccaaaatacttaatacatacctaattaaagaacatatacaaatagtaaataagcttatgaaaagacatttcaaatcctatgaatcagggaaatgaaaattaaaatgagctactgtaccactgcaagcctatcgaaatggtcaacatctagaacattgacaacaccaaatggtagatgtgaagcaacaggacatctcattcattgctgatggaaatgcagtgatacaatcactgtggaagacaatttagcagcttctcaagaaaataaatatactcttaccttaaaatttattatttgagctccttagtatttacccaaagaagttgaaagtgtatgtctacaccaaaaccgcacactgatgttttcagaagcttgtttcataactgccaaaacttggaagcaattaaaacatccttcagtaggtaaatgaataaactgtggtagatcccagcaatgggctgttattcagcactaaaaaggaaagagatagcaagccacgaagagacatggaggaaacttagatgattattactaagtgaaataagccaattttaaaagactacctactttataattccaactatatgacaaatatagttttgctttgagaaaagcaaaagacactaaaaagatcagtggttgcacatgttggaaagaagggaggaataagtaaagggagcccagaagatttgtgaggcagtaaaactattctgtatgataaaataattgtgagaaaatgtcatgataaacattttcaaacacatagaatgtacaaccccaagagtgaaccttaatgtaaagtataaatttggggtaatgatgtgtcaaggtaggttcattgattgtaacaaatgcacccctctggtgggagatgttgctaatgggggaggctatgcgtgtgtgggagcaggggatacgtgggaaatctctgtatctccctctcaattttgctatgaaattaaaactggtctaaattaagtctatacaaatggaattttaaaattattctttgtagtttataattgctgggcatcatagcagaatgttttcctgatgttaaaaaattacaatgtatatggttaatagtttgtaacagtgaatacctgtacgtgggaaagtcaaaagactaaaagaaaaagaaaaacattaataaacaaggtttaccttctagtagacatattcacatgtgtgtctggaaatatttatcattactccatgacaaccacacatttatcacctgaaagactggctattatactgaattacactaatctaaataataaggaagaaacaagaagaatcatagatgttggggaaaagtgaatatacagaataaaatctaaaagaaatataattatataacttcaaatattccagaaaagaagttatatacttcagcactttatttctaaaccctgggaaacaaatggcacacagattacaaaaaacgagtgaaattttgctgttgtctatttggcatatttgaatcattttcatcctttctataatatgtaaaatgaaaatatcatggttgattcataaaaacacagatgaatgaggtcttattggatgttcagtcctaatctccttttcattcatccccccttatgaaagtatcatgacagtaggatccaatggttattgtgagtgaaatattacatgaatacccgctcctcaattttagctatatacatgggcccaaacttgaatcacaagcaattaatcagaaaatctgagaaagtaaagagaatatgaagtcacatgatgatacctcctatccaacgcaggtataaggaacatgaaattttcaatattaaatttgttttgggatgtgttttatttggattatttttgcatatccttccattgcatttaagttaaaattatttgcaagtaagttattctacatagtagagttaaactttctattaattatgcattctgaaataaaacatagaatacatcaatattttaaaaaccttacagccatatttgtattttaaggtaaccacagtatacccttttactcttcccttttctaaactaatcattctcgaagctgttttcatgatttattaattgcatgaaatccttacattctggcagggtgtgcttattaattaatcaataatatcacctctcatgatataccagatgacatctgacaggggcagagtgcatggacatttactgtctttaatgtggaaactctctctctctctgtgttaatattaataaaacataacatagtattagtgtttctttaagtaactaaatattttagttacaaaagcagtaccaacatatataatttatatttaataatatcaccttttatgatagactggatgacatttgacaggggcagaatgcatttagacattcacagttttaatgcaaaatctctccctctctgttgataaaacataacatatattagcgtttccataagtaaccaaatattttagtttcaaaagcagtatctatatgtaattttatatttaattaaataaaaatatatatactttaaataaaattatataatttaatttaatttaattatatataatttaatttaatttaattatatatgatttaatttaatttaattatatatgatttaatttaatttaattatatatgatttaatttaatttaattatatataatttaatttaatttaattatatatatttaatttaaattaattatatataatttaatttaattatatataatttaatttaattatatataattaaattaaattatatataattaaattaaattaaattatatataattaaattaaaatataatttgattacattaaattatatataattttatttaaacactcaaaaatcaaagaaatgtaaaaagtagaaatcaaagaccttaatcaatactgatcctatttgctgcctcatacataagcattaatatttttttccttccttcccaataattttccatgtggtctatagtttgtaaaaaataatatcctaggatacacacacactcacacacacagatatttctatgtactacatatatacatatataaattttagcaaatttatgtcacatagaaatgcagctgcaataatgttccatttcagcacataaatctcttcctcattcttttcataaatgagtagtattccatagtgttagatataataatgtatttctctgcttctttattgttacactttagaagaaactttcaatatttttataatggactgttctgttttgaatatccatatatataaattttgtaaatatacagtaagatactagatgtagaatggaaggccaaaactgaaaaattctggcaaattgcccacagaagtctattccaattcatggctgcaataaaagcaaagaatgcatatttctctacaacttctgacatattaaatatcaccaatttattttttgacaatctggtaagtaaaagtttttattttgatgttatttaagatttgcatttgtctatttaggttgagtctgagcttgtttctttttttggttactttgttttaattgtcttttaatatctttacacactttcatagagttatttaaccttttctcttacttgttgcttatatcatgtgccctataatcatttgattttgtattacttgcaaatatttatttatatgatgctatttattacatgaaagtttatatttttatctgcaagtttatgaatttcataaatttttttcagtgttgacattttcatttttaaaaaatttcttaaaattgaaagtttcagtaatatatttccaaatgtaaattctccatgcatgccacgacagtgatgcaggtaacactgattgagtgtggcacatgcatcagctattacaagtaacctacaggaattagtttggcactattaccatctttgttttattaactaagcaattcgaaggatggggagttttatgcaatgagttagtgggagagccagctaatttagttctgatacacctccctttaaacattatgctatgcttgttattatttcctatttaatagtaagttctaaaatatggcaggaatttatataatgttaaccagtctatacattgtgaaacttatccacattacattttgtgactattttgacaaacaattgcctcatttactctttttaattctacagacaatatcaataatgattctggtattacttaatataacttacacgaggtcaggagatggagaccatcatggctaacgcggtgaaaccccgtctctactaaaaaataccaaaaaaaaaaaaaaaaattagccgggcgtggtggtgggcgcctgtagtcccagctacttgagaggctgaggcaggagaatggcgtgaacccaggaggcggagcttgcagtgagccgagatcacgccactgcacaccagcctggacgacagagcaagactccgtctcaaaaaaaaagaaaaatattatatatatatcttacaatggataggagattcgacatgtaaattatgtgtgtttcaaatatagccaaccaaggttaagtaaaatattcacttgataatacttatggtatttattataataaaaaagttaaaaataacctaaatgtttgtcagttggtaactggttaaatatatggtggtacatacatacaacagcatagtatgcagcatgaaaaaataaaagacaactctaaatattcttttatagattatagctaaaactcagtgttagttcaaaaggctcaattatatacagttagtatattatttgtgtaaaaataactgtatgcatttgattcatatgtgctgatatctgtgtagaatgtctctggaaaaaaattaatgtaataaaaattaaaattaaaaaggtcaccaaaaacaaaaataagaattgtaaaggctactaactaaccattttctcttgttaatcttgaatgtcctttcagtaatatttaattatttttaatttaaagatatttgtttgcatattaattcttagtaagaaaaagaattaaaatcagaattcactagttctgtcttctctctgcattgtgctttagttcatcgtatatttgtaccaattgttaatataagaaaatgtttgaatcattttcttgctaagaatcatcaatagccacatttccacaaatagtatactcctgtatgtcatcacaaacactggcataatgcagaattttttaaaagaatcaattgaagaataatgaaaactaacacacaaacagaccaaacaacattaagatccagtggtggtgggctcttcatccatctttacttactctgtagatcttacttacttggggcccttgatcagataatgttgctaaatctgtgtgaatcactgtctcttacagacatctgattttcagagctaaaaaagtttattcacttctagatttcttctattcttataaacacccattcttcaaattatgatgcatgtgtatgtgaggtacctacatactcagataagaggaatgatatggaactgtgatctgatcaaaagtgttttatatccttagtgtttttttctatataagtctcagcatttgtagagtctgttcaatctttggaccattgtagatttgttgtttgcttgctttttttttttttggtaatcctagtgtatatgcttcctaagagcaaattttaatatcctatatccaccattatgataagaaacataacagtttccctgctctgaatgttctaaatgtcccacccttcctctagtccctggcaactacagactttattattgtcattatgcatttgtcatttccggaatgtcatatagttggaattagaaagtatttagtcgtttcaaactgcctcagttgccttagtaaatatatttaaagttctatatattttcatggtagttagctcatttattttttattagtagtaattttcagttttaccgatggaccacagcttacttacccattacctactatccattcacttattgaaagacaagttggttacaatttttggcaatttataaatagtgttactgtaaacattcatatgaagactgttgaatgaatacaaattgaagtccccaacccttctttagttttttttttttttttctgtacctatttgaaatctttattaggagtacctcatgcccaattcttctgtctcactttactccttgtcatcaccaaataacttccttgttactctttttttggttgttgttcagttgtgaggcatgaaacattataataagttttctagttttcatcaattgtgaaaaattacattcactgttatatattcaaaatttgataaagacgacattggaggatgaagttataaatgaaaagatatgcatatatgttacaaagattattttatttaaactattttcttgaaaaacgtgaataagttagaagtccataatcattttatagttaagatctttcatacaaatggatagacatatttaaaagaagacaacacatacaaattttgtcttctaaattttgaaataaaagcaacccttctgaagtatttcaaatattttaaaattttaaaatgttttcttttttattattttaaaaatgttttgaaatattttgatagtttcaaatgtggctagttagaggaaagaaacctacttgatgctgtacattttattaacaaaatattttcatttttttcaaaatagaatatatacagtaggattttaaaatgtgtaccaattttgcaaaataattgatacagttttgatgagaaaatctatctagaaaaaatggaatttcttcctttttttctgagtgataatatatggtgaaacaaatttaaatggtaaagcatttctcagtggttttcttaaattaaccaagttggatttatttggaggaaggtagaattgggtgattttaaactctgtttttttccataatgcatccatttttaaattacacaggtgagatgtttctctttatgtttctaggaaagatggatcaaaagaaccaatagtggagatgagaacagaggatgaaagagttactaatcacgaagatgggagcccagtaaatgagccaaatgaaaccacaccactgacagaacctgagtatgtggcttggagtgctcacttatgttcaaatgggtattggcaaaatgataacacattattattgttgtattacatatttaaatattaattatttgtaaaagaattgtgcttttacttttttgatgaaagtacatgtgaatatctaaaatccattttctaaggagacatttttcatgaaaactttgtatgaatgtcagagaaagtctgttaaaccatatatctgtaatttaatgcaaaagtataaaaaggtaagtatcttacagagtttgaggttttcaacaatagtctgtctttttaagatagtgttgttttctctttcaagataaaataattatatttactgaaataaggacatgttaggaaatttgtcatcgctttgaatataaatgtcattgaaatatacgcacggctattttaaaaagaaatatttgtgcagaggagaaaataatattaaagtgtttatcattgcaatatctatgtagtaaatgatgcttggtttccattcttgatgttatttattttgcatctctaatagctctgttaaaactatagtagatatcaaaagctgaaaagatgaatatacgcctagattcatgcacagaataattagaataattcaaagcaaaggcattattacaaagtagtaatagtagtattcttctattggatgtatgtggtactaacaaaaccatggtggtcacacacttctttactgtgcaccaaaaaaactttttaattttattatttttcaaaacaaatatttatttttgtaacacctaatattttcttgcagagtaaactgatttaggtttctcatcctaaatcaaagaaaaaatgttgtcacagatgaagaaaatgattttattttcataaattccctctgtctacccacaaggggctgaaataattaatatttacacaaatgcaaagtactactctatagaaaaaaatttaatataaatcctcgggccaattttagtgattgcatttagagattattacaatgtaaattcaaattaactgtattagatgtgggttctacattcttcactttagaaataagaggtgtacatgaaaactagttaagaatatgctcttggaccaggctatattttgggaaaaaagggtaatttaataactatttcacaattatagaaaattaatcaccaatataaaataatatgattaacagtgatcttaaacatattttacctatacgtaagtggtgagaaattctatacccagaaacaaactatcaatttggtgaaagcactgggtcattaaaaacttaatatatatttcatgagtaagagatatattattatgctaacttactatcagaactctaatcagaactctttctctacagtttgatgcttgaggtgacacattgcttttatgaccttgtattgtcaatattttcagtacttgtgaatgctaaaaaggaataactgagactgcactatttataacatatataaaatagcctgctctcgttggtacaatgttttttaatgtttttttcattcccagcaatggatattactagtttttgcctattacttcttttgattagttctgattgctttgatctgcagaatgttttacccttctcattcaaaaatataaaataaattacaaataaatcccagatgaactagcattgtaactttcactccattataacatggtaaggttaaagtcacagagatggattggaatactatttctttcttttttttttttttccgagactagtttcgctcttgttgcccaggctggagtgcaatggcgcaatctcagctcacctcaacctccgcctcccaggttcaagcaattctcctgtctcagcctcccgaatagctgggattacaggcgcacgctgccacaccaggttaatttggtattttagtaaagacaggctttctccatgttggtcaggccggtctccaactcctgacctcatgtgatccgcccgccttggcctcccaaagtgctaggattagaggcgtgagccactgcgcctggcctggaatactatttctaacttaattttcttggtgtggaaaaagtatgttgttaagggagaaaaacccatctccaaatgtcatgtacacaatagtaaacaattgaatttgcaagttttaggaaaatcttgaaagcacaattcattggcatcgaagtagggtttatgacgctgtcttgatattaagaaataaagttggtattgcttcataagttacaattgcaaacaactcaaaatccgtgttgcaaagtgacataaaagtgacaagaaaaacaatgtgaaaagagacaaaagaaaacatatacaataaatattaaaaagtgagcaagtcctaaaatatgttcatttgcattaagttctaaggaatattgttaattcacttagtttctgaattttattttattttattttaataataattattattatttgagatggagtcttgctctgttgcccaggctgaagtgcagtggcatgatctcagctcactgcaatctccacctcccggttcaagtgatttccgtctaatttttgtaattttagtagatacctggtttcaccgttttggccaggctggtcttgaactcctgacctcaagtgatccacccgcctcagcatcccaaagtgctaggattacaagcatgagccaccacgcccagcctggtttctgaattttatgtaacagaatatggcaacaattattaattgttttcactggagaaaacgtagtgctaataaatcatatcattgacatttaaaaatattttggcattttaccttccataacatgtaattatattttggagatcaacaactagttaccaaatctaagccaccctatagtgagcaatttggtgcatctatatctacaaatatattgtttcattcatcattctgcattacatttttaaaaggccaagtaattgtttttactctcttttagatctttttaaatctattttatattatgttaataaatttaatttttcctttctaattattgtagcacgttttctctataaaatagtaacttatttagcatatataaaatgttagcatattattggagcatattttccttacaaaacagtaacttaaaggttaaggtacgtctccttaaatacctcagaaaatgaagcttattattttttatcttccagaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttttagcccatggttttatataatctttaagaactaattttaccactgttataggttcaccattaaatataattggctaataaaaattttaaggttgactaaattaagaagaaattatttaacattttaatgtgccataaaagagtaaatgataaataattaaatgccactatgtgttctattccggatgttctagctagaagtcattttaagattttgataaacaactttggttgaagaaattccttaagtattcaacacaaactttctaatatcttttgttagggttataccagaataaaatgcttctttacttccaagctatgcaagctcccagaggtaatagagtgacacatgatttaacttatatgtaaggtttaaaaaagtatttatcattataaacatacataccatttgggagcaggtttattaaccttgagagccaaaggtttccttaggccctgtaacattcagaacctttggtgtttcaggtggtattatagctcaaatagtgacaggacagggaatgcgttccaaaggaatattggagcaattttaacattgcagaaacctgctctgggtgtgtctctctgtagagataacctgatgattattaaatgtaaaattaaggcaactcatgaatatttttatttacaaagtgcttgaaactcagccaaggagagaaaactaagtacttttatataattcatcacttttctggctacagcaggacagaatatgaccatcttcgtttgaaggcaccaaatcgtcgcagtgtctttgccataagttgcagggttaaatgcgggaatctctccttgcgttcctgtctggcgtattctgaagaaaagaacagaattcttgtgcctacctaagaatttgagtagtgtctaaacaaacaaagcagttaggtcattttaactgacttgattatccaactggtctttgacagatttgactgttcatatttagtttatgtttgtctgatcatccagtttgctttattttgctgtgttttattttgttgtttgttttgttttgtaccagtgtactaaaactagtcaaaatacttgaattagtttgtttgtgcaaagtgtacaagcttagtaaagtgtccatgaagcaatagccatgaatgctaattatttctaaatagggccacatggttttaaactaatgatggtgaaagaaatacgatgactgagaaagtcatttcgcatgtttactattgttatattcgtgctttacttcaagagtgcagaaatcataataaataacaaactatttttgtgttttctcaatgtgacatttctgtttctctcatttattcggattttccttgtaaagaaattgacatatatttcatatatatatacacatatatatatatacacatatatatacatatatatatatgatgttaaatttcctgccactcatgtggagtaatgatctgaaattaacagataatctgaagctaattatattcagactatttcaagtgcactgtttcagttgcccgggtggtccttacctcttgtccttgaaatccatgccatgctgaagcaaggcaatactgtgataaagtattttttttaatatttcaatggaatgctccaaatgatttataaaaatttcaaaataaaagatggcttgtagtaaattgtaaaatatgagtagaactgaaataacctgtttcattcttattctagattaaacaaacatatacatataaccatataaatgttatttttattgtctgagagtactcttaaatattagtataaagtgtcaaaagaattgactgaatataagtactgttaaaataatttgaaccctatgatattttaaaccaagaggcaaagatatcacctaaaacttggtatttcttgataggttaggtgcaattaggcagtgacaatctgtattcaacaacatataagaggaaagagtaatatcagaattttgacacaaattaatgtgtcaacatattttacaatgattgtcaaaggaatttaagaattgtatttttaaagatttatttattatttttgtgggctaagacattgccattctattgatactaatgtctaacattaatgtttcttgttttcttttatttttaatattaataactataaaagcatttttcaaaggctatttgatccagcacacttcatatggatcttagtctttgaattaaatatttatataaatagattttattaatcaaattatttatttgtgtgccaacaattaattgtaactttatgatcatatctttgtttatgcttcttattttaaataattaagatgtatctgtgccttttaattagcatgacagtctgctttattaaaagaaaaaaactacaattaacatcattactagtatattttgcttagatttgagatactcaaatgatgctgtcttatttacagtcagtaattaagttcaattcaaactattttaccttgaatataaaatctaaatataataaactatactgtataatttactttaattcatgtcaaaacaattctttttatacacacacatgaaatattcttaatctgttctgtattgtttttctaaacaataaatacattctagatattgttgaaattaaattttgccagttgtaagacaaagacaacagataacttttgaaaatcaagcaaattactatggtgtttcttgggtcttcattattccatttatatatattttttatttcgaataataaatcaacctttatttttggcaataagattatcactgacgaaaatatgtacagttcaagaagtagaaataatattttccattagttaatttaggaaatattggaatagcatattataattatttatgaggttcccaatgttgtttttcacagaaaataaggtaaacattcaacttaaatcccccatgaagttttttcatgctcatactcataatcattatcacataatgtgcttattcaacaaactttgtatctggatatatttttaacaataagtttgttagcattatttatttatctttagagagaaaatatttgcatctgtttatttaccctttgaagcattaatacttagtcactcacattgaaattgcatatggatgtatcaacataggctaaaattaaattatggatgtcgcagaaatgaaatacttcatcttagaaggtaaaattttcaagaaa

SEQ ID NO: 12387 - DNA, 223471 bp, Human
  misc_feature (1)...(223471): n = A,T,C or G
gcataatttccatggaactttaacacaatgggatttctatcctaattttatgctttgctttcggtaatttgtcagacctgcaacaatggatgagcaacaaattcttggaaatgaaaaatatgtaattccatatagtgcaaaatgaatatatgtaggcaaatgggtaatacgttgctcatatatggtcactgtttgtcactctcttattcttcattttcttgagaactagaagtctcctgcttcatcaacccaacctaagactcacccccaactctgacactgtctaataattgtcaatctttgtagctctcttatgactttgagatcctgctgaggacaaactcatttaagacccgggattaataagaaatccctcttcacatacgggagaagaggccagtaaacatgagtttattcgtaataatgaccaatgatcttgttatatgtttaattaagctctgtagctttgtgtctaactgaaccctgatttcaagaagcatttatgggtattgaccctatgtcagatactaggtaagcatctgtgatacaaagatgactatgcggagtttcttgtgtctttatgtaaaatgtcttcactacattttgatttggaagaacagctttctcatcataagtcaagcctactcatcagcattagatttctcttttatcataataaaggtattttgaagattcatctgtagattcatgagcctactttcaaatatgttattcaagtcaccaattaaataagacccaggactcaaatttttgggaatctttagctgtatcctctttgttgatatttagctattaactactaacctttggatatggtcagatttttttttcctcctcctagaatatttcaaaataaagaattaactattggctgagcacaggggttcactcctgtaatcccagcactttgaaaggccgaggtgggtggatcacctgaggtcaagagtttgagatgagcctggccaacatggtgaaaccccatctctactaaaaatacaaaaaaaattagccgggcctggtgatggccacctgtaatcccagctacttaggagactgaggcaggagaattacttgaactcaggaggcagaggttgcagtgagctgagatcacgccattgtactccagcctggacgacagagcaagactctttctcaaaaaaaaaaaaaaaaaaatgcatagagagatttgagcatagagagaagccaagaaagtgaagaaagctcaggagagtttcaacccatcatgtacccatcatttgtcatcgaagactcataagcatggccttccatcaactgtgcacctgcctacagcaagaacaggcaaaccacagacaatctctactggtgaggctgtttcttggaaacacaagtttcctcaagctattcctcctccccaccctcaattaatacacttcctccctttagaaagaaattagatcagcttaggtgatttttctctttcaccttctaattgttaccaaaccctgcttctttgaggtggtatcagactgaatgacaatgtgttcttcttctggtcctgggtgtgggcaggagaataagatggaggaatgcgctgaaggccaccactctatttcctctagattctctaaggtactctaagaattgcatcgtcaatgaagatgatggctaaatgtaaaaatgatcttaccttgcacataaatggaaattattctagtacaccataaggactaaccttatgtaaaattgtaaagaaatacgtaacagataagctcatatctttttgcttgtttatatctcttccctttcatggtacccttgtaagttctccatcacacctgcctgttcctgatctccagcccacattctccttgggctcagcccatccagatctgatcatgctgaatccacctgtctttcactatatccctcccctctgagctctccacgctttggagggagatatgttactaccctgatactaatcaacattgctagaccagtaaaagtctggaggataagcttagtgcccatcctgcagagtaattggcgtctgcattttaatggaggctcctgtctcctcattcagagcaatcctgctggtattttcgactagatgaggaagggaaatgggccctttatgcaggcctgccagaggtatttaaaggtgagcaggattcagaggggaaccttgaacagcaccatccacacaaacctcctctctcctccctacttccccagcttggaaaggcagaccccctccctacttggtattaaacattccacttttttcactaacagtgcaatctccctcaattagcctatactcccaaagcaaagacttggcaagagggcttattgtctctgggtgttacaagtacattgcgctataaatgtctatgctctctgtctgaagtctcgaggagtttatcatttacttgcatctggacacgagtgcagttttcccagagttccatgctcaggcatttctgtggacagagggagattctcttgtgctcagccttcctctccctgacattggtgtggagggctgctctctgagtgagagctgctttctatttgactcaattcagtcagtgttcaccaggtgactcttctgtgcaaggcagctgccaggggctgctagaggtggatgggatgcatagccaagtatcaaggcacaccgccggccctctgcagcaggcaggaggatgtgtggaaacttgcaatgggcccctggacaggagccgtggttcacctcactagggggctgggtgagcggaggctgggcttgtgctgctagggggaggccgtggcattaacattgaaccaataatgctctttgccagaaggtggtggaacccagcaagggcagatgtgagtctcggttcacctctcacccagagccctgggattgcacagccaggggcagcgcccagtgccacagcagcctgcacttgaccttgctgcccaggctgctgcccagcctcccaagtagctgggactacaggcgcccaccaccacgcctggctactggctgtttctgggcccttctgctgctttccctgcacaggacattctgtttgctcagtggcagtgggcagctttgtgaagtcctctcatcttctggaaagcagggctgagctgtcctgagagaatttcagcgccagcagatatgcagggtgggggcagtccccctctcatgcacctatgttgccacctccccggccccatggtgtggagtcactgtccagctgccagtgagggaggcagtgagtgcccccggccccatccccaggccagtggccttcatctaaggtatctggagagctagactcgcacatgccctcatagaagccaaatctccctccagcttgaagccactgtgcagccaacttctgccagtctccccgaggaaataatagtcctcttgatttcatgtgtgctttactttttattttgaaatagttatggatacacaggaagttgtaaacatagcacagaaaggtcccaggtacccttcaccagctttttccaaatggctacctcttgcatagctagagtacagtaccaaaaccaggaaattgactttgctacagtgtatgcgtatagctctacttatcacaggtaggtttgtgcaactaccacctcaactctttttttttttttttttttttttttttttgagatagagtctcactctgtcacccaggctggagtgcagtgacgcgatctcggctcactgcaagctccgccttccaggttcacaccattctcctgcctcagcctcctgagtagctgggactacaggcgaccgccaccatgcccggctaattttttgtatttttagtagagacagggtttcaccgtgttagccaggatggtcttgatctcctgaccttgtgatccgcctgctttggcctcccaaagtgctgggattacaggtgtgagccaccacgcccagcctagcacctcaactcttgatttcatcttataactgtgtggctgggtccttacccaagcagaaccccatgaaaccaacagattcagtggttttgatgtacgttttggtgcgctgtgatgtcaccatataagtagccaaatttggtgattctaggttgacttactgctcccagatccataaagattggtcaacacgaatgaacctaaaaagataggtcagtcacacggaaccctgccccagccaaacaaactcacacttgtcaatcatgaactcatgattgaaaatgtgcttcccagataaaagaagtcatctactcattttgcttccatgttgctgatagaattactttttctgttctggctttcccaaggcaattacaaaacctgtttactccatcgtaagttgaaatcaacactattactataaactctataatactatatttttaccctaactggaagaaattaatcattaaacctgtggattaaatacaacttttaacatgatgcatacaatgagaaacaacttactgaaagcatcaattcaataaatgcatccactgaaatggtggcttatttaagagtcatgttcctgtacttttcttttttctttcttttttttttttttttttttttttgagattgagtcttgctctgtcacccaggctggagtgcagtggtgcgatcttggctcactgcaacccgcactgcccaggtttcagcaattctcctgcctcagcctcctgaatagctaggattataagcatgcgacaccatgcctggctagtttttgttttttagtggagatggagttttaccatgttggccaggctggtctcgaactcctaatctcaggtgatccacctgtctcggcctcccaaagtgttgagattgcaggcgtgagccaccatacctagcccacttttcttctttttcttcttcttcttcttctttcttctttcttcttcttcttttttttttttttttttttttttttagaaggagcctcactctgccacccaggctggagtgcacagtggtgcaatcttggctcactgcaacctctgtctcctgggttcaatcaattctcctaccttagcctcccgagtagctggaattacaggcacccgccatcacacccagctaatttttgcggattgtttttgtttttgttttttaagtagagatggggtttcaccatgtcggacaggctggtctcaaactcctggcctcaggtgacccacccacctcagcctcccaaagtgctgggattacaggcgtgagccactgcgcctggcccacttttcttcttaaagtaacactttggaaacactaggaatgaactggctctgttttaaggttatatagaaaaaagtaatggagttgggcattgtattagcagtaccataatgaagcttcttaaaagccagcttgatggttatttttaacaattataggcactacttacaggtcactgagataaatcacataatgttgaactttgcagtcttataaggaaaaaaaattttctcctttgccagaaattatcaggttattaatttttttcagtgcatgtgtgaaaagccattagcttctcttttttttcttttctttaaatatccagctatactaggtgactgtgctcaaatggtggtgattgccatggactaaaatcccatcagaagaaccttgagacctgtcgaggtgaaagctaacccactggaaagtggatgccatcagatttgtagtagttgataagtgtgtagaagtcaagaagcactgaaaatggcagtgtactcaattttaacttcatttattcaatgcttaaatcagtcctaaggaggatttgctgtagttatcatagtagcataatgatatactgtttcaaatgaaacacatgtgaagtaacacaattgactcctcattttaaatgatcctgctttaaatgttgagatccagcttctcatagcctaagcatcccacaaccaaatgcctgaaaattaagattcatctctaaaggcagtgtagtcatataagaataagctccacaaaattacatttactatgagtacaatattacaaaaatatatgtacatggagaaaaactcacaagaaatccagaatccagaaaacttaaccaggttaatacggtgttattattggtcacttttgctgttttcattttaaattatctaacgctgttctgtgttttcagataagaggaagggggaaaacagttggatgctgatttctcgttggtaccatgcatataatagatgttcagtagatgcagttggaggaaggtgtaacaataaaagcaggacatgtcagtagtgtgaatgtgccctttcatggcacaatttagaaaacagcctggaagacactgcacgttggcctcatgctttttaaaggaaataagacatgtatagagtcgcttttatgcatcttgtgatgaagatattccccctggcccatctttaactaacaattgggcctctcaactgccacctcaaagttcagtgctgcttgagaccaggggacacccttggcttcaggggagaggaacccggaggactccgtagtaggcaccatgacggcagcactaaggagcttgccgctctggacttcctagtgcagttttcaaggggtgggttcctggcctccccgcagtcctcctggaaccagagcccttctggtctcctggttcccacagcaacaaagttttctttcagcccctagtcactgggtcccctttccctggacctagtctctttacaatgaggtcccagataccagcctctaatcatcaggacaaacggccatcccccaactccagtttcctccccacccatcacctccctcctaagccagcgtgagtcacagacgcagatccttaaccctctctcgctttttgtcaccttgtccctcgcgttcagatctgttcaagctcatcctcaaaatagctggccttggttttattctgttttaaaaccttgccttcttcaccctttttccccataacccctatcactcctcaaaataaaactttacccccaaaaaactgttcagagtcccagtcccagccttatatggtctgaccctgtcctgcagctcagacccggtttgtttctcaagatcatgaccacattcaccatccaactcctgtctgtgcaacctgcctaaagagtccttgcccagttggataaataaatatctttcatttgcagaaatcttgagaaagcaaggactctggggttttgttttgtttttttccactctctctactcctttttctttggttctctcattcattcagtcatttgttctttaaatctattgtttatttacagttcctgagatcctagttgcaccaggaaatatactagataataaggttacaaagaaatacatttctgctttgagaagatcgtaattcctggggtcctaaaatacagctgttacagttacacaaccaccaacttttcatagaccttaatgattcccaaaatgctggcacgttggttgtctcaattagtcctctctacaaccctgtcaggaaggtattctatttgtcaccattttatagaggagggaacaaaaggtcaggaaagttaaataatttccccaagatagcccagctttcagtgatggatctgggagataagcccacctcccatgctcgttgtaaagtagtgctttccccgccttctcatgagatgtcttacaggggaaagtcattcttaagttaaaaacaacagcagcagcaaggcccgtacagcatgctcaggtagaaaatcacctcctagaaggagtccaacttcgggttccttcatgtagtggctcagtttgtttacctccttgcccacatttaccttcaaaaatttatcttgtaaacaaatgaaaaaaagcagaaagggctctttcaaaaaaaaaaaaaaaatgtgctgtaatcccagcactctgggaggctgaggcgggcagatcacgaggtcaggagatcgagaccatcctggctaacatggtgaaatcccgtctctactaaaaataaaaaaaattagccaagcgtggtggcatgcacctgtagtcccagctacccgggaggctgaggcaggagaatcacttgaacccggggggcggaggttgcagtgtgctgagatcgcaccactgcactccagcctgggtgacagagcgagaccccatctcaaaaaacaaagcaagcaaacaaacaaaacatgtatctttaagctcaaatgggaatatcccgtcacagtttgagaatgtaatagcttaagaggcagccaaatttttatttctagaaaccagtctatcattttcatgagtcgccaaataggaaactcctaaacatctgctttcctaagtgagtggaacttgtcctggtcctgacctgagaaatcgaaaccgtggcaagagtggttctgtggaggccagatgggcatttctctgagaggcaagaggaaggcaggttaatgtatgactcccaaagttcttacacctagcagtattgatgaaaccatattgttatggaatatcatcagcacggatattgtttcttaagcctacagctattcaaagagaaaggggaaaaagctgtgccaccttaatttaattggaagtaattatgctaacttccagcccccatagctgtgtgcaccagggaggccaggaggacggcaagtaagagtcaggggcacttgcctctccgcgtttgctctacatagtcacacgtgattgttttctcctcgtgtagaacaatcatctcacaacattaaaaggtagaaagagcttcctcttggttgtgtggttattttgggtgcagagttaatgacaaaccttgtataccaattcaccaggaatttcagtccaagccaggtgtgttcaatatggtgacctgaaaggaagcccgctctgttgaccgtgagaaatgagcagttgttagcacgtcaaaggtgtcatccctaccaacgaggtgtcccttcttgtggtttgttcaatacttctccgcatgaatttacttacaatagcaatacacttcatcagattcatttctatcatattgtttccctataattttattatattgtctgttatgcaccagagcctccctttttggccaagtgtgtttccacttccatttgattttcagggggggtcatttccttagagttgttttaaaccatttttctgagcttgggatgtgctgttttatcatatttgcagcagtcagaggctttagagcattttttactaataaaaatgaaaccacctctgttactgttttagtaatactgttctttgtagacctctttccattttcagacttacattgaatagattaggtacacttgtgttcttattcccatcaagctactgtataatttttgtcactttggctcttggcaggagattctgcatacagtgacaacaatgtaggtgtgtgtgcacatgtgtgtctgtgttagggggaaacgtgggcctgagccttggctgaaccctcacagcaagtctagccttcccgcggatcgtaatgaatggaactgcgggagctgtctccgctaaagtgagatattcttctcccagactaatgttttctgcaccagttagcagatttttttttttttcctaagatcaacccatctgccactttcattctgcagtaacctggcaacttgcagtctggatcgttctttttcatcttgacccctggccttggaatgctgcaatttagtgatactcctttaaaggattgtctggtcacttaggcaggtcagtgctgttatttgctcatgtcatgagggctgggtgttcttgaatagatggtgacagtatgaccataattcctaacgtgtccagtcaattgtcatgggctaaaacctttcacagaaataacggtgtcagatatggctgtggagtccatgaaagatgcattattattttgctcatccttcataatacttattttctttatccttattgccaattccccaggagtctagaaatgaagggatttgtttccagttgacatcacagtcttaggcctcgtgcggtttatattctattggaagggaaaactgataaataccaagcatcattttgttgcaaaagtttaaatcatctgaactatatatgtagcagcaatctagattgtgtttattttcctctattttttaaacttacatcatatttccaatctgacaaattgaactgctcctgcagtgccgtgatttaagcctcataggccaatctcttcaggtgattgttttgtctatttttaaaaatctccacaaagaacatttatttttcttcctagtaaacgatgtcattgtttacctgttagaaatgtcttatcaaattttaagataacctgtcctttgttatagtttgagtccattaccctaagagattacttcattttctatagcaaacaaaagatcagtggcctctttaaaaatagcattttccatattggaagaagaaaatcatgtctggactggcttcttttgatataacaaaaactatttcccttatccacgctcaatacggtcaacaccctctcctgcaaaaatggccacaggggaaaggagggccattttcagcccacttccaatggagaccaatctctttccaacatatttcattcaaatgataaaggattatatcctctatcatttgcttttacaaatagaacattggaagtcttgacttgctattattttcttgaaggttagcaaaaacataacttctgctggagtaacattgactctcttgggtctcttaatacccagactggttacttatgcaaatagctttgctgtgtaattagggtaaagcattttggttaaattgcctttctatacccagaactctatcctagaccaacctttgtaagggaattgaacctgctgggtttgaaaattagaatactaagcacaagtgggtgcatttcttcaatgggcttcgcgttggtctcagattaactggaaacaacaacttgatgtggggatctcagggacagtcacacttcacgatgcctcactggcgacctcagggacagtcacacttcacgatgcctcactggcgacctcagggacagtcacacttcacgatgcctcactggcgatctcagggacaatcacgcttcatgataccgcacatcctgtgatggttgagttattacaaagcatcaagaaggttcatctccacaaatttgtgtcatttttagtagccactgcatctggaatttcatcattagagagtaaagagcctaggttcctgccctttaaaatctcctcttaaaacacaattttataaaagtgttcatgtgtaaagaacatgcctctcaacgatgcatatgtcttcagaaatttcttatagaaatcataaggacggtagaggattagcctcctggcaagggcatgaatgcaggagcccatgggcaaaaccttgcttgcacctttttgagcccacacagggttgagctgcacaatggattaattaagccattttatatttaaatttaaaatatcgatttgtggcttaattttttttttttttttttttttttgagatggagtctcactctgtcacccaggctggagtacagtggcacaatctcggctcactgcaacctctgcctcccgggttcaagcaattctcctgcttcagcctcctgagtagctgggattacaggcgcgcaccaccacacacagctaatttttgtatttttagtaaagacggggtttcaccatgttggtcaggctggtctcgaactcctaaacttgtgatccaccctcctcggcctcccaaagtgttgagattacaggtgtaagccaccgtgcccagcctttttttctttttttccccccaaaggaagctcctggtgcactagatgggcattctcatgtgaagaaaaaaatcagcttaacatgaaaggccatcccctcctttaaacagcacaggtgcttccaatctgccaccatgcccacctggctgccccctattctccaggctcctccctggctctaaaagccttgagtttcttacctctcttttttgaggctttgccattctttttgatctcagaatggatcattttctctctgcgaggatgaataaacagctaacactaggactaagtgctttttctcaagcactgctgagaaagatctggaaggtagtgttgcccaagaacaggaggtgaaaaagttttctggtgctcttctaatttaaaaaaaaaaaagaaaagtctttagataccaaaatgtttctgtgatgttgtcatagaatcataacacccggccagacatggtggctcacgcctgtaatcccagcactttgggaggccaagactggcggatcacctgaggtcaggagttcgagactagcctgaccaacatggagaaaccctgtctctactaaaaatacaaaattagctgggcatggtggcgcatgcctgtaatcccagctacttgggaggctgaggcgggagaatcacttgaacctgggaggcagaggttgtggtgagccaagagcgcaccattgcactccagtctcggcaacaagagtgaaactccatctccaaaaaaaaaaaaaggaattataacactcaagaactgtgaaactttcctattcttagctctggtccgttttgcattaccatggtgtttaattgagggggaaaaaaagtaggctacagataaattggaaatgattcaactgagagtgacaaaaattattaaaatgattaaagggttgcaaaactgatctgtgaggatcggcttgaggaattggatttatgaagtctgaggaaaagggagctcagggcggatttattcagtgtattaagggacatgatacggaggaagctgaccaatgttttcctgctctgctgaggacagagcaaatggaaatgatcttacaatatggcaggggagaatttttcatcatgtgtaatggagccataaggactgaccctcaggaaaagcgtttccgaggttaaagaaaaagaaaatacttaaaaatattctccttgagacaggtttttaaaggatagacagtcgacaaggagttttatatcttgttctgcctaaaggcagggtttgtgccaggtgacctttgggggcattttccattcctttgagtctacagatttatagaaggtcttgaatctgattttagtgaattcaaaagcaagtacacatcagctcctaaccatcagaaactaaagtacaaggacacacacatttttttgctattgaattaacacctggaatctcagctattcatgcaatcatttcttttgtagtctgtgattgcaaactaacagttattagtcctctgtggcacttaaaaaagggtacagcttttatgcctaacgtgtgcgatacttctattagcaacgtgtttccctggatacgttttatcagaaacttcactaccaaaaataagaatatagaaaggcattcccatgtgtcagaaaaggtaggtcatttatttcatctactattatgtattgagcacctattataaacctggacctatgttttgcactgagcatacaaagatggaaaagtaagtcaacgagcttacttgggtggtcggggagtgattcaggctggacgtgaaaacccgttatgaaaatatagtttactgaatgtttaaggaggttgcagtgagggtaggaaaatatgaaataccaccgaaaatgggattaaattgacagaaaatatcaactgtgcatggtaccatcaggagcagagagaagagtcaagatatagaggaggcagagaatggagggtagggggaagggctcaaaggaagagagcatcccttcctgaacagctgcgtgctgggccgagaggaaagcttggctgtccccagcagctgtctggaacttccctgaccagtggaatgctagttagcaaaagagattgtagattataattggcggttccccaccccatagccaccttcgagggttaaattgggccatgtacaggcagaccagtacataatgtgatttaataatctgcccaagtcattgtgtcaaaactgagaactgatgccccaaattcacttgataggaaatggatcattccatttcatagagatgagcagtgttacaaatgccacactgaaaagatactttgacaaaaagtcactcgtcttcttagccccacagaatcttaggctgaaaaggaacttaaagcctagtcaccaaacctctttcccactactggaatgggttccgcacaccttccttccttggcaggtgtccaacttaagtggcaaaaagttcagatctttcaggaaggttgtttaggaagagaggaatttttaaaaagttcttccttacgtgaggcttaaaactgcctccctgaaacatgcactcatggcttgagacccactcctgggagctgcttagtgtagctgaacaggcggcctgtgacatcctcttgtgggtctcttctctggaggcttaatgcccctcctcagcctcctgtgaggctgctcctggctccgtggcagccttgcccaaatgggttacagtttgttaatgtctcacagaaggtggttccccaaattgtctttttggtactgcagaccaatggcccagtttacaactgagcaagctttttggggcagccatatcacacttatctgtaaagaattaaatgtgtaataaatcaatattactcttttactgttagcattattgagcactggctgtgtgcctctcaataagcccggttaggtccccacagccgcctgccactcctgggccccacccacctgcatcgtcctcctttctgcacttgtctcactcgcctgtgaccctttttgaccagcccagagcagtcattcaatcagcatttgttgatgaattcattaaataggcaacaaatttttcagcctctattgagtttgcaggtaacgtaaatgaaagtttggaagtcaaattgtcactgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaatagcagacaaacagagagccaaatcatgagtgaactcccattcacaattgcttcaaagagaataaaatacctaggaatccaccttacaagggatgtgaaggacctcttcaaggagaactacaaaccactgctcaatgaaattaaagaggatacaaacaaatggaagaacattccatgctcgtgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagaacccgcatcgccaagtcaatcctaagccaaaagaacaaagctggaggcatcacgctgcctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaacagtctagccatatgtagaaagctgaaactggatcccttccttacaccttatacaaaaatcaattcaagatggattaaagacttaaacgttagacctaaaaccataaaaaccctagaagaaaacctaagcattaccattcaggacataggcacgggcaaggacttcatgtctaaaacaccaatagcaatggcaacaaaagccaaaattgacaaatgggatctcattaaactaaacagcttctgcacagcaaaagaaactaccatcagagtgaacaggcagcccacaaaatgggagaatatttttgcaacctactcatctgacaaagggctaatatccagaatctacaatgaactcaaacaaatttacaagaaaaaaacaaacaaccccatcaaagagtgggcaaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcgatcattaaaaagtcaggaaacaacagatgcttgagaggatgtggagaaataggaacacttttacactgttggtgggactgtaaactagttcgaccattgtggaagtcagtgtggcgattcctcagggatctagaactagaaataccatttgacccagccatcccattactggatatacacccaaaggactataaatcatgctgctataaagacacatgcacacgtatgtttattgcagcactattcacaatagcaaagacttggaaccaacccaaatgtccaacaatgatagactggattaagaaaatgtggcacatatacaccatggaatactatgcagccataaaaaatgatgagttcatttcctttgtagggacatggatgaaattggaaatcatcattctcagtaaactatcgcaagaacaaaaaaccaaacaccgcatattctcactcataggtgggaattgaacaatgggaacacatggacacaggagggggaacatcacactctggggactgttgtggggtggggggaggggggagggacagcattgggagatatacctaatgctagatgacaagttggtgggtgcagcgcaccagcatgtcacatgtatacatatgtaactaacctgcacattgtgcacatgtaccctaaaacttaaagtataataataaaaaaaaaaagaaagtttcacagtgtttggtctgttcccatttatccctgcaacaactcctgacttgtaacatgactcagtcagtacaggtctggggaacacagggttcacccccttttcccatccccgcacacctgaggtttccgacccgccctgcctgaaaccctgctcggacgctcagggttgggaaaaggctatgcctggcagggagtggtccccatggcaatccccaccggctcttcctcagggagtcagaccttgcccagctctgaggtgcagataacgctgtgttcatgcctttaagtcaccctcattagatttcttgtggttcggttcagcccatccttccagccttggagaccctttgggatctttcttcaagcctctaagttattgaatatcttatggctttttgacatctaactgtaagaagtcacatcttctgtctctttacccatgtcatcggtatagctttttaaatatattaatacctttcctcatgtaacaaggacagacctaacactatcataataaactagaagtcaaggctgaaaatccagatcatggatatagcaaagaattaggttgaccacagaggttcttcaatgctttcctcctgtctagggtgtctcaatgatcaaggctgaaggggactctggtggtgatataatcatcattatcagaatagaagcctgtggattcctgggggaagcaggcttttcctcacagtggattctaaaagaatgctcacatctgactttgtgtcacggccaccctgtggtgcagtgagtgatgtttacaacctcttttttaaaacagcaactgcaggccggactgcttctggttgtgaccttcatagaagcatagaggctctcgaagcagggctctgggggcagagcaactgccttagaacccagctagactaggtcgcccccatagccccctcagtccagtccctcacctccataaacctctgttaaatgagggtaattaataagtatctacctcctggggccgttgcagccattaagtgagttaaaacatgtaaaagtcttagtgcagtgggggcaaaggttatttagtggcagaggttatttaggatgaaaatggtacttatcccatatatttgtggtgagaatgacctgaataacccacagaaagagcacagtgtgcagcaaacagaagttcatgagtcttggctattgtataaaagacttttttatgacttgttcagacaagattaaaatcttcagaatgacagccataaattcatcaagactctacggtacagcagcagccccctcccgttctaccctccttttagtcaatctagtattacaagtagcacccaggccttccagatcccatctcctccctctacatgggagatcagtttgcctttataatacacacctgctgttagccttgggccagaagacataccctgaaagtcactagaaccattcgttcatcaaccataaaatagtaagatttccaacatattaagaagtttctatcagacatggtgcttaacattggatatgtatcatctaactcaatccttgccacaaatgcatgaagtaagtgctgttctcctcctacaattaaaatgaagaaagtgaaggttaaagcaattaagcgacatccccagggttacgcacctactaagctgtggagtcaggtttttaatccagagccttctactccagagcatgtacttataaccattccacacctgtccttcccacacattcaccgtagagcatggatcagagccacctcataccctcaccgacactgctccaccatcattagtcctagccgataacactgtgttctaactattatctttccataaatgcactggtactccagaggttgctactcccaaatcccccatttctctcttccctgcttgttactggtcccctccttcaggatactcttactatcctcatccctaccagtcaatgcacataaatgacagctcacattatcccattttttaaatgtgggaatggattccagagttgggatgttgcttcagaagagaaggggtgggaaggcaagtagcttggggtgctgggaaaccttgctaatttcccagggttggttagaaggggtcctttaccatcagtcatgtttacttctagaagctctccttttgatgtcattggttttctgcacagccaaacattgttcatgagcttagagaaaatattgttattggcttggttgacagcgtcttaatctctttatgtctcagcgtcctcagctataacatagggataggagtagtgcctctcccaaagagtgcaaacttaatcaattgactaatgataagcatgtgcagtgcatggcccaaaatggacatgattagcaacaatgatgatcaggataatgcatttcagagttgcttcatgtgatccacaaaaagcagtttttaacacaactcataaaaaagcttttatgcccagatgattcagtgatccaggtattccttctcacatggctgataactaagacatgcagactttctctctcatgtcactcactgacagcgcatcttagaaacgtagtgttatatcttcccccagaacagccgcatcttagaaacgtagggttatatcttcatatcttggtgttacatcctcagcctcaggatgctgctgtggctgaggctgtgctgcctgaaggaaacccctgtctgtccaaggcctgtctgtttggtttatagacccacacaacccatggctcaagaagccactgagccttgtacaaattcacaatgtgagatgctatagagaacaaatgaccagtttctccagcatctgagaggcgtggagtacaaagcagaagagagacagttgcagatggcagacaagtcaaacaaccacttgaacatctgggctgggtgtgaagcctgatttctgattcctggaaacagaccaaccattaaaaaaaaagcattcaacagtctgggagaaaatattgcaaaagacctatcggataaagggactattaccaaaatatacaaagaacttttcaaaattgacagtaagaaaactatcaacaagattaaaaatgggcaaaagagctgaacagaaacctcaccgaaaaaagatatacagatgcaaaaaagcatatgaaaaggtgttcaacatcatatgtcatttggcatttgcaaattaaaacaatgagatacctctacacacctactaaaatggccaaaacccaaaacatggatgccaccagatgctggggaggatgtggagctccaggaactctcattcactgttggtgggaatgcaaaatggtatagtctctttggaagacagtctggcagtttcttagaaaactaaacacagccgggcacaatggctcttgcctgtaatcccagcgcttgggaggttgaggcaggcagatcacgaggtcaggagttcgagactagcctggcaatatggtgaaaccccgtctctactaaaaatacaaaaattagccaggcatggtggcgagtaccagtagtcccagctacttgggagtctgaggcaggagaatcgcttgaacccaggaggcggaggttgcagtgagccaagattgcgccattgcactccagcctgggcgacagagggagacttggtctcaaaaaaaaaaaaaaaaagaaaaaaaaaaactaaactaaacatacgcttaccatatgatctagcaaacatgcttcttggtatttacttgaattagttgaaaacttatgtatacaactaaaccttcatacagatattgacagcagatttattcataattgacaaatctgggaagcaaccaaggtgtccttcagtcgatgaatggataaataaactggtacttccagacagtgagatattattccatgctaaaaagaaacgtactgtcaagccatgggaagacatagaggaaccttaagtgcatattaccagtgaaagatgccaatctgaaaagactacatactgtgtggtttcagctatatgatattctagaaaaggcaaaactctggacacagtaaaaagatccatgattgtcaggggtttggggaggaaaggatgagtatgtggagcactgagggttttcaggaccatgaaactcttttgtataatactgcagaggtggataaatgttatacatttgtccaaacccataggaagtacagcaccaggagtgaacctcatgtaaactgaggactttgggtgatgatgtgtcaatgtacattttgcatttataacaaatgtaccactcttgtgaggaacactgatagtgggggaggctgtgcatgtatgggggagaggggagaggggagctctctgtactctgctcaattttgccgtgaaattaaactgtctttaaaaataatctctattgaaaaatgaaaaattctaaaagttttgacacaactgactttagataatagtaaggatgcattgattttcattaacatttcaactgcaccttaaagatgcgtgagattttgtaaggaaacatggccgaaggacttttggcaaagacactgcatgaacaaaagtggggaaggaggagagtgagggcagcattcagaagacaacttggtgttcagtttatctgtaatcttgggaacagctgcggtttcaaataattcattgtattattcctggacaccatttcagaaatcatagcattttggcatccaaattctaccttctgaagggtctttcaaagctagaagagaataaaaattctttacccattcgtagaacttggttctgaatatatgatgacctcagccacagagcagtaattctcaagattaattgtgcctaagaattgtcaagggaaagggttacttatggaaaatgcagaaaccaccaccacctcgaatccagtaggtctgaaatgaaacctgcaatctgcatttttcacgagcaactcagctaacttggatccaggtggaccagggaccacattttcagaagtcaaaccatagaggtagatgcaagaggctagaagagaggtcccacattccaaagccaataagaagcaacaggtgacatgaacgagagaaatgaggggtgggaaacactgatcttagcttttcactttcatacttaggagaattatgcactccacaaagaaatacactctttctcttacttttagaaaaacacagccctttcccacttttgatagagacatgggacagaaatatttccctatatgcaacagacatttatgtgtaatgacaaatagcaactgaagggaaggagtggaggcccagggtgtcctcattcttcactttagcaagggaagtttaggatgcatcttttacgttgatctcccaatctgtaaatgttgtcttagattcttttcaagcactctgtgagccaaaaaaaaaaaaaaaatgtgtgtgtgtgtgtgtgtccacaccctgctcacaagccaccagttgtgacctttgaacgaaaccctagctgggaaggttggtttggactagatcacagggtttcagcctgagttctgagaaatgtgcggaggttgcaaagcatcgggggcttcagtagaagataaagaagaatctcaatcctcccccatccccatacacacacactcaccccatctcactcttcaacatgaccatctctgcttttattatgtataggtgttccaaagcatatttcacttgaaaaatagaatgtagccgctagaattcccaaagaatatcctggatgtattagtcagcacagactaaagtctgttgcagtaacaaacaacttcaacatttcagtggtttgaaacaacaaaggtttgtttctcacgcgtaaggcctgtccaatagggttggcagggagactgatgtgacctcgttctccatcagggtcggcaggtggagcccttccttcaggaagcaggatggtgggagggatggagagttgagtgccagaaattaaaggctctggcctcaagttacacatgtcattgccacccacatttcattggccaaacaaggcatttgacgacatctaactgggttaggacagcacacccttcccacaagctctcagggagaagggagctgaagaccctgtgagcagtgtgaatggctggcacggcggggtcatgtggtgtgttgggaggaggcttgaattccaaaccagagagtgagcttttatttactgaggaataggaattataatgggatcgttgaggagaggagtaacataacaaatgtaataaatacaaacactaattataaaaagctaaatattccatttattaattaatacactctataacatgatactgatttgcagcctgaataaaaatccccttggtgagcagaggtttctatcagctaaattatgaatagtataggttagaaattgattaacaataatttgtcttttttcccacatgtgaatttaaccaatctaataagagctttataaataactaatgaaaaaagccagtctcagtgcttgtgagtcctcccactgtggaaaattagacccatctattgaagaacaaatatcccctcatggaagcaaaggtttcctctctcccgtcatttgatcagatttagaagcataattaccatcatgcaatttgaactaaatatattaaagtatttctttgaagtgaaaataattggaaagcatcaggaacaagcctttctatttgagacaccttgggaggagagttagcctcaacaaaggctgaagcagctacagctactgatccctgctgccgacttcccacccaccttggcaacagaaccaggcagaatcctggtctcatcttgtttgcatttgatgtgaattctgtcaaaaggaagagataattgagctagagttagccttctgaattgaaagggaaaggagcgagaagagcagctgaaaatactttgtggtgcaaagtattcagtctgtaagtgggatatggtgtgtgtgtgtgtgtgtgtgagagagagagagagagagagagagacatgtaagcactgtgcacacacacagacttgagaattgtacccttgactcttttcaatgggaatacagagttttaaaaaggagtaatatctgtctcttatctctcctaatttattcccagttcaagacagaggagcaagaacttttttttctttaaaggataacctttgccagagggtctgttttgaaggaggaatgtctgtgagagctgaatgatgatgtctctctttcttcctgtagtggggacaccctgtcctccactcgcccttacctgggaagttgtcctaaggaggtacaaatcccttccactccttggcagagcttcctgtacttctttacctgacttttcatgttgggagtgaggaagtactgataagtgcccctcctgcaggccactagccagcaatgccgcctggccctggcctgtgggctgacccctgggaacaggctgtggagtcgtagccaggaggaacgggcatgccagcaggtttgtgacgggttttctgccttgatgtatttgctcctagggctgccattataaagtgccacaagccgggtggcgtagaacagcagaaatgtgttgtctcacggttctggaggccagaagtctgaaatcaaggtgcctccaaggtcatgttcctctgaaacccatggggaagaatccctccttgcatcttctggcttctggtgtttgccagcaatccttggcttgtggctgtgtcactccagtctctgctcccatcatctcatggccaccttcttgctgtgtctccctcctcttcttctgaggatgccagccatgtttcagttagagccaacctactttggtatgaccttatgatatggtttggctgtgtccccacccaaatatcccttaaattgtaataatccccacagatcaagggctgggccaggtggagataattgaatcatgggggtggctttccccatactgtccttgtggtagtgaataagtctcacaagatctgatggttttataaaggggaggtcccctgcacatgctctcttgcctgccaccacgtaagacgtgcctttgctcctcattggccttccgccatgattgtgaggcctccccagccatgtggaactgtgagtcagttaaatctctttcctttataaattacccagtgtcgagtatgtctttattagcagcatgagaccagactaatacatcttaccttgactaattacatccacaatgacactatttccaaagaagatctcattccgaggtactgggtgttaggacatcagcatatctttgtaagggatacaactcaacccatgacactcaggccactcgatcctcccagctagccttgcctgtgtgcactgtcattctgatgctctctaacaggaaccaggaaaatctaaagagattctgtattcccatcaaaccgggaagggcaagagcacatcacttacatgttaagcctcttaattacatttattctttgaacaaatgtttggcacttctatgtgctaagcactgtgccaagtgcccagaagatggtcacagcatgcccccatgacacagaggtctagaacgaacaccaacattaaataaccctgtgcacggatgctgagaaaggggaagctcagggtgccatggtagtatggagtgagggctgtaacctagtcttcagaacattagaaaggcctccctgctgaaataaagcttcactgagacctgaaggaagagttgggtctaaccccaccaagagagcacggaattagattctagaaatgatgaaagtaaatgaagatgaccgtgcttgtcatagatgaacaatagttgtgtgaacaaaacaggaacctctttctctcaggacatggtccccatggctggctctgtggtaaggaaacagaagctcccgtctgtggctctgctgtcccttgagcgtgctcaggtggttgaaggtgactggcaccatacctgccttccagcttgcacaaagagagaaggagaagggctgggaacatgccttctttaagggcgtaacccagaaatggcacgcttcactttcgtttacatctcaggtgccagatccagtcacatgggaccctgagtgcaggagaggccaggaaatgtagtctgtacctggcagacacgtgcccagtgaaggcttcttatactgcagacgggaggagaagatacacatcgggaggagaagatacacatcaggaggacaactatgagccatagcatgttgtctgacacgttaacaactaaggattccttccctcccctaggatatgccgggcaatgcagtggccactagccagcgtccttggagcactcaaaatgtgggtagtccaaagggaggtgtgttgcaaatgtaaaatacaaaccagatttcaaagacttaataccatagaagaatataagatatcttattagtaatttttatgctgattacaggatgaaataaattttttgatatattgtggtaaataaaatatattatcaaaatcactttcacctgcttctttttgctttcctaaagtggatattaaaatacaatttatatgtgtggctcgcattttatttccaatgtatagcaccactctagaatcgtttaacagtgtagagggcaagaaagatgtcaacaacagagttcaaggcggagcaagggagaggagtcctagaagactggggaaaggctggggacgaatcctagaagaacttgatgttcgcctggagacttggatcttacaagttcactggaagcacagagttcatcagatgcacctcagccagctggagcatgttcctgaaacctctccagcccatttctttgcccgtaagatgggaatacatgtgcttattgcagaccgttttcatactgattaaatcagttaatgtgtgtaaagctctcacacagtatcagcacattaaaatcttcagttttgttactgaatgaaggaaccagtcgatgaagaaactagaaattcagttcaatccagtgcctccttgcacaaacagatttgaaatctttggatagttttgaaggaaaaagcatcattgatcattaaacttcatagaaatagtttcttgaatgcagaatgtaagtaacacaaggtctccactctccttaagattcagtcccttgttccacaggcatgaaaaggaccagtcaggcttctcagctgacgtggacacctgataacatggtgatggagaacatttttgttgaggctttgaagtagtcaagtatattgaccttgacctacctggagagcaggtgttggatagagttggggtaagagttgccaagacatcacaaagtcctgatgatacggtattttcattgcactgagtaacccagtgggcatttgctatttatttatttattttttattttttaaaagctgccaaataattatgaaagtttgaaatgttctattaaatatggtataaaactaagtataggctgtgtctgcaagcacccactaaatcatacagtgctgtcaaaaattatttttcagtttctgtctccatggtaggaagaaagcatttgtttagtttagtgggtggacccgttaacattgctggaaacggctgatcgagcgtccctgccttcccggctcttgtcttgtctgtgcggagatagccctgtgttctgccttctggctgtcacttctttagtcacttacagatggcattttgaaggaatgctaattgagggacttcactgttcacttctaactaatcattctgacagaaaacatctcctctgcaaaggaagaggaggaacccaagagaagaagcttttgcttctctgtgctaatgcacgtcgttctgtttcaccctaagatgctctatgcggaatcaactcaaagaagagcagtgactgaggtgttgccagcgtccctccctcatcggccctttctgcatctgctcttcgtgtaatctgtgcccttctttgttcattgccacatattcaggcgactctgtgctgcaacccccgttagtccttccgttcgtccatctatccatcagttcatcaactggataaacactgaccgagtaccttccattagcagaggcagtagagtgtgatggtaaagaacacaagctctggaaccagactttctgagttcaaatctcagccctggcacttattagatgtgtgatgttggccaagtcatttaaaccccagtgagtgccagtgtcctcatgggtcaaatggaataatgatagtgtcaaaattattgagcagttttgatggttaagtgaattattaaatataatgggcttaaaatacttctttaaacaagagaacattcaataaagattgtctactttaattattacatgtgtgccagacactttgtgggagatggaaatatgaataggctatgatcctcccctttggcatcttaagtcctcttataatatgaccaagaagacatttcagataggtcaccttgcaataagtacaatttgaagctactttattatttttatctttggtggcatttaactagaatttaacggttatgttttataactatgtatatatgcatgaatacatttttataaaaattaagactatattaaaaatggtctgtacagcctgctatattataaaatcataaaacatgatagggcccttagaggtcagctggtctaacatgacacccagtgtgagaatcttcccacaatcaccagcctctactcagatccactgggaacagcacgttcatcaatgcatgccattttggctgcagagattactactgagttttttcttttgtgaaattatattctttctctcaccagtacccacttctctgtcacagtttcactttccatgctagcaagaagcatgtataatccttgttttagatggcaacttcaaacatttaaaggtccttcacccaccgtattttcaaaacagtgacttgccaaggttctttctacctaatataataaggccctcctaatatgtggtgtctagaacaaagtacaaaatttcaactatcttatgattagagatggaatttagcagttctggtcttcagcccaaaacagcattagctgaccatcaactaaaacccccaggaacttttcacgttgactgcttccaagctgggtctcctcccaggagttcttaatgcacctcatttttgaacataaaagaaacttttacttttaccccttatcaatttcaactgtcaccataatcttggtcttgtccaagaccataggccataatcttggtcttgtcctaccaggagacccaccccgggcctgtgccatccatctgacaagaatagcttctacatctttaaatcattggcaaagttactgaggagagtagcatcaaggatgaagcaatactcaacctcatcattataataattaacattgatttaggtcttaaagtgctttcacttatagagtgatatttaatttggttctcaacaacgagatggatgacagctaacatgtactgagcatttacttgatggcagttcttatatgtcttatgagttttaccttacttaattctcccaacaatcctatgaggaaggtaatgttttgacccttgtttagaaaggataaaaaacaaggttaaagaagttaagtcataggccgggcacggtggctcatgcctgtaatcccagcattttgggaggccgagatgggtggatcacctgaggtcaggagttcgagaccagcctggccaacatggtgaaaccccatctctactaaaaaatacaaaaattagtcaggcatggtggcaggcacctgtaatcccagctactcaggaggctcaggcaggagaattgcttgaacctgggaggcagaggttccagtgagccaagatcgcgccattgcactccagcccgggtgacagagaaagacttcatctcaaaaaaaaaaggaagttaagtcactttcccgtacaaagttccaggagcaaatgaaatggctgggatttgaacttctctacatgccactctgaaatgtgtgtctttacctaataccccagcactgaaaggtgcagagagtggatttgcccaaatcacaagctttgtaagttgtttctccaagattccaactcacattatactcttagactccctctccctttggactaacaagaacaacccaacaaacgatgttcagccaggtgcagtagagcatcctgaaacaaaccccatcaacgccctctcacgctccctgtgtggttcacagagcaatcgagaaagccttggggaaatgaatgagtacgatccttcttccttcaggcatcaccctgcccatcagcccagccacctacccaactgtccatacgaagttttctaagagaaccaaatcatttcaaaagatcttgaagtcatctgatatataactgaaagtgctcgactctaaagaaatctgaacacaggcaatggtatctgtaatagttcatcctcgcactgctataaagaaataccggagactgggtgatttataaagaaaagatgtttaattggctcatggtttcacaggctggatggaagcatgatgctggcacctgcttggcttctggagaggccacaggaaactttcaatcacagcagaaggcaaaaggggagcaggcatctcatatggcgggagcagggggaagagagagagggaggagagataccacacttttaaacaaccagatctcacgataactcactcatgatcacgagaacagcaccgatgggatggtgctcacacaagcatgagaaccccacccccacgatccagtcaacactggggattacaatttgacatgagatttggtggggacacacagccaaaccctctctgtatctatgaaaagtagagagatctggccgtgcacagtggctcacacctgtaatcccagcactttgggatgccaaggtgggaggatcacctgaggtcaggagtttgagaccagcctggccaacatgaagaaaccccatctctactaaaaatacaaaaattagctgagcgtggtggtgcctgcctgtaagctcagctacttgggaggctgagacaggagaatcgcttgaacccaggaggcagatgttgcagtgagctgagattgagatcatgccactgcactccagcctgggcaacagagtgagactctgtctcaaaaaaaaaaaaaaaaaaggaaagaaagaaagagagagagagagggagagagagagagagagagaaagcaagcaagcaagcaagcaagaaagaaaagtagagagatttacgtagattagagggacagaccaccgccatggcacttttgtgctgggagcgagcatgccaaagatggctctccacacctgggtaagagttcaaagcctttgtgaccagggatactccttggccttatgtttgtcagctcctcttttcttcttcaacttgactagaggaggaaaatgcttacgtcattgtattgtaattgctggtctaggtcctcctggtaagacattaagttggaatatcctaacagctaccttctttatggggcttgatgccactgcaggaacagatgggcaaggagaacccaggagttactgtggaaattggatgcccagcttaaagtaattgggagcagtatggcaggagccatcggaactcaaatgaatccagaagttggtgttagcataatcagcaacaagccaagaactggggagttcctgcagagcctggaggaaagcctttgtataacagcttggtttttaacagcattcctttcccttgaaaacaatgtcatccttcacctaataaatcaggtctcaacaattcaaggaagaaatataccataagtgttgtagtaatgacaatctaggaattcctgcataaataattcatgtattagatccctagtaggttaaaaaaaaaagttccaagtatagcaaaaaaaaattattacatacatcatttttaaatatagaaatttgtttttgttttgggtttgttgttgttgtttttgagatggagttttgctctttcgcccaggctggagtgaagtggcgccatcttggctcactgcaacctctgccctccggagttcaagtgattctcctgcctcgcctcctgagtagctgggactgcaggtgtgtgctaccatgcctggctaatttttgtatttttagtagagacagggtttcaccatgttggccagactggtcttgaactcctgaactcaggtgatccacctacctcggcctcccaaagtgctggggttgcaggcatgagccactgtgcccggccagaaatttgtatttttatgattatattgcccatgtttttttttttccagtatgaatgtaatcacttaactgacaaggcaactaaaatacaaaatgtataaataaaacaatttctattaagaaaaggaaggaagggagggataggaagaaggagagtgaattatgtcttagaaatcagtatgccaaaactggttttgatttttgagactctttttaaaaagtattgtgagaattctgaaaactcttagcccccttttctttcatgtttttcttctagtcgcctcgttcctgagaaatgtcatcacagtaggttatcagccaatggtaaatcgtgacctcttcatctccaagggtctgtgttctattttccattgccttaattcctcttcatcattcaatgtgtcagccatccttttcctggttaatgtactgttttctttcatggtcccctagtctcttagtagtcaagattcactgtcaaaaattccttgttatgccaggtgtggtggcttacgcctgtaatcccaacacttcaggaggccaaggtgggaggatcacttgaggccgagttcaagaccagcctgggcaacatagtgagaccccacctctacaaaaaattttaaaaattagccaggtgtggtggtgcatgcctttagtcccacctactcaggaggctgaggcaggaagatcacttgagcccaggaattcatgcagtgagctatgatggcaccaccacacttcagcctacgtggcagaggaagaccctatctctaaaaaaattaattaaaatataataaattcagatgtccttctcggtctctgttatcttctctgctcctctgtgaacattacttaaattccattataatttatactaacagtttaagcagctccactccggagaataaaatttggagttcttctcacactacaaagacctatgtgacctggccttctgtcctcggcccgatcactttccccttgttgacaatgctccagtaccctggcccttcatggtgttctctaaatgaagcagacttgtcctcttcctagggccatgactctcccttcctggaggaccttccttcagctttttgcatggctgcctccattcatttagccctctaaacaggtgtcccctcccaggagaggcctgcttagaccatgccttccccaaccactgcacgatctcaccctgtaagccagccctgctttcttcatcacttaccactaactggaattacattattcaattgccttgcttattttctgcctttcccctctctccaccccatttcatgggagaatctcattggttttagtcatagaagttttgtaggtattcagtaaatatgtgtttaatgacgggagggaagaaaaagaggaaggaaggtagggggaggtgggaagggagggaggcaaggagcagggcaggaaattccattcattcattcactgaacattaatgggaaattcctagtgccagacttcatgctggaggcagggtatgcccaaagcaatgagcatggtgcctctctattcgcgagcctccataggcgcttttttctgaatgaatggaaaagaaggcacaacccctacctcctacatgaatacacatattatcatatcagtagtcaatatttaatattattcaactaatttctccttgtagttgtttgcaagtctaaaatagatcttagtttacctaagcgaccatcaaaatgtgaataagatggtctacaaaatggtgaaggcttagaacatgggctaaaatcctttttctggcttttcaagctttacccaaactaacctttccaaacccatctcattaccttcccaacacacactcttagttctagaaaattcctttgccatcccacaggccccagactgtcttccttgccttggctcacacagatgggcgaaggggcagtataggaaggagacagtagtgtgatctgaaccaggcaagtgctgggagtcccagccccttcactgagcagttgttactgagcaagcccacttcatgggtctatgcctcaatgtcttctcctgtaaaaagggttgagggataggacttcactcagaattgcttttggattaaacatgatccatatacagtcctgggcacagtgtttatcaggcaatggttcataagcattagtcattcttacctcatcgcccctcaaccaggacacccatctttccccgtctcactccgtggcacctattcactaaactcacttgcccctaacctccatgaagacgagctacacctcccctaaactcttactcagacactgatgtgcattgttactaatatgagctctccttaattaaactgtgagcttcctgaggggaaaaatcaggtcctgctagcacaaagcaagttcttgaaaaatccttgattaaagagtgtatgatagagctaaaaaattggaatgcacaattcattctgctctggtgctttaaattaatattaaatatgtctgtaacatataaatcctagactttcacatttaatcaaagtcttaatcataatgagcagcatttatgaaagggcaattaacagattcccaaaagaactggaaatagtaaattgctaatagcatccctaaggttttgctttttgctctgataaattaagtaatttaataatagaggcagtgtgaaccaaaaagaacgcaggcttaaaaggcagaggacctgcattctgatccttgctctgccagcctgtgactcagcaccagtgacttatctgctccgagcctctgttaactcacctcttatgtgagaagctgtattcataccactgcttgtcagaacacgttcctaaaatccttatggttctatgcatgaaatctgacttcaaatttcatttttaaatatatcatagactatttagaaacaaaaacaacatatacatactcttagcagaaactgaaaattcattattttgtgcagccttgagctaaagtttctgtttaataaagtgaattacaaaattgtaaaatgaggtgtttaaaaaaaaacacataactgtttgccacacttatctgggtatatcagtgtttgcttgatctaggcaacgtaatgaaatatagaaagaacgaaataatacatgattacatgtgtctttcaaaaaactaaatttcaaaagtttgtgttcaccaaaaataagcttaatttattaaaaataaatagtttatctatttctaaaaaatgggtttctggacaatattttctttgctaaaaagtaaacatctcttctacataatcttaagggaccttagaactttcacagtccataaaattatagtcttaaagcctaatagaatcttacagtttaagataaataaacttatatgtttaaaattctcattagattcatcagtgtttccatctttaactgattttcctatactttaagagctaaaataattccatgaaatttcaatataaagcaatatatatataatatataaagccttatatattattgttctaagtctccagattatcccagttcagtctaaaatattctgtttttctcaggatacctctctctacttgaattttcttcattctctcaagtgaatctgtccaaaaaaattttgatttctaactaattcatcacaagtagaagcttctctcttatacatattgcatctaaattttagaaacatcttcgtattcctctaaactttgaccccctcctatataaattagagtggtttgggaggggatgaaaactagcctatggactttaaaataaatatagtttactatggtaatattttcatttctaactccagttgttaccattgattagaaaatcagccctgtctgagtgttcacattgtccattatagaacacaggcaagagcaaggtgaattaggaagagggaaacaggacacaggttttatttcaaaagagccaatggggacattacaggaatcatttgatggagatgcctattcagttttttatcacaccacacactagtataaccaggaaatgcaaggcactctctgcctactctgcctagcctaccaaattaaatctaatttatttcataaaaagacctaaggcatatagtcatctgaatgactggctcggtacacaatgaattccccagaatattaataggtttgttatagcctgaatgttgatttactgaaagtgtcattccagcctatgcatattgattctcaaaagctaatatgtgaccaaaatgcttggtctgtcaaagctgtcacatgagctgatctgactggttcctttgccactgatgctagtccgacctgatttttgcctcaaagaagcagggggaagccggcggcagcaaaggcaggtggttaggagcagacacctttgaggggcaggtggttaggagcagacacctttgagaggcaggtggttaggagcagacacctttgagtcagagcagtggtgctcagttgccagcgattttgtccccaggggatatttggtcatgtctggagatagttttggtcatcacaacagggggatgcttctagcatctagcgggtagaggcagggatggtgccaaacaccatgcagtgcccacaacgggcccgtgagaatggcctggtctcaaacttcagtagtgctgagattgaacaccctgagtcagactccctgcgtttagttctgatgccgtccgtacccacagcttgctttgggaaaccttcctaagcttcccaagtgtcaactgtctcatctttaaaaagagtgaatcccatgtcctatttcacagggcaaagatggttgtaaaaatgaaactaatcgatgcttactaagcacttgggacgctccctaacacgtaacgtacccagtgcatcttagttattgttagtaaaggaaataatgatacaaatagcagcaacaagaaaggctttcttcaggctggatggcccatctagaggtttccagtgcgtctcagcattccaagaggactttggttcaaaagccagttataggagttcagaaaatggccatgtgcaaaacccagaaattttctttaagctgaaaccctgccaggcagggtcttttttaaaaattttcttcaacttttcattttaagttcaggggtacatgtgcaggatgtgcaggtttgttatataggtaaacgtgtgccatggtgttttgctgcacagatcaacccatcacctaggtattaagcccagcatccattaggtattcttcctgatgctctccctccccacaaccccccagcaggccccagtgtgtgttgttcccccatgtgtccatgtgtgctcatcattcagctcccacttataagtgagaacaggcagtgtttggttttctgttcctgcattagtttgctgaggataacggtttccagcttcatccatgtccctgcaaaggatatggtcttgttcctttttatggttgcatagtattccatgatatatatggaccacattttctttatccagtctatcaatgatgggcatctgggttgattccaagtctttgctattgtgaacagtgctcctgccaggatctcactatgccactcccatgccttaagaaataagtagaagaggtcacagtgagtaatagcctatttgagctaccaatgtgctctctattggggatgaggggcattaatgtagatgtcacctttagggatgtgacatgtgaggtaaggatagaattgtagcttattgaagtttagtgaattctgtggaggatccatgagtttatacgctgggaattaatgcaagtccatattctatgagctatgacccctttcctgaccttatagatgaggcctgaaagttcatgaaggcaagcatcctggggctaattagcacttacgcatgacaagcctttcaaccacgctcaatctttatcatggattttcagggggaagccgacatggagcactgtgaaacatttttataactattaaccagtgctttggagttggcctgaaatacaaagccaattcagtcaattaatgcatagctatgaaaatagttatctctatttcacctaactctaagcatctctggcgaagtctcattaacaatgcatgtttttttttttttttgaaacacaattgttagttgtcacgagccggaaagaacatttatctgcagaacacatagagagaaattgctgagaagtcccttgcatcttctccctagcatacttttacaaaaccaaattcactctcaaacttaaaaagaagccgagggagaaggaagaattctgtactgccagacttcgtgattaaatttagtgaagatgctgagaatgtctgtggaaattctcaaaaagctatgaaacattaaatatgccacagttactaaagtctaagctaaaatacttaaagtgcttatgaaagtcatattgtaagtctattataagatggccttttgtttataccaaaaagttggcaagtcctctaggaaaccttgtaaaattaattaaccttgtgcagaaaaacagaaccaaaacatggcaaattgggtcttaaccgtgctgcccctggtgaaaaagcctactcatgatgcttgaaaaagctactgaannnnnnnnnnnnnnnnnnnnttttcctgcttttttattcaggattcaaggggaacccacagaagcctgtgaaacatttacaacaataaccagggttgggagtggcccgaaaacaaaaccaatcaggcaattaaggcaaggctataaaaaagtttctccatttccccaactctaagcatctcggggaagtctcattaccaatgcatgtttttttttttttttgaaacacaattgttagttgtcacgagccggaaagaacatttatctgcagaacacatagagagaaattgctgagaagtcccttgcatcttctccctagcatacttttacaaaaccaaattcactctcaaacttaaaaagaagccgagggagaaggaagaattctgtactgccagacttcgtgattaaatttagtgaagatgctgagaatgtctgtggaaattctcaaaaagctatgaaacattaaatatgccacagttactaaagtctaagctaaaatacttaaagtgcttatgaaagtcatattgtaagtctattataagatggccttttgttttaataccaaaaagttgtgcaagtcctctaggaaacccttgtaaaaattcaattaacctttgtgcagaaaaaaacaagacccagaaacaatgccagaattggggtcattaaccacgtgctggcctcatggtggagaacagccacgtactcagttgaatgctctgaaagtcaggctagcttgcagggaattagccgtaacatagaaagcattcttcatgcttccctgcccagctaatgtgcattgtactttgttcccattttgttttctaaaacattccaaattatgtagagaaagtatgtatttaaaagccagttctcaaactaactagctaatctatggcggctttctcccttaaagaacttagtcatattatttcatgcatctcttcatattcatattgatgacaatgttttcttgacctaagagtagggacaaggacaactttttatataagcttcctgagggagattgttttgatcctaacagaacctaacactgcacgctggcatgctgacaaatattcttcacacagtcaataggtcatgagaacctggttagtaaatgtttgccacacagttcctaaagcattaatattggagccataaaactttaaatgtatcatttgttgtgaaatctacttgagtaacatgctttaaattattcttgtttttatgttatctatttgaatatacagttttcaaaaattgataaattttgttaacaattttacttgagattgtttctttgaaagccacctacatttttcattttaagtgactgctgaattcatcattgatacagtatgatgttgttgcagtctcccccaccccccgcaaaatgaacatatttatggaccagtgtggcactaatgttctaaagtgactccaacaaactcaatccttgtttcttttggcttcccccctccctcccttccttccttctttacttcctttcttccttccttctttgaaaaattgcccaaactaagtttatatgaagagaagaaaatgacagaggaattgtgccaattcactaatgtgttctagggcacaatcagtaagaacaataataaagtgctcaaacagagtgataggatttcatcttgaaactcaggatttaatgacagctgccttttaaaattaccagattcactacctaccctctttgtgcggcaaaggttctttttttccttgtttgtttttgtttttttgtttgtttgttttgtttttttgttttttgagatggagtcttgctctgtcgccaggttctagtgcagtggtgcgacctcagctcactgcaacctccacctcccaggttcaaacaatcctcctgcctcagcctccggagtagctgggactacaggcacacgccaccatgcccagctaattttttgtatttttagtagagatggggtttcaccatgttggccaggatggtctcaatctcttgacctcatcatccgcctgcctctgcctcccaaagttctgggattacaggagtgagccaccgcgcccagccaaaggttctttttattacttttcctgatgccttctgccccctgtactgggtacagaggtaggatatgttgggtgggagagttgataggaattctttaggaaaaaccaatgtgattttaattggtagagccctttctaaaaaaatcttgatacggtttgaatagcttttaaggaatatgtagaaaacagttctatggtggcgtgtaatattttcagttcaaaacactgcccttgactggaatatgccaatgttctttgtggcatctgaagtcaggggcagtgcctgcccacttccacgtgctgctgcctggagcccgcgtctcgtgcttccctcaggaaccccctcttcgtggctgtgaagcgcttttctccttgcccggttaccatggagaaagctgcaccatcagctttcctttccagttaccaatgggttgttagcacactgcttatgaaaatggtttctctaatgctaattagttatagcaatgaaattaaaagcggtgcctgcttttctttattgatactttcagcatgtgctgaggcaggtatttcagataaggcctgaaattactaattatactttctggcaagagaaaacattcacttagcatgtaatgggttagacgttaactctttcttaccttccattgaaggttccagttaggtgatttcctacaaaggagacgatatttcctgagtcttgtctgcttcctgtaatagtgtacttggctccttgtgccccaaagcccagaaccaggaatgcacaaaagacccatcatcgcagtgttattaataccaatggaatcaaactctcgcttctggcattttgtgagtctgctattttaagcaagctgtttaagctctcaattttctcatatgtgaaataagagaattaagattcttttccaggattgttgtgatggtggaataggaaaatagggccagcttggagtgtgcgacctgtacagtcacacagggccccatactcacagggccccatactcacagggccccatactcacagggccccccagagtttgaggctctactgctaatatcttgaaatgctaaatcatttttgaagaaggggctctgtgtctttgttttgcactgggcttcacaaattatatagtcatgatcagataggaaacgctgcagtgataataaatactccaaaatctcagtggcttcacccaacaaaagttcatttctcgctcatgctatggcctgcacacggctgaaggctgccctcctcatcaaggccgaggctgacagaggctcaccttcacctgggcttccatgatcccgcaccagagggaagggagcaaggaattgtgtgctggcccttaaagctctcacctggatgacacttgtcactggtgctcacaactctttgtctagagcaaatcgtgtggcctggtctaacttcaaaggagatgggaagtgcatttccaccttgcacctggaaagcagaggctagggaagttggagaccagccccacactgtcacaatacagggagggggtgccccagtgaccccggctttgtgcaagccacccttcagagggctacattgtaagattccagttttctcctaaaacaaagccaagccaaattgctcaaaagtaaaatcacttaccttttaaaagaagcccttaattttcttattttccaagaagttcaagattcccttgactgtcgtcttccccggggacagagcatatgctcagaaagttaatgttgcagcgtcaggattaaatcctttccagccaaactgagacactgaaaccagcattgctggttccctcattacacttcctcaagatggaagtggcattgctgcttgcgttctgattatacaatataaatgtattattataacacattcaagcaaaatgaaaaagtagaaagttaacataaaaagcaaaaaccagtaagatcaggaatctcactacttattattacttatctttctaggcattttaggatacatacccacacttgaaactttttaaactattagtattattatacatgtgaatgcgtagatagtgttttatggactgctctattatgggcatgtacgtactaaatatagtgataatgatgctatttttcaaatgtcatcattgtgcgaagtaatcacctaccacacagcaatcatacggcatacagaacgatttagttccctgtcctcaggcctcagttacaggttctagaggcagccacttagcgttgttattccagaaattttctgcacatctataagcaaatatatcttttttctttcatccaaattgttacactctatgtataaattgttttcattgttctatagtatttcattttatgaaatatcattatttgtttaatgaattacatatttatatgatgactatagctgcatcattgcattagtatatccacataaaacttatttacttgtttatttgatacatcatttttgttttgtttttgccacaaagtctcactctgtcactcaggctgggagtacagtggcgcaatcagagctcactgaagcctcaacctccgaggctcacgtgatcgtcccacctcagcctcctgagtagctgggactacagcacccgccagcaggctaggctaatttattgtatttttttctaaagacaaggctttgccatgttgcccaggctggcctcaaacccctggactcacatgatccacccacctcagcctcccaaagtggtgggattacaggtgtgagccactgcacctggctggccacatcattcagaattttttgaagaagccagataacagctattattttgggagttaaatgaaataatcctttggaaagtattctgtagatcaactatcacatgtgtaactatactgatggtaaacagtaattatttgaccatatgtcctatctacttgtgttattttattaataagtgcaataatataattctgcatctacaatgtgtaaatctcacattcccgtggaaatcatactgtaaagagaggcataatacatgtgaaaaagagacacataattgtggaactatagcatgagaagtggtgggagccacattactcagtttgcccgaggcaagctgctttatgcccattgttcaggagtagctgctactatgttccctttcactctcaaatttgttcagttgaacaataaatcatattgtcatttgatttatgagtaaatcaaccaggccccaaatcttgaaagagacatccttaatctgcctgtgtatattgtcattttattgtcctcagaatagctaaaatggaacacattgcaactgctccttgttaaattagttcactgtgatacagctcaggtacaacagttcatttgcactttacacaaatctgttgatttaaagccacttttcatgccgctctttcctgcttcggagactggtcgccatcttgtccctctctattccatcctgccaggctgattatcttcccctccagataatactgggaagcaaggaaggcctgcatgagccgtcttcaatatatttgctaccattatcaggatagttacatttgtaatgcttatgcattctaataacatgatgtatctatttaattttcctaatttcccatttgtgatacagaaaactaaaaattatttctaaaaagtattctgaaaacaacttatcctttcacacttccaatgattatccaccaaacaaagttaattttcttctatgctgcaactgaattaagaaaggccatcttcatcaccttgattcattaaccttatcctaaggaaaagtaccagtattttttttttttttttttgagatggagtttcactcttgttgctggagtgcaatggtgtgatctcggctcaccacaacctctgcctcctgagttcaagcgattctcctgcctcagcctccgagtagctgggattacaggcatgcgccaccacgcctggctaattttgtatttttagtagagacggggtttctccgtgttggtcaggctggtctcaaactcccgacctcaggtgatccgcctgcctgggcctcccaaagtgctgggattacaggcgtgagccaccgcgcctggccaagtcccattatttttttccatcaccaatacaagctgctgatcgcctgcaagaagagtcacttcatgtttttaatacttttaaagccaaatgtcttttcaaaatgctgggtaggaaactacacaggaacagcattctctgataattaaccacactggtgagttaagtgctgttggcttttcctcaggatacctcactctccaacatcatccaagttaattagctgacatcatgcgcacttccgtgcctgccttactgcctcattagaactgcatgcactggtttgtgtccaagccatttcacctcagctcgcccaccagtttttctgttagcagctcctgtatgctggctctcggtttccattgccttccttttcatgctggataacgtcttcacagaggatgcgagacagcaaagcacagtctcatttcgttgtaatgacggaatgtcccagtcagagccaaagagtgtagaaattccacactaattccagcacatctccagtgttctcagaaatcgatcactgtgtgactaaaccgccagtgtcaaagaaacaaatcggtgggtcttctgcctcccggctgccctgacttcctgacaactgttcttttcctgggagccatttttaatggcctttttaatcaccatcatcaacagtggggaactctcaataacatcttaagctttaaaatgtttttgaaagtgagttggagacgcataaatatttagattttctcaaggaaaagtgtcttaagtgtctgagttctaaatttgagccaagttttctttgaaaatgtatcccaattacagttgtaaatagtaatcccacaaacaaaagcttcggggggaagttactaaaaacagttgaattccctaaatgttgatttccccacacatcagaagcagcagctttttttaggatgtaattattttcctgatatacattctcacactcctgggaaagagttttagccattttgtactagagatccatttggcagtttgatgaacagtttggacactatcttgaataatttttttttttttcctgagacagagtctcactctgtcgcccaggttggagtacagtggcgcgatctcggctcactgcaagctccgcctcccgggtccacaccattctccggcctcagcctcctgagtagctgggactacaggcgcccgccaccacgcccggctaatttttttgtatttttagtagagacaggctttcaccgtgttaaccaggatggtctccatctcctgacctcgtgatccgcccaccttggcctcccaaaatgctgggattacaggcgtgagccaccgcgaccagcctatcttgaataatatttttaaatatataaaatatataagattgaaaggaaaatgcagttatcagagtaataaaaagaaattcatggtttttaatatgtgtttctttatgaatgaattaaataacaagtcaggccaggaacagtggcccttgcctgtaatcccagcactttgggagaccgaggcgagcagattccttgagctcaggagttcaagaccagcctcggcaacatggcaaaaccctgtctctacaaaaaatacaaaaatgcctcagctacccaaaaggctgaggtgggaggatcacttgagcccaggaggtcaagactgcggcaagttgtattgcaccgcggcactccagcctgggccacagagcgagacctcgtctcaaaaatatatgtaaataaaaataacaagtcaataccgtgcatttaaaatatagcaagttaaagtaaaactttattgtttaaagaaataccagtgcaaagaacatttttgctgagtttacctgggaacaataaaccatgcatgagaatgagtaccctccttcctcgtgatgaccaaaaacaaatcgcaaatgggaatactggaaagcaacgtgaatgtctgggtcaccagtgtgggaagaggtgactgcattcccccaagttggcagctccatcacaccagttgataggacagcagcgatcacatgcaatctactataagtataggtaatagtgggtcaggcatggtggcttatgcctgcaatcccagcgctttgagaggcaggcagatcatgaggtcaagagatcgagaccatcctggccaacatggtgaaaccctgtctctactaaaaattagctgggcatggtggtgcatgcctgtagtcccagctacttgggaggctgaggcaggagaatcacttgaacccaggaggcggaggttgcagtgagccgagattgcgccactgcactccagtctggtgacagagagacttcatctcaaaaaataaaaataagtaatagtgggccgggcgtggtggctcacacctgtaatctcagcactttgggagtctgaggcaggtggattacgaggtcaggagatcgagaccatcctggccaacatggtgaaacccagtatctactaaaaattaaaaccaaaaaaaagttagccaggcatgatggcgagtgcctgtagtcccagctactcgggaggctgaggcaggagaatggcgtgaacccacgaggcggagcttgcagtgagccgagatcacaccactgcactccagcctgggcaacagagcgagactccattgccgaaaaaaaaaaaaagtaatggtgaacatagttggtatttcaaggtgtctacagctgctctaaaatcatacgaagatatctgtgattctcatctatgactaagtcacagataccactaacactactgatattcatacctatgtttataactgaaggaaacaccaaacttcaggtagggattagtgatattaaatatataattaattcccatccaagttcacaagctccacggactcctgttaccagtctcaatcttataggaaacaagaggcttggtctatggttggagcaggaaagacaagatgaaggagaataactatggggtagccaacaaggtaagagttatgaagagccattacacaccaggccctgtgctgggcacttccgtggagtagccaattcattcctcacatgactgcaccatttacttgtacatggtactagtaaacagtggcgccataatacaaatccatgccaccacaggagaggtggagtgacttactggtaagtttggaaagagtaaactgatcatgctccacgcccatttttttcttggtagcagatgctctgcagagaacttatattctgctctgtttttcgaggaagtctggctctgcctaagcttgggtggatagatttccacaagcataaaatttgatattagaaaacccgctagtctacatacacaagtcatgccctccatcctagcgatcttgtatataaaaatgccactccacctgctctcctttcttatttacttatttttctattatatatagttaaggtgtacaacatattttgatatatttatacatagtgaagtggttactatactcaagcaaattaacatacttatcatcttcatggttacttttttcatacgtatacagtaatagcacctaaaatctacttttttgcaaattttcattatacaatattataattatagtcctctagtacatttctagaatatttgtcctacctgtaactttgtatgctttgacccatatctccccattttctgccacaattccccccaccacttccggtaaccaccattttattctgtctctatatatttgacattttttttttaagattccacatgtaagtaagatcatgcagtactttttcctgtgtctggctcagttcacttagcataatgtcctccaggttaatacatgttgccaaaaatagtagaatctcctttttaaggcttgataatattccattttatatatatatatgtatataaataaatttatggatatataggtatctatatatataatgctcccctctccctaatatatatgtatataatatattccacaatttctttatccattcatcctttgatgcttacttaggttgtttgcatatcttgctattgtaaataatgccacagtgaacataagaaggcagctctgtgaggtgctaattttacttcttttgagtatatactcagcagagagattgctggatcatatggtgctatagttctatttttttattttttaaggaaccttcgtactgttttccataaaggctgcaacaatttacattcccaccaacagcatgtcagggttcccttttctccaacccgtgctaccgcttgttatgtctttttgataatggccatcctaacaggtataagttgctatctcatggttttcatttgcctgtccctgatggtcagagatgttgattaccttttcgtatgcctgttggccatttttatatcttttttggagaaatgtctattcaggctctttgtccgttttttaatcaggttatttggggttttttgctattgagttgtaggcatttattttacattttggatattaaccacttatcaaatacatggttttcaaatattttcttccaatctgtaagctgccttttgattctgttcgttgcttcctttgctgtgcagaagctttttagtttggtgtagtccagttgtttattttcacttttgttgcctgagctttggtgtggtatccaaaaagttattgccaaggcgatggggtttccctgtgttttctactaggaatgttatgatttcaggtcctatgttaagttctttcatctatgttgagttgatttttgtgtatgatacaagctaagggttcaattcattattttacatgtggatatccagttttcccaataccatttattgaagatattatcctatccagataccattgtgtcttcttggtgcctttgtcaaaaattagttgacccatttttcttttcaagctgagacagggatagtaggtgtcatggattgggtttccttaaactcccaacacgttctgcaagtaagacttgctctcttctaaaggcatccattctattttcaaacagttctgatttttacaacgtttttctttatatctagctaaaatcaacctccctctgttgtcctggggtacttggaagccttagtccttctgtgaagggcttatccttcagtcattaaagcaggccatgaagaagattaccaactctacaaaacaccctggtccaaacatgcatgtgtccttccttcttaacatggtcaaaatactagattaggtttttcaaaaatttttcaaatgagagagaacttcttcttcataggcttcagtatttttttttaatgtctcccaaagttggtattgaaattaaacagattccaggtgaggtcttgccaccacatagcaaaagaaaactatccacaccttcagtttatgctgtatttttctattagtgttaccttagattaatttaatctttcatagatgcatttattgtatgttaattatctttatgacacatgttctgttaagctataactcccacagccaatatagctgttacatatattctagtactgggatttaaactcttctctaaaagtcggttctgtaatcttgttagattacccagtgatgtcagacggtggggggatgtttttgaatcctgattctgtttccgatagaccatccaattcaagagcatatagaaattaggtcatcattctgtcaaggtctattttcaagttgttaatgaaagtgcctaagaggatacattcttcattacccaatccatatttctccatttctttctttttcatgtcttgaagatttgttgttttgatttggtttggtttagtttggtttttcatcctagtctaatgctgacattatactgggaacttattgaatattcataagtttgaattcataaacaaatattttcttattataaagctgcttacgtaggtgtatatctgtaagtgaaataaaacaacatccccataaccccaaaactcagacattgcagactctgctaatgtttggctatatttctttctaggctttttgaaagagcatttttctaatgtacatttttcactctattcattacctggcctttctctgtctctccctctattgagagggagtggttagtccagtcctaacatttgcaggacctgggataagaagacaagtgtgggttcacatggccctcatctcaatgtttaaaaattctaaatcacactagcaagctgttaaataaaatacatgctatcctcttaccttaaggagtacaccttcataaggaccttagaggccagattctaacttagaattctctgacccctcagaattctttaccagaacttagtggaactgggagagtcagcccagaccccttctcttgtctagctctgccctgcctagaaggttctctgcacacacataggcagacacccagcccacaaatctcagattcatccacatcccctacatgtggcagcccttcaggcagccttcgggctcagggtaggcacatcactggaacagtccactctcagaaggacagatgggaggaagctgcctacacaagccctgaatcaagcccaggccatttgggcagggaattctggggctcaggtgcctggggcatagtctgaagggcaagcatgtgctgttgtgggtgcagctttttagctccacagactctttgctccaggaagaggggtgtggccagaggagggccagggcagaaccctctaagacataggacatctcttgagtgggtcaaagggttagactgggagtgcttctcaggtaatccagagtgtcctgctctcaggaagttctgatccgttgagaattactcttgagtgttcataatgggagttccttctacctagaggaaaacctcaggtcttccaccactcccagctccagcagaagagtgatgagcactgggtagagccgttgaagaggggaatgaagatttagatgagtgactacattaaataataccctaatgggcctatgacagcaaaggtagtaatataactaaagcatataatcaaacacaaaaattatgtggcatagactgtacaccattattttagtgtaggttacaaggctcagactgtctaggtttagaccctagccagagttcacttcctagctatgcaattttgagcaaattaacttctctgtggctcactttcctcttctattaaatgggtgttttttaagagtgcctaccttggtgaattgaaggaaactatgtatgttggatgttcagcctagcaatgcccggttcatagtaagcactttgcaagcattagctaatttttaagcggaacaattattattaccactattattaatgctatgctatagcttctatgagaaaatgcaggctagtggtcctctacctctcacagttcagtaatatgtgtattagtttccagtggttgctgtaaaaaattatcacaaatgtcatggctgaaaacaacacagatttattttcttacagctctgtaggtcggaagtcctaaagttaaggtgtcgcagggctgcattccttctggaggctgtgggggagaatcctcttttctcccttttctggcttcttgaggctgcctggattccttggcttgaggtcccttcctccatcttcaaaaccagcaaagtaaccttcaggtttcaatctctctctctttctctttctctctctctttctctctctctctctctctctctctttctcttgttcactggacccacctggatagtccagaattatctccccacctcaagacccttaacctactcatttctgcaaactcccgttgcgatgtattagtctgttctcacactgctatgaagaaatacctgaaactgagtaatttataaagaaaagaggtttaattgactcacagttctgtatggctagggaggcctcaggaaacttacatcatggcggaaggcacctcttcacagggtggcaggagagagaatgggtgcccagtgaagggggaagcctcttataaaaaaagtcagatcttctgagaactcactcactatcacaagaacagcctgggggataccacccccatgattcatttatctccacctggtcccatccttgacatggtggattattacaattcaaggtgacatttggatggggacacagaaccaaaccatgaatgctaccatattcataagttccagggatgagtacacagacatgggggaggtggcagtattgactctttggcagcattttggtggggagtcattaggagatgcatgaaggaattttacttggcctgtagggagcgcccatttgtgtactgctgggttttaaagtaggaggaagttgccttggttgtagtcagcattatcagttaaccaggttggtgttgagtatgtcttatgggaaggactgacaggtgtataggctgacagtgagcatgagggccttcaactgtggccacaaggacaacttcacaaatgaatgaacatacactgtgcatgactttcctgtccttgagaagaacatacccaagtcctctgaggctggatcctcccggcagctgcattagtggtaaatagcagagtaattccccggccatggatgcaaggacaggagatggtaacttagactgtggtgacaccttcacttaaatctgagccttcctgaaatatgagtatttgaaataatagcagacgacattgggcagatttcagtaaaggatgaatgcatttttaagtttctaaacatgttaataagcacatgtcaataaatggggagtgaggcaaaaatggagtcaggctgaagtacccccttgccatttaaaggatactctgtaggatttgacatttattatggttgacttttcaaggctgagtattttcccagacccactgcctcttctctcttcctgtctacacctggcgtagtacactatttcagattgaagattaggtttggctgttttttttttgtttttgttttaaagtatagggtaagaggctgggcatggcggctcatgcctgtaatcctagcacgttgggaggttgaggcgggcggatcacctgaggtcaggagttcaagaccagcctggccaacatggcgaaaccccgtctctactaaaaatacaaaaattagctaggtgtggtggtgcgtgcctataatcccagctactcaggaggctgaggcaggaaaattgcttgaacccggaaggcagaggttgcagtgagctgagatcacaccacttcactccagcctggttgaaagagtgaaactctgtctcaataaaactaaaaataaaaataaagtgtaggctaagggagtgagaaggaatagaattttactctttctcacatgaaaaaaaaaagctggaagtatgcaactgacggacagtgtgggacctccatggtcacaagggagccatggccattcctcctgagaatgtagctccctggaatccccaggaaaccctctactcacagctcactgatcagccctaatgcaagcaaggctggaaaagtagaattttgctgggcacatagttggtgttctgttactgaggaagaagaggaacatgaatattgggcaggcatttgcagcctctgtcgctcctgcacatcctttgagactcctctcaagcgtcatcatctccaggaagccttccctgtatcctccttttaggctcagcacctctcaacctgcattcccatagcaatctgcatgtttctctgttatacaacagtaaagcattgtattaaaattgtatctaggtcttccccattggaccatatgcttacagagaaatgcccatcttactcgtcattacactcttaaatgcccagcacatacaagaacttggtaagtgtgtgctggactgaacttatcagttaataacgtatatactccatagggctagaatcgtgttcgtattatatgtgtctatatcaaattcaccgcacagtgccaggcacacagtccactctcaataatatttactgatgaatgggtgaatgaatgaatgaatgagtgaattatacttaagacagaagggtgtagatggaagaagtctctctcaaaatgccactttcccagtacattgaaaaaaacaactattcgtcagcacaaatggctcccccagcagcaggacactgatgagcagtaatgagagaggctttttaatccagaggcaacagtgagaagaaaatgaaatcagtggcaaacaatcctggtttctgggatgtagaacattctgcagagagaagttggcttgtatataaggacgcgaatctagacaggaacctcttgatgagatttcattcctttgccctgaaaagaatattttatttctgccaccagaaacaaaagaataaaaatccctcattaactaacttcgtgtgactgtcccagaaaggaaaaagcttgtatgcccatctgagaaccatagtcttgccaagagaaccctgagattccactctttttgggctctacttgacagctttgaaataaatctatcaatcacttgtcagaaagcctgtccttgggttgtttgtatgtctgtgtgtctgtgtgtggatgtttgccctagcagtatggctgcatatttatttaaggttaggccctcctgttactttgagtgcagtccttaccagagaggatggcaaatctcagagatgtactggcttatcttttaatatgcaaactgtaccttcatcctaacatccacagtgtctgagttagttgagcaagcagaattgtttaagcttctgcctaaacagatcagagcagatgagtgcaaaaatagaaactagttgactggaggagaaatgataaaactattttctagatttctaccgtaacaaaaagaacaagccaaacagcttacatagtttcagagattttttaacccatcagagagctgagatcaaaaaaaacctaagtgaagaaaattactaaaagtaataagactttcctggaagagaatgttatcagaattgactaaatcattcaacaggttaacagaagactgagcagaagaggtaagtatcaatgatcttgaagagcggtcaatataaactgttcaaatagaaacacagggggatctaatgtacagcatggtgactagagttaataatgttgtattgtgtacttgaaatgtgctaagactaggtcttaagtgtcctccccacacagacacacacacacacacacacaaagataactatgtgtggtgatagaagtgttgattaatttgattgtaattattacatagtgtatacagatatcaagtcattattttgtatgtgttgaatatatgattattatttatcaattatacctaataaagctggagagaaaggaaacacaaagtgaaaaaaagtaataaacatagaccagagtatccaagatctggtgaatatcaaacactgtgtaattggaatccaagaagaaaaagaaagagaatgggccagaagaaatatttgaaaagataatggtgaaaacttttccaaaactgatggaaaacatcaaattaaatacccaaaaagcacagtgaatcttaagcagtagcggtacaaagaaaacaatgtgttaaaacaaattgcagtcaaaatgctgaaaacacaagataaggagataatgttaagagctgccagagggaacctcattgtatggagagcacggtgataagagtgagggctgacttctccatcaaaaacaatggaagccagaaaacaatggaatgatatggaaagaaaaaagtatactaaaattccatgtctagtaaaaaaaaaaaaatccccaaaagaaaggcccccaaaaataacattttcagatgacaaaagctgacagaatccatcagacttgtactgcatgaaatactaaaatcacgtctgcaggttgaaaggatatgaagtgaagcccagatctgtacgaaggaatgaggaacatcagaacgtataaaaatgtaggtcagctccaagatgattttttaaaatcccaatgttaagaagtcatcattattaccaaaagaagcaagccagaaagcatgtcgcctttcaaaaagaactagagcagtaagcaaacactgaggcagaaaggcctaaagcaggtcctgcatgggccagtctcgacggtatgaaagaagactcaccgtctagactgctgtctctgtcgctgcgactttttgcatactccaagctgcaagagtcagtgattgaagggctttctaacctctgcagctcacctggagaggatcgcagcctatcgcttttgttgaccacaaggacctgagctctgcagaagcagttgtcacctccttgaagagctaaggcttccaaggagatattttgtgggtcgaactggctaagcaaaggggagcaagtgacccagcaagcaacaggtggggaagccaaggtggaggaacttgtgtattgcctgatggttttacctgacatttgactaattcgtttcactggggattcataagagaccttaggggcctgtatgtcagaatttgaggtgtgacttactttggagcccttcaaggcattatttaattatttggtaattcatttttctatttgtctgctaatgaacatgagtttacactttctgagaaattaccaataccaagactgtagttacacaaagaagttcaatgatttccttaggctaggtgggcataggatggtgttgactgcagatgggcgtgagaaaacctttttcagaacatggaaaggttataaaatacatcctgattgtagtggtgcatatattgccaaaactcatcaaagtatacaattaaaactgacatatttcatattatataaatgatatatagatgaagtttctttaaaaaagaaaatctgagattcaaagtttccaggaatgaaatgtgacttccataggaattggccaactccatcagttttcccaatccaatccctggcttgagaaagtaccagctgggcatggtggcccacgcctgtaattccagcactttgggaggctgaggtaggcagattacctgaggtcgggagtataagaccagcctgaccaacatggagaaaccctgtctctactaaaaatacaaaattagctggacgtggtggtacatgcctgtaatcccagctactaaggaggctgagacaggagaatctcttgaacccaggaggcggatgttgtggtaagccaagattgcaccattgcactccagcctgggcaacaagagcaaaactctgagccaagatcacaccattgcacttcagcctgggcaacaagagcgaaactccttctcaaaaaaacaaaaacaaaaacaaaaacaaaaaaaaccctaaaggtctctgtatgttgatgtctaccatcctagctctatggagtacagtatcttaaatataagtgaataatactataatattgtgggatagttgcagggcttggatttaggtgcttccaaaatttggatggaaatgttggaaaagtgatcactagataaagattatacttccaaagtggacacttgatctttaccactgtgtatgcagttctgatgttgctttagctggggctgagtttcagccaagtctttccagcttatagtacattgaatttctcattcatgctgaatcaaaactttggcctttacctgtaaagtttcagtccatgggaaccaagaaattggaatactccatatctggatatcaagatggtcaaagaaagcatctggtaggtatagtgtaggttgatgtaaagatccctccaaccttggtagttgatgccctcagaaaagtgctgccagatcccaaatgcatcctgtccaaaatcaaggaggggcaggatgatatggccaatttcaggatttttaatgtcttcttagactcagttgacctctggaaaacatgattcaagagccagttaggcaggatcagtaaggataagccaggtagaaccaaacagtcgtcattctgaaagctgggaaagttttggcatccttggtaacaagggaggaggggtcaggagaggcaccagctgacagtgaagctgacctggcagtcaccttccagaggccgtgctgaatctggatgcctcaggaattctactggtgccccatgccaccttcttcaataatatatcactgaccactccagccagaagggctcacactgaccttggaaccccttggtgctcagtcacccataattctcattaggtagttttttctctatttagtatttatgtaagtatttatctctctgactttcctgttgcttccagtacattgcagtctactatacatagaacttctgacatcttcatgcccctatagcctactgtagtgccttgttaatactaagtgctctaccaaacaaaaaaactgagtgaagaaatcctgaggaaatagaaaatattattggcctcagacctattaagccagtttagaacaaaaaaatcatggattatttaaagtatgccaattttgggatgaaagtgtattctgtgtgtttttattgctaccgttctccagagaaacagggtgatattttccagctacagaatgttttagcagcaattcccaacgaattcagcttatttttcagcaagttaacctctgttaatgacatattaaattttgatttttttaatatgatcaccctggggagacattcaaagtagaccttttaaaataagggtgagctatattgctgatcagacatcatggtgtcatttcacttcagagaatatttttccagaaagacacacattttaatgactggtcaaacatactaaccatcttatctttgctttgggccatataactaatttagctagtcattagcttcaaggtaatggaagagcacgttctacagtattaactgaataccaaatcagctcctaaaatacctctccctgtggtatttcgactgaaaaatgccagcttatgccagcttataaaccacagatagctggaagttcaggtgattcagaataaaagcatgctgtctagataacattgttagatgtaaatgattcaggctcacttttgatctgatctctctagatggactagactttggtcatattggaagacagtagaggctaatattgtgcaaagatgaaaaggatgagacaaagcatgtgtaggtccctaccgtagtgagtccccgctcattgcaggtggcggcatttggcactgttgactgttccctcccctgctagcttgtgggtgcccttctcacccacctttccagccatcttcccccaccattgccatccttcacagcccacattacaagctagtcttccacctgccctttaaccgctgttattttcaaggtgaccatccttggtcctctcttcaagccaagccctccctcagaccttctcgtgtatttctgcagttctgactgcctatagttgataggccccaagtctgtgtctctaactagaccattctctagagctcctggattatacttcacattgcctactggatacctccatttggaattttcataagcatttcaaatgtaaaatgtcaatatttgagctcatttttccacctcttccctcacccacatgcaaccctgtcctgtctcttcttacctcggtccttgcaatgagtggcacttagaatcctccgtgcatgtattccagacccttttatctccagtggctgactgataactgattgattccagaaggccagtgattcctgcatccacctcctctttcctattaactcagggtccccactctttacctcaactactggaacaacctacactcttcctgccttgagtgtattccccctagtaatccatcctttatccccataccataaaatatgctcataacaccccccataaagtgattccctagagcttaaaaacctcagctccttaagaccatctactttgttttctggaccctctggcctcatcttccacctaccctccctctccaccatccccctcatctccagcgacaccttatacttaactcatgttgaaccatttccgggtccggaactcactgagtacttttcagacctccagacctttgcacaggccgctgcttcctctgagccactggctagcaaaactctttctctgtccctgaggacaaacttgacgttcagttctgttttctgaaaaactgatgcaggtggaatgtttatggggttaatagacagtaagtacttatgataaagatgactcttggaccgggcatggtggctcacacctgtagtcccagtactttgggaagccaaggcaggcagatcatgaggtcaggtgatcaagaccatcctggccaacatggtgaaaccccgtctctgctaaaaaaaaaaaagaaagaaaaattagctgggcgtggtggtgcgtacctgtagtcccagctacttgggaggccgaggcaggagaattgcttgaaccagggagtctgagattgcagtgggccgagattgtgacactgcactccagcctggcgacagaacgagactccatctgaagaaaaaaaaaaaaaagataactcttggttggtgtgtgggatcttgacaggcaggactgtaaatgaactataaatacctgggagaagccacagctgtggacatccctggaagtcatgctcacggcgatgaagttgtgtcttcttcagcttggccttgtgcccccggaactcctgccagcacatgtggcacctggggcttctaccccagcattgctccttacctaccagcatgtctccttccccaaacccaagtgatcacgggggttcagagaagtgtcccctggcccttcctgctgatatgctgcttcttgtcctgtgtccttctaaatgactccaatgccaagtatagcccattatattccagagatcctaaatggatatttgggcctgagactatccagagggagtatggcacctcctttgcccattattcccaagcaatatctaacccacttttcaagatcttggtcaaaggcactctcctctgtaaacacacggtgcccatcaacaagaattaaataaaataatcttttgttgcaacctctgtgacatcctaaaataacacggattatattcctattataaactttggttgtattaccaccaaaatctgtcctctaagcagatgacttattgagggtaggatcaattgctgtttatatttgttcgtactattcctgcaccatgcctgcttcaccctgtggggacacattaaaagttgaatggttggatgaatggatggatggatggactgatggatggatagttgaattaaaggaaagaagcatatgtgatttgatggataaatagatttttttttttacaaaatatcaacagccattttcttatctaaataaaataatgtaagcagcaccaagaaaccaactttcaatataatagtttctgctgacccatttctgggccagaaatctcccattaggggtaagtcattgaaagcctctaaattatgaagaaggagacaaagagaaaaccaaataactgaactgttataattatagcaaatgttatggtggcaccagttagctagtttcctaggaccctggacaaatctacatataagtggaaacctctaaacagcgatgagaaaaacgggaaaatagcttgcttgtgagggagttctagggctgacagcaggatggatctcagagaagctggggcatcaggaaggcctgctaccctgtgtgccagaagctctaggcattcctgtgaacagatccagggattcagggaattccatccttcccactactttgctcagaaccaggtccctgcactccacactaagaaatggtggctccatttgtaaacaggcctctgatttatttcaacatgtgcacagcttggactttctcaaaagtaaactaaaaccaaatgaattacttaattcacaccatattctggaattaatagtcacttcaagggcatttctgagaatgttctcattcttaagagagagaccacagcatttcctttaggttgcagactggcaggaagagaagcccacaaacacactgactgtcaagttcgatcaggtttccactgtaattaacctggagaacaagtcttacctgaaaaatggtgatcactgagggcaggtgctaagtaccacttctgaaagtagcttcttttggctactgggccactaacaaggccctggctgtcagcagacactctctgaggaaggaagtgcttgtagctttagaaagctcagccttgccttaaaatccctcctggatactatcatggttttcattcctgtcttccctccagataagatgaagggatttgaggctgtccaaataaagatatgcactttaaaaagaaaaaaaaaaacatgaaaatggcttctggtaattataaggtttagaccaaggatactagcaagtcatagtgaccatatgctcttcactttcctaaaaatttacgaatttctggcaaagtcagtatttctccattgacaagcttgcctacccacagcctaacacatgcagactacagaattccacagacatggagttactgtcatggtgagcacgaagctaataaatttagtgcccattgctctgtagaagaaaacaaacatatattttaaacacaaactttgagcttaatggctgaaatgtttttgtaccttggaaatgctcctttgctattaaatcaagggtaatcatagttcatttaaatgtaggaaggaaataattgatgttttcacattactgagcatttggttcaaacactggctctgcagtaaacagcatgcagacattttaggagacaggcagccggcaggaggtagacagacggctgcctccaccgcggcgagggccagggagctgtgataacggcttccaggtttgcatcagctgcacttatggtcgatcacaccaggcacccgagatgctggatgaaagtgcttcacaattccccctacttaataattaaaatttcaatcatattctccaataatgatcatgattaaagaatgacaacacgtttctgaaatctgtaagtggcagcagagacaccaggccttctttagctcgataagcagctgcactaagatttatttatgttctgtcaaacccaaaggttttcttaaaggaggctaccctttttctttcaagctaaaggaatctgaatgtacaaagagctgtatttctctttttcttcttataagtattcccataacagctaggatattctatttttctttccagagttttgagcagcccaagtaaatcagaaggcggtcattgtctgcatgacagttcagcttgtgtcccataaaagcccacaacccttgaaacaccaaatcaccttttctgcaggtcttttgattattggcgtccttttcccaaaaaactacaaaggaaagacaaaagaaggccactatttctttaacttacatgtgcggtcatctacaaaatgttggacttcttatcacacatgttttcatattaagagtgtggtaacacacacacaggaagttggtggttcccattctccctattttcagaaccagtctcttctctagagacacgtttgtacctaacagtagattttcatattccttgattttgctttctgaccttcttggagttttcagtaatgtatcttcagccctcagatcacagagcattcattaattcattcatgcatccattcatcctcccatccatctatccacacattcagcagtcatgtcttatcattgttctaggcactgtacataaatataaacatgaattttgagttatttatatgacatccatgtatcctttcagaatacagttgtatcattgtagggcaattagaagaggtaatttctattaaagtagtagcttttttatttgatgttttcagtagaaattactagagttctctattcagtagggatgcattcagagttagtgtcaatatattgtgtaagtggaggaatcttgaatagttggatcctgcattggcccagctgcccatcctccttgcaaagtgcttaacagagacacatgtgtaggaaaagtaatggaatgcattattattagccttggctttattacaaaatctcatgggtttaactttggtaaaactgggtgtaccgagtggagaactcctggactccaaagaaccaagcggtctggaagagagccttgcgtagcgaagacgctcagtggatatttgttaaaggaggaagttggactattcagccttgctctcacaccgcccttccacgcccaaacccaggtcctgaactcagctctctggtaggaccacagtggaggcaaaggctctgagagggcaagtgtttggcttcaaagtccaagtaccactccaggcctcttccagctgccacactacctctgtttgcctaggagaaaaggttccctgagcaatgagaccatctcttctcctgaggaagccctgagctctctgggcatgtgggtggaagaggaagaggaagggtcatgtgcatgtaccccagaccctttcaccctctgaccacccatacaaagcagacccaggtcagcattcgcaaacccaaagagcagctttcttttggtacagttcagtgccctgtccttgatcctctttattcttgggcaggattcaagctggtgatgtgggagattattagtcagggttctctagagggacagaactaattggatagatgaatatatgaaggggcatttattaaggagaattgactcacacgatcacaaggagaagtcccacaatagactgtctgcaagctgaggagcaaggaagccggtctgactcccaaaacctcaaaagtagggaagccgacagtgcagccttcagtctgtggccaaaggcctgagagcccctggcaaaccactggtgtaggtccaagagtccaaaagctgaagaacttggagtctgatgttccagggcaggaagctttcaatgcgagagaaatttgaaagccggaagactcagccagtctaggccttccacacccttctgcctgcttttatcttagctgcactggcagccgattcaatttcgcccatcctgactgagggtgggtctgcctctcccagtcccactgactcaaatgttaatctcctttggcaacaccctcacagacacacccaggaacaatactttgcgtccttcaatccaatcaagttgacactcaatattaaccatcacaacacaggagccctttgcttcccctagaggccaacgttctccttaggaaaacattttttcatagtgattttgaactggaagaaactataaacacacatggccagccttgaaattcttttcaatatttgtttctctataatatgttgatatgagttaaagtatgtgtatatgtatttatttgtatgcacctaatttttttttttttttttttgagacggagtcttgctgtgtcgccaggctggagtgcagtggcgcgatctcagctcaccacaacctccgcctcccgggttcgagagattcccttgcctcagcctcccaagtagctgggattacagacatgtgccaccatacctggctaattttttgtatttagtagagatggggtttcaccatgttggccaagatggtctcggtctcctgaccttgtgatctgcccgcgtcagcctcccaaagtgctgggattacaggcgtgagcccctgcacctggcctgcacctaatatttctgtaacttcatggcaccagggaccggatgtgatttcctccactagaatagcctacactgataggcctctataaaaaaaggaatgattaggatgctttcatttgaaatttttctactcactgggtagcatttagtaggctgatgtaaatagcaagtcattcatgcagcaaatatttctgcagtgttttctgcatgctggccattgtgctgggtgtttagaacacagcgtgtcaggccgggcgtggtggctcacatctgtaatcccagcactttaggaggccgaggcaggtggatcacaaggtcaggagttcaagaccagcctggccaagattgtgaaactccgtctctactaaaaatacaaaaattagtcgggcatggtggcaggcgcctgtaattccagctactcaggaggctgaggcaggagcattgcttgaacccggggggcagaggttgcagtgagccgagatcataccactgcactccagcctgggcgacagagtgagactccatctcaaaaaaaaaaaaaacacgtgtcaaattaaaccaaactgacagtccatcgtctcaagaagtctatgttctaataggagagacaggatatgacaaatctagatgtaatataatgtctagagaaaccagtgttatgaagaaaaatatagctggggaagaaaagacagagaaactgagacaactgggggagtggaaggatgactttagacaggctagatggttttactggagaggtgatgtctcagcagtgacctagatgaagttatggaccagagaaagtcactcaggaatccaagttaagtgcaattggcctccagaaagtagtcaacctaatgggacttcagtagccctaatggtgggctggatttctcacactggctttggtgcttttcaacccacatattctaaatttcagtataactacaatgctggcgcaaagttcccccaaaataaacttgggcttgctccaagaactaacagtttcaaaaccccagatattaagaaacttccatgactatcattatcattgagttagagagcacaccaaaagcatagaccaagcttagaacctggaacctggactcaagaccacgaatgaactgctgttcctcctgcctggttaaggaaggaattggaaaggattcctcaagcagtcaagggtttcccaaagccaccctaaccccagccagtgccttcttcaagaacttcagagtatggagaattacccaaggatctaataacgtgagcctgaggtctttctttcacaggacctaggataacatggaaagtgagctcaaaagacacaggctatgtgccgtcagtgctaatgccaccccgacctatagaacccatgctgccgttctgtgacccaaggggacatcgccaaaatgctgctggcaaccctagcgagttgtgtacattgttacttttaggtttccttccatctcagaaagaaagaaataaaaagaaaccatgtgtggtctgtgcttgcttgacaaattagtctctcaatgtatttactgacatcagaatttgcattgcagacaccaagaaaacacttctgttatatattgtagtaaagaatagtaatgctcttttagttcctcatctcattaaataaaaaataagatactaatctttccctctgaagaattcaactaccaactggtacattactgatttttctatgtgaataatgtgtatagtaacaactagtattcccagaaagggtaatcataaagttaactttttttgaatttggggagaggggaaggggaggggaggggaggggaggaggaaaggaaggaagggaggaaggaagggagggagggagggagggagggatggaccgaccgttgtgcattagttggagttctctttatttcaaagaattgacttacatagccatggaggcccccaagtctgaatcctacagggcgggccagaaggttgggaacggagcaggagctgatgttgtaatcttgaaacagaatttcttcctctgagaaacctgttaaggcctttcaactaaatggatgaggcccgttaagattatcaagggcaatcccactgattgtagattttaaccccatctacaacataccttcaccacaacacccagagtaatgtttggttaaaaaaccaggtactagagacaagccaaggtgatagaaaacacacgttgtttatctacacaggcaagagtctgagaagtatctgaaggatttaataacacatgcacacacacacattgtgggagtttctatagcatgatgattaagagtacgaaatgagtgacagagccacgacgttaagcccaggcagtctgactccccgccctcctaactgctactcagtactgttcactggttcaaggctcaggccctcattggctataaaggattgaatattccattttttaaaaactttcatcaaatagattgtgggaatgaatggccttagaatttgcaactatcaaaaatggctatgagagatatcaaaaatgcgattgaatacacgaagaatgtgtgtggtcctgtatagactttgacaatacagaattttattaagcctgacgtgaccttgagatggaaatatatttatatcttaagagcacaatagtgcaaaattctgccaagtgacttgaatggaggtattttatatatatataaaatatatatgatattagagagagagagagagagaatttggatttaaagtcaagggctccctgcccctcgcctgtgggttatggaatcatcactatggcaactataaatagggctccatggaacccacttggtcaccatgaagaatctagtcagcaccccagctaaacgttttgattataacgcaactacaagcaaattgagaggacaatcccaaaaataatacaggaacatcacctaaaatagttgtgtgggatggtgcaatagtttccttagtagctaatcatctttcaccctaaaagatttagaattaagtagagaaatgttttaaagaattaaaaaacacagaaccaatattttgtattaaggaatttatacatacttgaacttctaaaggaatgtggttaattagtgaaacagctcagccttgtgacttagcttgaaacacaattgagtaattgactgaggctagggatattaaattgaactctgacaaagtttgtaaacagtatcaaagcctttcagagaacttaaggcgcactatatctattgctttgatttatttataagttatttaagtcctcaggaaaaacaaaactattttttaaatcagactttggaagtacttaagagtgtgttaaggccgggcgcagtggctcatgcctgtaatctcagcattttgggaggccgaggtgggatcacttgagatcaggacttcgacaccagcctagccaatacggtgaaagaccatctctactaaaaatacaaaaattagctgggtgtggtggtgcgcctgtaatcccagctactcaggaggctgaggaaggagaatcgcttgaacccgggagggggagggtgcagtgagccaagatcatgccactgcactccagtctgggcaacagagtgagactccatcccaaaaaaagaaaagaaaagaaaagaaaaaagtaaaagaaaagaaaagaaaaaagaaaaaaaagaatgtcttaaatttataaatgtagtttacaacgtttaaaggtgacaccatttttctacaaaattaagggacctattttgagggttccatggactggccaggaaatctgccaagaccaaagcagtcccctaattctctaagtttcactcatgggccacctgctgtcactgttggcagctgcctgtccacccaagcttgcaaatgacgcatcctggatggcctttctaatatttatccgcattgtacaaaaccactgttgactgccactttctcttggaatcatcttgctcatattcttgagacaggttactctggccattcaaggatgggtggtgcctcagctttgggactgggtaggtccctctgggagcagaggctgtgggcagcaggttccctcaggtgggccgtgggcaggtggtatcctgaggctgcgttgcctcctgttgatggagtctgttgatggaagtgtagtgacaggcacaaggaaggcttctcagtactctgcctatgctaatcaggccacatcctaactttatattcaatgcttggtcccaaaatcaagagggagctgacagaagacaatgttcagacctctccagagaggtcttctcgtggaagtcattgaagaaactggaggtgttttatctggaaatgagatgacggtaggataaaagagacccctgtttttaatagttcatttgttgcaatgggagattggccttgggaggtgttcaagatgattttctgcggtgctgggacctaagagaaataacatggaaacacgtcatgcagaagttagccccttgccagttctctttccatcggttctgttctagtcctcaaggcttctctattacctgcttacctgcctctttaaaaacaagaatgcaggccctgggctcttccacaggcaaaagtgtttgactttcatatcattcatattgttgattttttgcagttgtcttctatgtgtggcaagtaacacaattcagtgttttctatttacattaatggtatgatatttattttggaataattttaattaaattaagaaaacaagccgggcacagtggctcacgcctgtaatcccagcactttgggaggccagggtgggcagatcacgaggtcaggagatcgagaccatcctggctaacacagtgaaaccctgtctctactaaaaatacaaaaattagctgggtgtggtggcgggcacctgtagtcccagctgctcgggaggctgaggcaggagaatcacttgaacctgggaggcagaggttgcagtgagctgagatcgcaccactgcactccagcctgggtgacagagcgagactccgtctcaaaaaaaaaagaaagaaaaagaaaacattaagtaaatcatggtatgagtggtttatagatatgctgaaacttatggagaagtcaagaaaacaattgggcattggaaacaccagtgcagattgttatgtattgcaaagtagggtaaatggtatcacttgcatgtggcatgtcagaggcagccggcagggcagaagttctcacaatagatggagcttcgcaacatgggatgtgttcttacctgtgagcttctggttgagtcagggaggcgtaggaagacatcatttttcaagaatgctgcagcaggggtcctgcatgcctctggatggtccctaaggctcagcgtctttgccagtggcaatcagggcaagtcctcctttggccatacaccttccccctcttcactcctctctctgatcttaggagagactcgaaaaggtataaaggaacaccaagaggccttcttaagctcaaggaatcaacagtttgtttattttcagttccccatgtattttgaggctggaggataatgcaggcagccagactacctgtaccttacctcttgggagccaaagctatgaggcagctgtagggagaatgagtaatggatcagcaaagaggcaggcaccgttggctctggaacagctaaagtctcgtgggtgggtgtgggggtcatggcagtgcattgaaatggagaaaccaaagatgttccattcccaatgcttctgttttcctgcactttcccattgcttccctacacctgtctgtgtagaacaataaccatgaatgtcattataaactagaaagtatggctggttacggaagtctagtcagtgcctcactgtcgctgactcagtccaacacccaccatctctggtgggacaagtctccactttggttctgatttcctctttgaggtctagatgccagttttcagcaactaccaaacagtttttcttggctgagcctcttcaacacgtgcacttatgggtcagcttattttattgttgctttgacttaagatttccatggaatatgaacatgaaaagagagtctttttgtcaaacactgggagacatttcacatattacggccctgagtacgttcagagttaccttctttgaataaaatcgcctttccctggggcccacgatgagcagtgggagagtacatacggatagatgagaaaagatttttctctatgtcaatcttgaaaccttctttgagtttatgtttctttgtttgtttttctccctagttacttgtgttttaagttgttgaaggcaagtgatctggttggacagttattttgcttagaggacatgctaaatcgtgggacaaaatccaatatcagattttgaaaccggggcattactattttatattggcagaattgactgagcatacaaattataaattgcaagcataaaccaagaaattgtaataataatacacacagcttcttttctatcaggttggtccagatcaataaccacaaaccatttatcccagacaatgttcttacccgagccctgatggtctcattcataacacctgtaagtaagccatccaccttttgtccccttatcactttattctgagcagtcaccatctcagatgcaccacctttttaatgtgaccttggggagaacacactgggcttcctgtgttgccagagtcccaaagtcatcctctaccttgaacgcttttattttaaaataatagtgccactcatttgggaaggttaacttggactccagcttataaggattgtccagcaaagaaacgaaagggtagaggaacagctaatgctcctgtggctcatggcttcccagatctgcagggagtgcctttccagccagagatgtctagcctcttgcccccacaaattaggaggaagcagataaaagccttgcacgtaatgtgtagcaaaaatgcaaatatttggatggaaaagatatacgggaacgtcagcatagatgctacctcgggggacagagaaagagaaagaagagaagaaagacggaagaaactgggataagagaatcgcaagatctttatgtctgtaacctttgctttttacaaatttgaagcaaaaatgccccccgaaatcagcattaaatctaagatgtggatatgtgagtcctgattacattagtctttgtattttctgtgttttggaacaatttcattacatatgtgtatgtacacatacgtgtatatgcatgtgtatatgtccatctaaaataatcaaaatgcttaggatccagttaagtaattcattcaagggctgcatgggagtggccattcagagatacgcagacaccaaagaatgatgaatttctgatattccaagaatccagtgaaatattacggtgtggggaaaagtgaagatcttttatggaggcaaaagggaggcgctgaacagaatcacggtgttttccatacaacggctaacacacagatgtaagatttgattggctactgttgacttcactctaagggggttgcttagcattttattataaagagataacaatgaccaaggtccctacctcccacatcattcagtctggtttgaatgaaggctataagtctggttaaggtctaagatctcaacacaaaaatcaggaagcagtggtcacgcaccagagagaaaaaacagcctgctctcacaactccatttccagggcttaactttcctctaggcctgtgaaatttggaaggtcctgaaattttcttttgtttttacatatatgtatgtatgtgtttaaaagaaaaaggaggccagccacggtggctcatacctgtaatcccagcacattgggaggccgaggcgggctgatcatgaggtcaggagatcgagaccatcctagcttacacggtgaaacgctgtgtctactaaaaatacaaaaaattagccaggcatggtggtgcatgcctgtagtcccagctactcgggaggctgaggcaggagcatcgcttgaacccgggaggcggaggttgcagtgagctgagatcactccactgcactccagcctgggcgacagagagagactccatctcaaggaaaggaaggaaagaaaggatggcagaggaatatgggagattattctccaacttgtcttctttacagggggccttttctaaacttaaaccaatacacagaagaaaagttatttataactaaatcaaaatgtaaattcatttctaatgagttcagttctgaaaaggtttggggaattctgctgttaggagtttcgaagtgaattttagggtttagccgcgggaaaccctagattgagcatgtcagagagaaccgaagaatttagacacgcaggaaaagctggtcaatgaacagcagcccattctctgagtgaaaaagcagctttcggttaacttcacagggggacttaactgtcctagtagcaggaaagatgttgctatagtaacgctcagtgtggggtgagaaggaaaatgggattaaaaaaggatattttccttgtattgacttctttccttaaagatcattaagaagtcacctacccatagctaacagaaaagaaatcctatttagccttaagggggaaaaaaagcccactttttcacctgggaaggataggagctgctcccatgtcctggggtacagagtagcttttaactgaatgtagggatatttggttgagggagtggctgttgtccttttctatgtatacagcagaaaaatgggttgatggatggaattaaatggcaatttaaagaaatccaaagagctgtctgttctgcagttgccacctcccacgtgaacctccctcattcctggctccatattcctagtgtgggaggatggttataaattagatgaggatgaattgtttcgtttgtgcagagctttaatttgatagaaaggggaggtctaataaatcatgggtagaaaagaggctgcatttagtttcaatcttaaagtacagttcaggttaacaaggttaaaaatagattgctccaggaacaggtatgaattcctccatgacgctcagccatcacaaacatcctactccttttatgcttctacacaaagtcagatctggctcagacgccaggcttcagggcaccagagtctgcatctggtagcggggagggcctttcccctcccacagctgcataggtcccaagccaggcccctttgggtcgcagtgtctgctggcatctcccagttcctctaagtcacacttggacctcgaaacctccccaaaggcctacaagcatggtgctccctgctcagccccaggcagcctccaagcctcccttcccaaagggagaaatcagagaaatcccttctccaatttttttgttttgttctgagataagatctctctctgttgccaaggctggagtgcagtgatacaatcctagcttactgtggcctcgacctccccaggctcagatgatcctcccaccaccccaccaccaccccatgctccagatacctgggaccataggcatgtgccaccacacccagctaagttttatattttttatagagacagggtttcaccatgttgcccaggctggtctcaaactcctgggctcaaacagtttgcctctcctctttgtttatgctgctgccctctctgctctggtccctatccccgccactccatctccccacaggaggctttccagaactaaggcctctgaactctccgggcaaaggaaaccaccaccctgcaaggctgtcgatagggaagggaagggaagggaagggaagggaagggaaaccccttgtattctttgctggcggccaatagcaggaaagtgggcccagctcatcactctgtgcagtcacctggccccgcacgtgaagggagaccatgcactctgccctgtgacacgcagacctggtgcggggcagctggcctctatcatgctgcaccgatcccattcagctgcagcacgggtggatgatacaggtggcctctttctcctgctgccctgtcagacgctgggatggcagccagctgacacttcgatgccttgaagtccaggaaaagagtcacagtcatcttccttcaagcttggagaaaggacagtcttcccttattccactcagaggtgtccatgtgtaggagaaaggggagggtgggcctcagctctcagctcctctgatcaatctacgctgcttgactcggtggccaggggcaccactgagcccctcatgagcccccagcaactgcattccagcccaagtggccctcctcccctgggtcagtgccgagcaccagcaggtcacatgcggtctatgttttacagtcctgtctttgtggtcaggcagcctctaagtggccgtcagaaagttgagccccctctccccgttcctgtctgactgctgtacactcgtgcagggggagctgtgtcagcgccgcggctttggagaggctgagcacgtcaagttcaagaattatgggttttaggcagatgtgccagccctggcatctggtccctgaagcccagtctactcttggaatccagagtaaaatgtaggcaggggttggttacctagagattaaaaaaacaaaaaaagatattgtgccaaatgccctttttagaaaagaccatgctaaggataaatgaaaatgaagactggagaggtactggctttttttaaaaataaataactattacataccttagcaaaacaggaataaatctattaaactgataacaaatacctctggccaaaaccacgggaaggcttttttcaaagcatttgaaatgcaaaataaacgacatgtaaagattctgtccgtacagcatgtcaagagtgccgtttcattcatcaaggggaacaaatgtttccaccgccacgcggtagcgctcgtgcaaagctcgctgttactcaggagccctcgctacccgcagacaggctgagcacagtgaattagcctctcaggaggaactcagcttttcagagcacaacctcaccacgtcaattaatatttgctgactgaatgcctgctctgcgtctcccactaaccaggggctgcagggacttcttggagcatggcaagcaccccaagcgctagtttagtctaaatggaaaaagcatgcatggaaatggaaatgccggagtaaattcatgagatctaatgaccttgaggacttcacacagacatacacattcctggaggaaggtggtggggatgctttggctaaacccattacagagcacattctgttcatcagagaatgtgtctttaaggaagagaatctcaatcgtttgctaaataggaaagacaagttgacagatgattgggagcctcttccaggcaagaggatttccttaggaagctcactcagccaggcccatcccatgaagctgccctgggatgggtcctggagaagtggtatctgcagctcccacccgctgggcctggcctggccgattcccagtcccccagtccaggagccagaagctccagagctcaccggccccacccagcctcccacacttttgctctttgtctgcctaaggcctaagcctggcgcctcctagttagttcgtgcacactgaatcgaatttcatgtaaattaaatgctaacaggctgctgatgccagcatctctacctttgtcatttaaagtcacaggctccttaatgactgcaattaggcagctccgttattacttgagctagagacgtttagagaggcatctgtgatggcaaaatgctcagcgtgctccactctttccattaaccccttggctctgcctaccggggcatcagtttaggcaggagtaatattagcagctgaagcacacttgtttctaccaaaggtaaaactgactgaactaatgactgcggaggatttctttctctttttttctttttttttaaatggttatgaccatttaaaaaaactgattgttcttataaattgcagtatgtactgtccactctgggttatctatttaccattaataatttatatggtgtgatttgtaaaactactgtcaggcttctttccttacaatgttacaaagtctgtgcgacaatgaacttatcttccagcgggcattgcgtgagtacctctcaggctcccacaccctgtggcgcttcgtggtaccatcaaactcctgcgcttgatttaggcaatgcacgccagttcccccgccccatgcagggcatgtggtaagtcacagtgacatagtataagaccacgcgtgttggaggaacttcactccctgattttttttttttttttttgagacggagtcttgctctgtcacccaggctggagtgcagtggtataatcttggctcactgcaacctctgcctcccaggttcaagcaattctcctgcctcagcctcccaagtagctgggattacaggcatgcaccaccaccacacccagctaattttgtatttttagtagagatggggtttttccatgttggtcaggctggcctcgaactcccgacctcaggtgatccacccgccttggcctcccaaagtgctggtattacaagcatgagccaccgcgcccggcctcgctccctgattctaatccctactcattttcttcacctcgagcaggtcagttaacctctcagagccccgatttcctcatctgtgcactggggagaatggcttgcctgaggagcagcgtggacacattggcagtaagtgagagggtttatgttaaactgctgacagatagtgatataaatgttatgtttagttgttacgatgtccaaaatgaaagggaagagaacctctcttttgcttcctggcagaggctctcggtaagctgttcgtctccacggctgcattctagcaacttcgttgaaaagcattcatgggtgttggtgtgtaagcggggccccgaaggaacagctaaattccaagccaccttcagctgggagtccagcccgtccagtccaagacagcgaaggccacccttggtccaggtcgccaccttagatacaagcagtgctgcccttccgcttggtggtgcggaacggcacgctattcagtgccttcttgtactcgcccactaaggagaaggtcatgtgaattatccaaaagatgaagcccgagattttaaaatcatactgagtaatggttctgaataaaagccatttgttatgatcactaaagtaaacctgtttgtggacagtaagaatagtgtcttaaatctagccttcaagattaaggactttaaactcatttcatggtgtattttttgtgctaatcattttatgtttttacttatcgtaggaggtggaaagccccttcaatggctctgtactgacttttgaagtggagaaataattctccttcaatttcagagaaattgaagtttacttaaagatgattaaaaatctttctgacagactttgagaaggtctctcttctgactgctgtaattttaaataattcagagccagcttggcacatgtatgtttattaaagtagggatgaaaataaaactcactcgtgtggctgcattagcccactgaacagtatttcatcttacatcgtctctataacttctgaagtgaaaaccagaaactcattggcgatgtcctccctgcttgctgggctgattggcatgaggcagggccagctttatccacttcctgaagaccattcctccatggtagcccctttgccagccgccagacgctcttctcagagactcagaacagcaggccagggatggagggagggaagatgccggatggccgaggagcccccaggcaggtggcagctgcagccttggcccttcctgggaccctgaggcccctgggatgccttggcagcagaacctgtatcagcaggagcagctctgggaactgcggggaagaactggagctctcaggaccccagatcctcagatcctttttttttttttttttttttttttaagagacagagtcttgctctgttgcccaggctggagtgcagtggcatgatctcagctcactgcaacctccacctcccaggttcaagtgattctcctgccttggcctcccgagtagctgggatcacaggcacgtgccaccacgcccagcaaatttttgtatttttagtagatacggggtttcaccacgttggccaggctggtttcaaactcctgacctcaagtgatccgcccgccttggcctcccaaagtgctgggattgtaggcatgaaccaccgcacctggacaggaccccagactctttctgtagctcacaaatcaacaaaattagtaagtatgtgaactgtgatgcagagcttccaaccacatcccaaactgccatggactgcgcttctcttcacgctcgagcagtgatggctgagcaccatgcttctccgcagagctgagctgctctttcttgctcctcaccaggttctctcctgctcctcctgcggtggccacagctttggctgtgctgtgttttgtgccgcagataggccctttctgactttatttgactaaccccccagaacccctgatggtgtttagctggccaaaattcaaaaatccctctgagatgcttgtagttcagaacatttttgttaggaaaatcctctctctctttaccaatgagattttgcaagaacaatcccatctttctctttgtctttcagctgacattttagtcttaaattttctagggacaccttcagttcagcctcttatcacattagactcttatttgtattctggagagatgctggtctttaatattctcgaagacaaataaagaaccctcagaaaacccagggccattctactttctaccttcagtcctgaatgatgtcagggagctctcaggaccttcaggtggcattggaaatatctcttgggtttggaaagggcaatttagatccaagcaatctcagaatgcatttgtgatagatatgttatgaatttttactgcctcacctcttcacttcctccctgtctgcgaggtagaactaggattttcttatccatttccagcaactcccagacccctggtgagggaaccctctgtgtctgccgaccatgtctttgcagaacaattcaatctatcccgagaggcagcctcccagaggcagcaatggggaaatgccaggcttctcaacctccgtgtcagcattcttgatatttggggtgggataatcctttgtcagggggactgttctttgcattgtaggatgtttagcagagtctctggcctctgtctgctagacaccagtggcactctgtagtgtgacagtgaaaaatgtctccagacattgtcaactgagaacttctgacataatgggaagggtaaaaacttagggccaggccaggcgcagtgtctcacacctgtaatcccagcactttgggaggccgagacgggcggatcacgaggtcaggagatggagagcatcctggctaacacggtgaaaccccgtctctactaaaaataccaaaaaaaattagccgggcgtggtggtgggcgcctgtagtcccagctactcaggaggctgaggcaggagagtagcatgaacccgggaggtggagcttgcagtgagccgagatcgcgccactgcactccagcctgggcggcagagtgagactccgtcaaaaaaaaaaaacaaaaaacaaaacaaaacaaaaaacaaaaaaacctaggcccaaaatactgatgctcgaatctcagctctactgggacgaccttgaccaagtctatctgagctcatagtacctgccccacgagattgcttgcataattaaactcaatgatgtggtagctttcagtacatgtttattgaagccaaatctcttatcatctgttttcttaattaatggcaagaattacgttcagatgcgcagtaagcaataaaaaaaaatctagcttccttgtttcaccaaaggtacacttctagctctttggcacaaaccggtttagttcagtgtagatggaatcgctcggagatctggcttcatcacgggagagaggacatttcacttctggtggtatctctcttgtacccgttgagagctgctcccacgcagttaatggcgcccagataattacagacggagctgccttcgggttgtaaacagagctttgggtgattgcacactgccatttatccggcctatttgcattcgtacttatttgcatttctacatctcccacagctgacacttgttttttcattttgtgattccaaagcacttttctgattaccctgtgcctgctaggagtgctccccatcaggcgagggatgcagcctccttcccggctctgccctcttgatttcctccatgtttttggagggaggccagttgttgggagaccgcatctgccgtgagcccgggactaatgagtcattgttcttctgagaagcccgttggcgtcagcttcctttcagctgcggcatcgcaggaccttgtctgccttttcctccgggttacacctgggacctgctgcattatgttactatgacaagggtcaccttactttctcttttcgaaagtgagattgactttccttctgtttctgaaagaaatgcgacttaaaatttgagtctgtagcaatcagcttgagatagcctactctgaaactgctaaaagaacagtttccatttaagaatttagctgcagtgctgagaacatacaacccctacctttttaagcctctcatgtgcttatatttcttaaacaaaatggctatgtctattccttgctttcagtaaaaggcatactcgtcagtttaataaaatgtatgttaattttcctaagccaatttacaagcagcattggtcaaatagctacatgcgggatgatcacccgaatatctaataatgatagagcacttaacggtttactaattccttaacaacatccatcatctatttttcgattttcttctctctctcggtttccacatgacccatgcattgaaagatttagatttcctattttgccgaattgtactgttttcccttcccctctgagtgaaagtaagaaaacctatgagtttaaagtatgtcttctgccctacatgctgtatgtaaaatttaacagaattcagccgggcgcagtggctgatgcctgtaatcccagcaccttgggaggctaaggtgggcggattacgaggtcaagagatagagaccatcttggccaacatggtgaaaccccatctctactaaaaatacaaaaaatagctgggcgtggtggtgtgtgcctgtagttctagctcctcaggaggctgaggcaggagaatcacttgaacccaggaggcggaggttgcagtgagtcgagatcacgccattgcaatccagcctggagacagagcaagactctgtctcaaaaaaaaaaaaaaaaaaaaattaacagaattctccctgtaagtgaatttgtaagaaaacaagaacattgactattccatttaataacaaaacttctgggacagaccagctccctcagtggattagttaaatgatgtgcagattatattaacccatggaatatagcatcacggacccacataccatcatcctgacttagtacgactcacaccagctctgtatttaaacggatgaggatagatgtgggctcatataattactgtgtcaattacaagggaagaataaacaaatgtttaccaatcaagtagtcaccagcaacctgcctttggtagatatactagtgttcctatttggggaaaggtattatttattttaatagttgcataatggtcactttcaaaatatgcctttgactacgttatgcttattttctgcatgtcacagactagccctgcttaggtgagcttagtagatacactaatgttactactttgagaaaggcattatttaatattcctttcaggaacacattaatatacgatgtcagaattatgatgcttggtttttatacacagcctgtcccagctcaggtgaggtcacatcccttggccatacctgtgtaaaaagccaaagggggccccttttccagacagcaaccagcctagcccaggctcccctgccttgtggcatccacgccaccagtcactgccaaagcgcatacaggagtccccgcttatccatggtttcgattcctgcagtctctggtactcacagtcaaccgaggcccgaagatattaaatggaaaataccagctcaacacttcctaagttttaaattgctcactgttctgagttgtgcgatgaaatctcacaccctcccacctggatgtggatcctccctttgtctggcatctccacgctgtagacaccacgcgcccagaagtcacttagtagccatctgggatagcagagctatagatcacaagaagaaggatgagcgcaggacaatgagatatttagagagagcgggagtccacattcacgtagcttgtgtcgtggtcctcgcaccattatacctgctctgctgtagcactgttgtgaatgtcttactttgcttaatttataagttaagcttcgtaataggcatgtatgtgtaggaaaaaacagcatatatagggtcggtactacccgtgatttcagcatacactgagggtctgggaacgtatcccccttggataatgggggtgactgtgatggtaacagaagcatcctagttgttattttcataggcactgctaccaagcttgtaaacctcttcactgtacccagtagtgagacagagctgcagagggtgaccggtctccctaagtgaataccaggtggaacctaacacatagagagagaggaaaggccaatttcagacactgaaagctactcttacagatacagacatttcaatagccaggagaccctgaggaatggctcttaatccaggtggcctgtgtatagacatgcctgcaagtagccaaccaggataataagagtcatcccccggaagggatgaggtcagagcaggagtttcaatttgacccacgttcccatcatgcctttctctctttctctcccatcctcacttccaaatcacagccattcacccaagcagttcatgaatgcaggaacctaccaggacattacaaatcattaaaaatttaaccctcccagggagcaattacaactccaaaaaggcattatttgcactctccgcccacccccccccaaaaaagtcttgagtttgcagagagtggccaaaaacattctagaacttcatgtctctatgccatgcctcctcttccatcccagcgaatgaaatccacctgatgagggcacacagcaggccctcccatcccgcctcctcctctctgccctcccatcccggcccctgctctctgtccctcccattccactcccctgctctctgccctcacatcttgccccctcttctctgccctcccatcccaccctctgctctctgccctcccatcctgccccctgctctctgccctcccatctcgccccctcctctctgccctcccatcccagcctctgctctctgtctctcccatcctcctcccctgctctctgctctcccattctgcctcttcatctctgccctcccatcccaccccctcctctctgtcctcccatccctccccctcctctctgccctcccatccctccccctcctctctgccctcccatccctccccctcctctctgccctcccatcccacccccctgctctctgtcttcccccactccctcctccccaagtcattgctgggaggagtgggtcggcctcagggcctcccaggcagtccttgaggaaaccacacacttcatgaggaaaggaaatcctggaggagttttcatgtagatacaggttttatttagggaaaaaaaaatccagaaataaatacaactgcctggaaaactaactatattttacattttggaataatttaaatatcattcctggtaaaggaagtgatgcagaaaagtcaagagagctctgaaggcagagagagctggataagcgggtcctgattcatcagtgaccttgagctggcccctgacacctctgaaattccatttctgcaatggtaaaacggggatagcaatgacacctacattattatatttaaaatgaacacattttatttttttaatgcgccaatatttgtaaatattcataaagctcatatgaatatttgtaaagctctctgcacaaagtagaagctcagtgcttctttataaacaacattaacaaaacgacttcacttaccttcacacgatccctttgcattagggattatcgccaaccaggcaggaggcgtcagagcatggcttgataaaaatagagtacaactatgcagggagttttttaggacaatgggaatgtaaccgcttataatgcatgtccaaaaggttccttgtaaaatattatcttgcaaaatgattttagagtgaaatcatctctcttttttctggcaaatctttgaattccacccaatttaccttcattatatccagctgcacaaaagcccatgtgttatttcttcccatgctgtctcaccagatctgtctgttcacattaacctagttaccagtggaacaaaaatgcaattggccaaaggttacatttctttgtcatgagcacaagagagcaagatcatgccgggcaaaggctttcagtaaatttcagccaagaagttgggcttcttcccaggaactctttaaccctcccctctccttcctcccagaaacacacatgctacgttacccttggtgtttttccgcgccaaacttgtggtctttttttgttttatttttaaagatgaatatattacagaaaggaatgatactgaatttccttcagcatgccccccaattttaggaccttgaagattttcatgtttcaaattgcattaaacttttcaaagagctttctttccctacttcagctataatcctgaagagacaggtgaaagatgctttgtaaatcctcattttacaaatgagaaaattaaggctccaggagatgatatgacttgctcagcgattacacaagtaggaaaataaagaccccattgtgtgttgattctcaaacggtctgcattatagtcttgtgtctacacaagtcagcgcacaccccagccttggagaggatgttgttctgaggaatcggagtccagttcctgaagcttgggcggctctggcttcatgaagacggagtctgggtacaaagcagaaacttagggaaattccccaacagccggcaggcagatgccaccctccctcaccctgcaccgtagacgttagcctgggataatggcagaggaaaaaagcacacagaaaactaagcagacacagaaataagtaatcattttccctatgatctatggcaatgttgaactcttccaagagcatactggcaaaatctcttgagtaaaatagcaagtgaatagaatgcttactattggaatggtatggagtggtggtcttcaaactgttttcctaataatatattccccacatacaaaattttgaaaacaatgtacctcctcacaagtgtttaagtccatcataaaattttacctaggcttaagtagtagcaaaaagtgaaactcctggagtgttataaaaactgacaattttttttttaatggagtttcgctcttgtcacccaggctggaatgcaatggcgtgatctcaactcactgcaacctctgcctcccgggttcagataattctcctctctcagcctcccgagtagctgggattacagacgtgtgccaccacgcctggctaatttttgtatttttagcagagatggggtttcatcatgttggccaggcgggtcttgaactcctgacctcaggtgatctgcttgcctcggcctcccaaagtgctgggattacaggtgacagccacagtgctcagcctaatactgacaaatattttataaaagaagagagacagcaatcttttaaatgacagaaatagaatctgtacaccagagggtccacatcattcattttgtaaacacatgaatgggctcttctttatcaaagggagtttatatcgggcctcatactcctagtagtccatttcacttctcttattctctaacatgtgtttatatttgaaaatattttattggtcatccagtatatatttctgtaatgaaaatatgtacaaagcctttaatttttaatttctagaattaaaaacgaggttctgaggttaacattttttcctacttgagttattaaaattaattattagtagtaaacagttaatccaaacaacaaaaatacattataagttttgttgactacttgttaaacaaaaagtgaaatggtaatgggaacatccaacttactgagatgccgcggacgcatactgcttacagctggaatcagacagccctcaatatgaatttcttccatttttcattttaattaatgtaagcactaaataactttgttcatataaataggtacattgcaatggaagaagtcttttagcagtatcattctattttttaaaagtcatttgcagttatatgccaaaatcacatgatagtctatcatcaaaacatatttttatttttcaaaatcttcaggaacaaagaattagaagcaaaagtattttttgccctttgccatgaaattattggcacgctgatttaccttttcagttttttagaagtatgccataaaggttttatgaggatcttacgaataactattaattgtaccttttattttgtgcatttagaaacccttcatttaatacattcagaaagagttgaaaaaatattaaatattgttattttcaatacgcctttgccagtaaagcatctcttgataaaatatttttgtcatgtgctttaaatatattcttacccaaatggaagttgctgagtcatttaatttatagaaaaggtaaaatatttaacaaactcagtcttcacaccaatagctaaaatcagaggctaggtgcagtggctcatgtctgtaatcccagcactttgggaggccgaggtgggcagattgctggaggtcaggagttagagaccagcctggccaacatggtgaaaccccatctctactaaaaatacaaaaaaaaaaaaaaaaaaaaattagctgggcatggtgatggcgggcgcctgtaatcccagctacttgggaggctgaggcaggagaatcgcttgaacccgggaggcagaggttgcagtgagccaagatggcgccattaaactccagcctggatgacaagagtgagacttcgtctcaaaaaaaaaaaaaaaaaaaaaaaatcagaggaagtgaatattgttaatgtaaaaatatgctaacatgtgttccaaggaatattgttgggggtcactaaaaagtagatatctatcttgcaagatgagttatgaaaaacagtcaggatcagaatgacatagaatattcatttaaccatttcacaaagtttaacaaactaaaataaatctatctgttcttgtacttgatttgtaataaaggaatattatgtgttgctgaaattacagttatttatgaagcaaggatagcctggagtcctttggtgggtacacatgtgtgcatgcattaaaatgcaccccagtgtttggcatctgtgaataattaagtaagagtcatgtaataaagagaaataactttattcatgatcaaacattgtcaagaaagtgaaaagcttaaacgtagatatagctatagatagaaaatattattgccggatgcagtggctcacgcctgtaatcccatcactttgggaggctaaggcgggtgtggattgcctgaggtcaggagtttgagaccagcctggccaatatggtgaaaccctgtctctactaaaaatacaaaaattagcggggtgtggtggcaggcgcctgtaatcccagctactcgggaggctgagccaggagaatctcttgaacccgggaggcggaggttgcagtgagccaagatcgcgccattgcactccagcctgggcaatggagcaagactccatctcaaaaaaaaagaaaaagaaaaagaaaagaaaagaaagaaagaaagaaaagaaaatattctgactcagcagctagcaaacaattttaatttgttgttaataagaggtggaaaatattaaacactttataatataaaatatgagtattgattgcactgggaataaaaattttatgatatgatttaataaaacaggttttaactaccttgttaaataatgtgtaccacatctaaaaggaaccacataaaatgtttatctgctgatttgatctagtattaaatttaaaaatttcgtagttcctaaaaacatttgttatgtttgaaagactatttaatttatagaaaaagccatttcttcagtggctcaaggtttatttctttccagttaatgatatactctacaaataagcattgagattagctaatcataattgctcacattaaatacatgggaaaacgtagattttagcagtcaatatttcttttttttttttttgagacagagtctcgctctgttgcccaggctgaagtgcagtggagtgatctcgactcgtttcaacctccgccccccaggttcaagcaattctcctgtctcaacctcctgagtagctgggcttacaggcatgcaccactgtgccgtgctaattttttttgtagttttagtagagacagggtttcaccacgttggccaggctggtctcgaacttctgacctcaggtgatccgcctgccttgacctcccaaagtgctgggattacaggcatgagccaccgcacctggccagcattcagtatttcttttttttttttttttttttttttgagacggagtctggctgtgttgcccaggctggagtgcagtggcgcaatcttggctcactgcaagctccgcctcccaggttcacaccattctcctgcctcagcctcccgagtagctgggactacaggcgcccgccactatgccaggctaattttttgtatttttagtagagacagggtttcactgtgttagccaggatggtcttgatctcctgacctcgtgatccacccgcctcggccccccaaagtgctgggattacaggcgtgagccaccacgcccggcccattcagtatttcttatccattctctctgtgtttgctctcaccacatttttccccaagagcagtgcatttactgacaatcccaagagagaacaggttaagcaattaaacagaagttggtgaaaattgctatcattctgctgtggtttcactgttctctccaaaactcatgttgaacttcaattgtcagtgtaatagtgttaagaggtgggacctttaggcagtgattaggtcctaaggactctaccctcatggatggattaatgccctgtgtttcataacatagttacaataataatcgtacagtgaacagccttggaagatagagatactgtctctttccgcagcagaggggaagtttgcttataacaaagacaatgtctccctctgttgacaatggcaggcctgctcacggcccattataaaagactcagattccctaaagtcagggtcctcacacctgtaatgcaacccatgccatgtgcagctgccatctggtccatttcaaaccaccctgtgagaactgggatttgagaaaccagcacaggaaaaaagatattgctgtaaataatgcatggtcctttgtctctgacccaggaacctctggtcttctcctggcctccgtaaaactgagcagactaacttgttagcttgcaaagaaagcaaaatcttggatccttcacagttcctgacaagaattaaaatgaagtcttctcttggtagctacctggagccatgaatatttccaggtatccaagtggccatactcacttaggagtattctgaattactgaagaaaaggcccattaatgactctgaaactcaccctcctcccacacaccctcggactggaacttctggattcctctttcttcattgatctacttgtggcccaaacctgaaaccagcagccatctccgtggcctccctggccctcccgcttcacatccaggttcttctagttccatctcagaatgttttctgagctctggaacttgcttccatttccttcttctagcaacatcctagccattgcaaggtctcagctctggggataccaccctgcctcaccacattcgtgttatttctccgtccctcttaaccatggctccccaggttgcctgttttcccacacatagagcaatagcacttagggcactgctgtgttataatgacctgtttacttgcccatgactgactataagctccctgagggcaggaactttctcaatcttgtttaccattgtattccacacctagcccagcacctagcatgtctcagcacttgatcagtatttgctgggtaaatctataaatgaataaatgagtaaatgagcaagaatatataaattgtatcttacatcatatgaagtgtgatataggtgataggagcattcactctgaaggaaaggtgaatatctcaaggcacaatcaaggttagcaaaggtgccatctgcaggtgtcctgtctaagagaagtttagcttcaggaacatcttacgttatctcttggacatgagcaaaactttcccccttcttgaaccagctgacctgagctggtctgccagccttccagtcttagggcaggaatgtatgcctggccatcaggaagaaggtgggagaaaccagggacccctagccataggtcagcacatgatagaggcctgcttgaaacactggcagggtggccatgtaggacttacacagtcatctgcctgcaaaaacatgacttgaaatacatgaatgcttgcccatatatgacaagatggaggttttccaaggtagaggtactcaggcagaaaaatgaaagaaaaaaaatgtgaatgtgctttttttggttgtgagctttattatatgtgtgaattgctgattctttagcaagacagtagcagttgacaaagaatcgcccttcagatgtgtggaaaaacactcagagaacacagcaaaccgccaaacaatcaaaggcagccacaatgccacacacttagagatgcaagaaggtgccacggcctttatggctgctgccctgggcacgggcatctgcgatgccagccaggttagaagatggacggagcagccgcctgtctctccgtgaggctcgtgtggaccctgaagctcacagactccggcggatggcaggcttctgtctgcactctccaccccagcagcccgtcctgcctccctctgcccctctctgccagtcccagcaggaatctgacaccttataccttcctcaatatcaggtagcagtcaatggaaggaaaaatgctggagtcttttgataaaggattggattcttttaagccagttattaatgtatttcattcagaatgtgagtagaagaaagaagttgccctatgttgccctgagatggaggcgcacggctttgaggaaggcccccacagtgcaagtgccagaagatgcaggtggaagagcatcactcatgcgtgtgagctgtgtccaaatgccgagctccacggagacacactcagactgcagcgagcttccttctgcaaccatgcaagtgtcaccctctgtcgggaccctctgagcccatccccgcaccaaagcttctctccagtgctggaaacctctgttttcaggtatatcgacaagagtgatttcagtctggagtcacgcctggagtcatgactgatttgcttgagaagccagtgcaaatcgctgagccacagcatatggaaatctgcagattgcaagtgaaacgtgggattcatcaaaagcctgattgcgtactcttccatgacacttgatacatgggattatgatgtgactttatctatctatttgaatacttccaacctcagcaaaggcctaaatgtagaacacagtggcagtgaaacaactctaccctcaagaaatatatactttacatccatgtcacaaaacgtcttccaattgtgtttcactttcacatgtcagatttcatgtaatgattgctaattactagcaacccagacaagatatagacttatgaaattgcctcatgagtttagtgatttttcagcaactggaaggaaatagaaaatccttgggtcagttctacctgagttctaatcccagctgtgtcttttacgagctggtgggcttgagtaagttattcaacttttgtgtgcctcagtttcctcctctgaaaaatgtggatgataatagtacctaccagttagggtggctgtgagaattaaaaaagatgattcgcataaagcactagtttagggcccaatagtaacatgtaatatcccagcattttgggaggccaaggcttgagtccaagagttcaagaccagcctgagcaacatggcaaaatcctgtctcgtctaaaaatacaaacaattagctgagtgttgtggtgcatatcagtagtcccagctaccagggaggctgaggtgggaggattgcttgaactggagaggtggaggctgcagtgagctatgatcacaccactgcactcccacatggtggaccagagtaaaaccctgtctcaaaaatataagtaagtaggccaggagtagtggctcacgcctgtaatcccagcactttgggaggctgaggtgggcagatcacaaggtcaggagatcgagaccatcctggctaacatgaaaccccatctctactaaaaatacgaaaaaattagccaggcatggtggcaggtgcctgtagtcccagctactcggaaggctgaggcaggagaatggcatgaacctgggaggcagagcttgcagtgagccgagtattgcgccactgcactccagcctgggtgacagagcgagactctgtctcaacaaataaataaataaataactatattagggttctccagagggacagaactaataggagatgtgtgtgtgtgtgtgtgtgtgtgtgtgtgtgtgtgtgtgtaaaggggagtttattaagtagtattaactcacatgatcacaaggtcccacaataggccatctgcaagctgaggagctaggagagccagtctgagtcccaagactgaagaacttggagttcgatgttcaagggccggaagcatccagcacaggagaaagatgtaggctgggaggctaggccagtctagtcttttcatgtttttctgcctgctttatattttagctacactggcagctgattagatggtgtccactcagattaagggtgggtctgccttccccagcccactgactcaaatgttaatctcctttgacaacaccctcacagacatacccatgatcaatactttgcatccttcagtccaatcaagttgacactcagtattaaccatcacaatagcatagaatcatatccctgaggtacttcagcacgcccctttgggtattcaggggcagtgggacatctcattttctctcttgctttttacaaatctccgtttttctctcttcctctttttgttttcctttaaatttgtcaccccatcacattttttgctcctacaacgctgtacacaggcacccccttaaccacttgggaggccatcactcatctttgttaattcccctgaacatccagtgtgggaacactccactgtcactcctgctcggtgttggaactgaggctgggtattagtctctaaaaggaggacaggacagaccactgcacttttcaggaatcctgtgggcccaacatgagctattaaaaaaataccatgtcttccaaggaacaggggcaccgtgtgaatatggggggaattactgatgtggcaaggcgtctcgtctatattatacaacctactgtgttttacaaagcacaaaatttgagtatttggacaaattcatctcctcataatactttacaaacattttgacccaaaagatacttagttgtaatcttgacttccccctgaagacacctctccagtgggtgatgaggcacctttatcatgtctgactggggagcagccaagggggactagtccttgatctggtgcatcagaaatgaaaatctgtggattctgatctcaaaagacaaggacaactgagacatttgagaccagcgttggacaccaatcggaccacggacctacaccatctctccctgaagctcattttgttgcctctgaaataagtcaatggagactctttctgaagggttgctggtagacaggacaaacaagtactgtgaactttcagatcaggattgcaatgggtgcagcgataacctttcaggaggtgcatttttgatgtgttgtaaggcaacgctgtgagtagagaacctcaatgcagtttgtactctttgcccactgctctctaacacgagtcagtagaaagctggtgggctgtacagttcaatctaggagggagtttcagctcttccaagactagtggggtcaaagtagttatatgagcctctcaggatgcagtttcctcctatgttaaagtaagtgtgtgtgagagagaggagacagagaaagagagtcatgcctaactcagcacataggcactcaataaacattgggttctccacaccaattcacagaaacagaagacacctgtaggcatcacttacttaatgtgggcctatgagtactttcttaagtgtttctgaacaaagaaactcccatagtctccctcgacagtacagtccaacttttcagagcacatttaactaggaagttcttcccacatcgtggctgctgtctcttagaattaagatgtaaagacgcttcacattgctgtcacacaccaaaagcccttccaggtactgcagaataaggaacatgcattcctagatgagttaattcctttgatactttgattgctcacagtggttttgcctacatcctctccaaattctccactcctccttttagtacagggagtggccaaagagctataattacactcttaaggacagttagaggtgtcctgtggttcctgctgttaaagtaattaaatggaagcctgctagaccaaggtggccccaatgccctgagttcctgtgtctgcaatctgaaacccaactcagtggtcatgttctaggacaatctgaaacagccagctaagccctaacttgggactttccactgggatgaattctttgccttgcttctgagttcactccataaaagccttcctctttgccccttctgtggagccatgaaccacttgtgatccagagctggcccacccatgattgctgtttgctcaaatcaaaatcaattcttttttttttttttttttgagacagaatctccctctgtctcccagaccagagtgcagtggtatgatctcggctcactgcaaccactgtctcctgggttcaagtgattctcctgccatggcctcccaagtagctgggattacaggcacccaccatcatgcctagctaatttttgtatttttagtagagacagggttttgccatgttggccaggctggccttgaactcctggactcaaatgatccacccaccttggcctccgaaagtgctgggattacagacatgagccaccatggctggcctcaaatcaactctttaatattaatatgcctcaatttatcttcaacactacatgccgtactccagtctcaataccagccttgtgctttgacattgaccttcattggccagtgcttttcttgtctgtagactttagaaaatcaccagaaacctaatagtaaagatcatattcattcatttaactgatctgtgttcagcactgcctgtaaactgggcactgttctgtcaattcatacacaatgatgagacctaggcagagtcccctccctcttctagacaaatggtggagaaagatgatagtggttgtgtgtagcctatgagaccaggaacaagagcagtggaagggactggtgggacaatgagccatggtaaggccctgctgtagctagagtgtgcagaggaagcttccagaaagaggcagctttaaacagaccagccaattttatgaattccagcttgggattgacaagtcatctaaatctgtaaatgtcttgcttgtcattggccccaaatcaaggaattttaagatgtcctttgtcatccacattccagagcttgacaaacactgcctatgcccctgttcaaatgtgtgttcttcatgcatgaatacgtgcagaaggttcccccataaaattcaggtggttacgacgtgtaactgcatcgcagtactcacctccgaattatttacatgtaagctgcaagttacacagcgtgtctcagctgctatccgtttgcatgtagacacctctatgtacattagaaagcagagagagcatgacaacccttcagatactagttgagaaaaattaacgtgagtgcctccctattcatttgggggccacgtcttctcagatgaggacgtcccaaccaaacccatgcaaggctggcatacattaaagatgctgatatctcacacccagtgcagctgtcaagtctgctctaagagtgctgcagctcctgatgtttcaaggccttctcatagtgcgtgcatttctcactacgatactgacatgtaaatggatttataggaaatataaatgctttctaaaagacacaaataaaatgtctgaatgcatgcccagcttgtctcatattttggtccacatgctgtgagtgatgtggcagtcgatgtcagccctagaaaagggctgctgttggcgtctcgatcattggcatcatccccgtttatttattgaagtctggaatgcaaggtcagggcactgggaaattaccagcctagaagaagtagctttgaaaatatgtcatttgcctctggggcattttttcctttttctctcttccttccttgctccctgcctgcctgccttcctttcttccttccttcttccttttttcctctatttttccttcctattttcctctattcctttcaaattttcttccttcttcataattctttcagcagagaaagggggaataaaaaagaaacaagaaaatgaagcataaacagagcatctatgagaatataggcgttagtcaaagaaagagaggagataggtgtaaagttaattttctcaagattttatttgtgttgtctggccaggcacagtggctcatgcctgtaatcccagcactttgggaggccgaggcaggtggatcacttgaggtcaggagttcaagaccagcctgactaacatggtgaaaccccatctctgctaaaaatacgaaaagtagctgggtgtggtggtgggtgcctgtagtcccagctgcttgggaggctgaagcaggagaaccacttgaactcagaaggcagaggttgcagtgagccgagatcatgccactgcactccagcgtgggcaacagagtgagactccatctcaaaaaaaaaaaaaaaaaaagattttatttgtgtttccttagtcggttattttgggttattactgttttgctttcaactggaactaagtagaatccttggctaataagttttatgtggatcctgccacagttatctcaaatgatttcttggagtaaaacttgaaaaatattttcctttactagattatgtttctataatgataactcgttaaacagaaatgctacatagaaatccaaagaacttcagttgttcttttctatcaaaattctttacttctgaaattcactaaattctaacctttttccattatcatagccactctgttgctgaagaatataccaagaatttcttcaacaccactgatagtaaatctctgactatactgaatccagaatttcaagaacatatttcaaaattttaactttttaaaaaatactttttaaactcttcatgtgatttcttctgtgtagaccctgcacaaaagttcttcttatgctaactttatactatccttaatttttccctaaatatctaatgtagtctctttagaataatatacaacagccagggttggaaacagttcaaggggtaaacgtctctatctgaacaaactcttcctgtgatctccggagtcccctccattcccccgttaatgctacatggggaaaggaagttatgctgtaactacagaagatacaacatactctctatccaccctcatgctggtcctgcttaatttttagtgaagatcaaatgtgatttctgcatgaactcaggacattggttctgacccagaaagtaaactccaggcctaactgccaaatacccaactcccttctaaccacttttctacaacttttggatggaaattctatatctactcattaattgtctagaaaggactgatttttgccattcaaagtcacctgagaatttccatttatgttgggaattcagcacgtttcaattaatacttaagtacccccactcaagcatcaattcaaaatcaagatgaggaatgcctcaactctcctggtgtggggtatgggccctcgagtgcctggagggtaaaggctcacccaggtgaacttcacatgattttcttacatcatcactcaaaggcataaggaccaggaggatccttcctttctctacttagtttattgctttctctcttgctgtccttttgtgctccctgtctccaatggttcacatacaaaattaggggttagcaaggaataggaatttcagagaagcaagctctgtggagttgaggaaaaccacaaatattgtagcacatgatttagtacggcaaatggaaaaaacaagatccagcagcccggcaaattctctcttcagctatgtgaccttggacatgtaacttcatctttgagctttcttcatttgtaaaatcaggatcttaatttttaaaaagtaaagaaaactgaggctgatgtaggggggaaatcactggagcccagaagtttgaaaccagactgggcaacatagggagaccctctctctacaaataatacaaaaattagccaggcatggtggcgcgtgcctgtggtcccagctcaggaggctgaggtgggaggatcaccgagcccagaaagtggaggctgcagtgagatgttattgtaccattgcactcccgcctgggtgacagagcagaatcctgtctcaaaaataaataaagaaagaaaaaaaagaaaataaaggaaactgttcatcatgccaaaagcccatgagccatgcctggcaccaacagttggcatctctgttcatatatagtcattttatccagataaactgaggccactccagcccttgcacctttgaaaactgcttaagactaactcctgacctctcataacgcatttcagaaaagaatgctttattgcatattcattactcttaatttatttcaaaaatcagggttttttactttatcaagttctttttttttttttttttgagacatagtctcgctctgtcgctctggctggagtgcagcggcgcatgatctcggctcactgcaacctctgtctcctgggttcaagcaattctcctgtctcagcctctcaagtagctgggactacaggcacgtgctaccacacccagctaattttttgtatttttagtagagacggggtttcaccgtgttagccaggatggtcttgatctcttgacctcgtgatccgccctcctcagcctcccaaagtgctgggattacaggcgtgagccaccacgcccagccttatcaagttcttaaacaagtgccttttacgtgccaggcgcagtgctaggaactttcttaaacacggtatttgaatctctacagcaatcccacaagtagctaccaatttccccctttcacagtgaaataaatggaaattcagagatggtaagtgaactactcagagccactatcagtcggaagtaggaggactagaactgaactccggcctggctagaattattcaacacaagcagaatctaattatttcccttacaaaagtcagaggaggctgggcgtggtggttcatgcctgtaatcccagcactttgggaggcagaggtgggcagatcacttgaggtcaggagtttgagaccagcctggtcaacatggtgaaaccccgttttttaaaaaaatacaaaaattagccaggcgcagtggcgtgtacctgtaatcccagctactcaggaggctgaggcaggggaattgcttgaacccaggaggtggaggttgcagtgagccaagatggcaccactgcactccagcctgggcaacagagcgagactccatttaaaaaaaaaagaagaagaaaaaagaaaaaaggaaaggccctctgtgttgtggttaggacctcaggttctagggccaaaaatctcctggttgactgctagttggtcactttctaccactgtggcgcagggacctcactgtcctctttaaacatccatttcttcattgtaaaatggtcacataagtgggggaacaggtgagatcacgcacaagaagcatcaaactctgtgtagcacgttagctcgtaaaggattctcaccattttcattgcatagctacgcatttagtgaacactaatgaccttacatatttgtgtgtcactgtgtgaacttataattccatgtccttcatgtaaacgatgtgtttacatccaacgtattttcagagactcgctttactgcctcacttctaattttctatgatatacgattgtttctgtgtaggcaacaccagacattgttttctgatttaggctggaacgctagaaaactccaccgcctgtatgtgaaaatgccaatgcattttataagcaaagtcaaccgcaaaatgtttatagggtcaggcagttagatctgaggtacaaacatggtttagaaggaattcttacaatggtgctaaagctctagaagcaaatactatgtgggaggccatagaaagagtgaattgttgttcacacttcagctttgatttggagacacctgtgaaagaaaataatctttttcccagtacttactggttattttatttccagaaaacatgcttgttattttagccgaggtaattgccttgcctttcgggtatggtttgtgctaaatgaacagtgacacctactggcggaagatgatcacgtttatttactaaaagaagctcctgttctcactttgctgggtataatcccagaaataatacagaatgttttgatttcaaagagcaaagaaccaacactggagttaaaaagaaaaatcaaaccacgtcaaggccgatacatgaatatagacagattcactttctggagtgaagattgctcttttcttctctaaaaatgctgggttcccccaaccaccaccacaaaaataagcttgtcagagctgctccaagtaaggcagttcaagtgccaaggaaagatgtttggcttgacacacctgttcttcttctctccgtggagtaaacagattggcagaggctgcttcaaacacgttatctgtctaactcattacatattaatacttccaaagtaaatctctccattctgtaactttatttaaatatttttattaatatacagtaatacttttccagatggccttatcagaagttttagtgagaataagcagctgaaaacacaacagctgctctgctggcagcctgagagccctgcgctgtgatactgccaggccccccatggagtcagccaggcctgggggccaggcccaggagggagcgtgggaagccagcctgcagctcccagcattactcatgcccctgggtgggccactgagtctgcgtctaggtttggagtggaaagtaggaggtctgtctacattcccccagctcagctttgcctagggccctgtccttgggggattattagacactgttgatttacaaaagctggtattttcatctaatttggttctctaggtctagaggttaaaacccaggggggccggagggatgactaattggcagcctaaatttccaatgtgttgtgaaagttatttaacctgagtttccttgcctgtgaaaatgtgtgtattgagtactgctgtgacaattacaggaaacaatagatgtaacccccagccccgtgagttttttcttttctaagacacaaaccccattctcagagttatgggagaaggtacatttatacactttaattcagagacctttaattcagagattaaatcaatagcgtgtggtcttggaggcattagatgactttttttttttttttttgaaacggcgtctggctctgttgccaggctggagtgcagtgacgccatctctgctcactgcaacctccgcctcccaggttcaagtgattctgctgccttagcctcccgagtagctgcgactacaggcaggcgccaccacacccggctaatttttgtatttttagtagagacagggtttcaccatgttgaccagaatggtcttgatctcttgacctcgtgatttggcagcctcggcctcccaaagtgctgggattacaggcgtgagccactgcgccaagcccgttagatgactttacaggccatcaaaaacccgctgccatcagaaactctggacccacaagcaagctctcttcttgctcttggcccaggtctggagcttgaatgaggggtgagcatgagctagcatagccacacctcctactccttcctcggccccatctccctccagagttctttcctccatcttcctttcttctttctggtacctcattccagagctttagctgcttccccaatagacgtggctttcaatgcaaatcctgcattctgacctctctcctgggtgctcagcatctgctggacgtctagatgggggagtcttcaaaacgccaaggcccctgggcaggaggacgggtgacagttcggtgtgtatcaactccgtagcacggttgatacaagccttgccttgaagcactttgtcttatggtcagaaccatgaaccatcctttctggcccatattaataagattaaaagctggtagcttgcctttttccctgcctggtttttatgagcaaatataggacactgtctcctgcgaggcagcagcggatgaggctggtcgggggtcactggtaagaacgggtctctgttgctattactctctgttggtctgcctgggtttgaatttggatgccgagagctgatgggcctatcactggagtgactttgggtgagttgtttagcaaatatatgcctcattcacacatttattcaacaaatatgaactggcatcatctacgagccaggtcctgttctaggcactgggaggcgtcagtgctcaaaagaaacaaagttcctgccccccagtgtgtgcgctctcctcgggggaaaacagaccgagaaaaacaagcccaatccgtcatcaagctctccagttatgttagagcagaggtggccgcacttttcagtaaagggccaggcagtgcgtctgttagctctgagggccactggtcattctgtgaaagtggccacagacaatacacgaaccaaaaggtgtggctgtgtcccagtaaaatgtgattgtaaagtggttcgctgacctctgtgtcagagcatttccataggcgccgtggaagcaaagcgggggagtccagttaaggcggatctgctgcgcctggggtgggaggatgggaagagcaggttgaacttcagagtaaacttcatcgagaaggtgcgatttgagtaaagacgggacccggagggagccagctgggtgggcacctgcaggatcccagggcattcccagtcgagtgacgcaggatgaaagcccacggcatgttctggcacatccagagagcaatgcagctccaggagacactgtggggagagagggacgcagtggggaggcctggtgaggacccctggctctcattcccagtgaaatgggcagtggcggggagtgagagcagaactgacaacatctgaagtcctgctctgactgctgtctgggacgaagctcaggaggggccgggcagactccaggagagattagactattgcagcaaccagggcaggaggtggctgtggcttagttccgggcggtcgggggctggcggggggtcggggggggggggggcgacatttcctgaggattgtaagagaggcgtgagaaaagagttataacacctggaaggctctgcgtttcctcatctgtggctggaacaatcactctgccgcaggattatctgaggatcaactaagttgactcacgtaaagggttcggcacatgcttactacttagccattgctcagttcatgtaggtagtgtcgttattgtttattatgatgattatggagttgttcaaatctagatttgactctaagctaaatcacctactagccagaggatcttgaaaatgttcgtaatcttggagtctcaattccccacgtatataaaatgagtttaaggcagaaaatggggaggcctctctgcatgaatggttcctcgcggacacggtaagttgttactgggtctgactaggtctcaattatgtgatcaccactctcttggtgcccctctccggtgttattctgtattctgttgagttagccatgttctccccaagtctctttgggagcagactgccctgcagtcaggccacagagctctggagtcctgtggactccacactcacggtgaagtcgtgggtaagaaccaggtgacgctccgcagaatggcaggctccgtccttccctctgaggagctgccaacagtgtgtaggtggaagaaagtgaattcctcctatgcctagctccctttcaaaaggcatttaatttcctgtgactgatgagagagtttgtatttgaaacggaagcctcttaatttatagcccacaataatagagtctggcaactacagaccctcccggtgctgttcagcggctgccctgcctgcggagaccctcctctggtggagaagcataatgtgcctttcatgccttttgcactttggggcttcatcaggaaaagatgaccttactcagttaaaaaaaatcctcttcatcagatgtgcagtagctgtgaaacatcaagaagaacacatgccattgaagggtgacacctgaattacctgccattttctatttttcaaaacagtctcagccaaaaggctagaagtgaataaataattctaccacgactcctctaaataagattttagcactctgttatttgcttcgaacaggagatcagagaacatttgagagtggcactttgcatttgggacatggcacggaagccgtggctggaggccaaggactgtctcaggcagaaacctttgcctggggcctcgggtgcatctaaacagaatctgggaataaataccaggacctgacacagagcgcccgagaacacagagactggccgctgcctgtgacaaacaacgctgaacaccctccagccttccggagaagggtgcacggctctgacatctggggagaaaatgctggaaagagcctcttctgcaaaattgtgcatggagattgagagcatagtgtcgagtttccaccttgttgagagtttgtgctccagagagccatttgcagcaaagaaagagagaagtctgaattaaaatgacaccagtaccctgccctcactgaccctccccacctcggcccaggacacagtgctgtcgaggagtttcacgtcccaccgctctgcctggctgcttctctcaggcaccccttccttcctggagttatcatctctttctgccacctctgcctcgcttccctttccacagtctcctcttcagaaggcaggaaagagaaaggaacagcagctgggtgaggctcaccctgcctgacttcatgctgtaaatgctccctgtcctctcaggaagtttcccttttaattaaaaattgcatttttgaatgagcttcctcagagctagggagctggaacatctcatttgtgtggcattatccttgttctcaggaatggccatgtggcttccttctcagctggactcctgtgggaagctgtgaacagaaggcgccctgagacgtgctcaggtgtccctgggacccggtgcagcccatgcctctgtgagcttcatctcatgccaacacccccagttcccaggctttcctggcccacgctgccatcccaccatggccagcgtgcccacatgagcccgccaggttccggccttctcccccagttctcactgcagcatgcccacttggcttccattcccagctggccagatccctatgtcctctctgatgtattcggttactctgtgttgatgcactggcgacctgctgcagctgtcattccctttgctgcagtatgtgtatatgaattcttcttctaatggaaagagactcaggaagtgaagggaaagcggagggaggacaggaccctggcagtggaacaaggaacaggaatgtcacggggagtcttacagaccctccagaccgtgccctggaggccagtgtccgggagacagtgggtttccacaaataaatgggaaggggtcccacgaccctaaatgcacattcctccgcccctcagacttccacgtacttgacctcctggtgttatttaggtgttcagaaaaggtaatataatttccaaaggagctgaatttgctgccagaataaagctcaatccctgcgagattctagtccagcagtcaggaaggcaggcaagagcagacagagcctgtctctgattactgttccttctccagcacaggccacagggacacgtgcatagctgctgcttaataagctcttgctgactgaatgagtgaggaaggaatgagtgagtgaaggaatgagtgagtggaggaatgagtgaggaaagaatgagtgagtggaggaatgagtgaggaaggagtgagtgaaggaatgagtgagtgaaggaatgagtgaggaaggaatgagtgagtgaaggaatgagtgaggaaggaatgagtgagtgaaggaattatagaatggaggaatgagtgaggaaggaatgagttagtaaaggaatgagtgagcggaggaatgagtgaggaaggaatgagtgagtggaggaatgagtgagccgaggaatgagtgagtggaggaataagttagaaaggactgagtgagcggaggaatgaatgagcggaggaatgagtgaggaaggaatgagtgagtggaggaacgagtgaggaaggaatgagtgagtggaggaatgagtgaggaaggaatgagtgagtggaggaatgcgtgagaaaggagtgagtgagtggaggaatgagtgaggaaggaatgagtgagtggaggaatgcgtgagaaaggagtgagtgagtggaggaatgagtgagtggaggaataagtgacaaaggaatgagtgagtgaaggaatgagtgagtggacgaatgagtgagcagaggaatgagtggaggaatgagtgagtgaaggaataagtgagaggaggaatgagtgagtggaggaatgagtgaggaaggaaggaatgagtgaggaaggaaagagtgagtggaggaatgagtgaggaaggaatgagtgagtggaagaatagtgaggaaggaatgagtgagtgaaggaatgagtgagtggaggaatgagtgagtggaggaatgagtgaggaaggaatgagtgaatggaggaatgaatgaggaaggaatgagtgagtggaggaatgaatgagtgaatgaatgagtggaggaatgagtgaggaaggaatgaatgaggaaggaatgggtgaggaaggaatgaatgagtggaggaatgagtgagggaggagtgagtgagtggaggaatgagtgagtggaggaatgaatgaggaaggaatgaatgaagaaggaatgggtgaggaaggaatgagggaggaatgagtgagtggaggaatgaatgagtggaggaatgagtgagggaggaatgagtgagtgaaggaatgagtgagtgaaggaatgagtgaatggaggaatgactgagtggaggaatgagtgaggaaggaatgagtgaggaaggaatgagtggaagaatgcataagtgggggaatgagcaaggaagcaatgagtgaatggaggaatgagtaaggaaggaatgaatgagtggaggagtgagtgagaagggaatgagtgagttcgcagacagacactgtgttggtctcttaggcatccctgtcgccatggcccccagactctctgactgtattagtctgttctcacactgctaataaatacatacctgagactgagtaacttatcaaggagagaggtttaactgactcacaattccacatggctggggaggcctcacaatcatggcggaaggccaatgagggagcaaaggcatgtcttacatggcggcaggcaagagagcatatgcaggggacctcccctttataaaaccatcagatcttgtgagacttattcactaccacaaggacagtatggggaaagccacccccatgattcgattatctccacttggccccactcttgacgtgtggggattactataattcaatgtgagatttgggtggggacacagccaagccatgtcactgacctagagcctccagggtctcatgagtaaaaacagaggccctaaatcctgcctcacagtgaaactagagtttgccagcatcccagaggccctgcactggtttatatcaccgctgataatattaggttttttatctgaaaaataaaatctactacagggaagcaggatgagtcaactgccttccttccacctgaggaaaccggtttcaggatgaaacttcctgtttagccagattttgtaaacatgatcaaaccatcgagtggccctttctgttattcttatgggtaggtgatgagttgctttgcttggttttaaggaatcccatatcattctgaggattcaacgttctgcccatacctgaggctgctgccatcaagccccttggcgtgccgttgtcatgagcaccaatgatgcatttcccatggcactgttgcccctccctcacagtgaccccgattctcttccctgcatcctccccatcctccattccatgtttccccaactccatctgcttccttgtaaccaacgcatggcccacgatgagcaccagaatggaggaaatagctcgcccttcccctctcgctgctgtgtgtgtccagctcagacccgggctccttagagtatctgccaggagcagggccttaggggaccaagagcttgctgtgaaacctgaaaagctcaaaccagcagcccccttacagttggttgggaagccctcatccttacttaaaagctggtgccactgttcatagctcagggattgtacgtgcttcccccaggccaggaaaggactgaaaaagagctgggcccagtgggtatgagcggggctcagcatggcgctcacatcaaccaccactcccagatacactggaggaggacacagcaggccaccagctctgggacaagggctaccagctgagacatgctcgtactctcactcatgttcactctcattcagattcctggccacccacctgccccaggccccctgccacaacttatgcaatccttccccatccccttcttcaagggcagcagacactcaaaaaaagtgccagaccgctgacccagcagatgcacgggctgcccagagcctacacctatgatcttttgcatcctagcacaggtacaggaaaggtcactgtgcctggcttagcacttttattcatgatacacatgagacagaatttaatcttcctgtttcaaatactccctgaaatattttccaattctgcttctcacctgaaaagcaagacagggtaaactttatgagaatggatctgctactcagatttatatagatacatcacagttctattgatctgaggaatgctgagaaccttgggaattaacagaaggcagactgccactgggcctgcgctttcttcaggccggtgctgaaggggttgtcatctaacagcgacctgactctgaaagaacactgggtttgcagcacgtgacctcaaattgggtcttaaattcttattccatggattgctgtttattgcaaaacatcacaccaaggttgggcttgctttcatttttatagtgacggccttatgtgattccactgaacattctggcaatctaaaaatatccagcaagcacaccactttcctttgaactgagaggtgctgtcagtaggaaagctacttgtctatgtcctgagaaaggggcactctggaaagactgggtccttccgcattttatgtattagtgtcagcacactgcgtttttgtgtgccatttggtaatttcttctggaaaatcctactcagggagacatatggccgttataacctggcgctttagagaacacacaatgctgtcatcgtctcagagattttctgtccaaaatgcttgtagtaatgaagagtattctcaaccattaccacagagtttaaaaatgtgttctcctggccgggggtggtggctcacacctgtaatcccagcagtttgggagtccagtgcgggtggatcacaaggtcaggagttcgagaccagcctggccaatatggtgaaaccccatctctactaaaagtacaaaaattagctgggcatggtgatgggagcctgtagtcctagttacttgggaggctgaggcaggagaatcgcttgaacccaggaggcagaggttgcagtgagctgagattgcaccactgcactccagcctgggcaacagagcgagactctgtctcaaaaaataaaaattaaaattaaaatgtggcctccttaatacagcatctgcaagtcttgctgcatgcttgtgaattacttggggggatagcatataaatgggcaaagtccacctcattttagataagatttcattggctatttcctaatgttttattttaatgaaataatgaaaagagatgtcattgtggattcttttttaatgcccatgaatggtttctagtgacattgtatggggacaaaacatacacagcagatcttgccaccaacagcattcccacaactgttttcttcctgcagatcctacttgcattccacacatgtccactcccggtatcagcctcgccgaccccctgacccatggcacaggctcatcagccctcaatattgttaagtggaaaaatgaaagagtttttattattacaaaagtaatacatactcattagacaatgtcagtaaattgtaccaaaaaaaaaaaaaaaaggaaaacctagaaaacaaacataatcccacgtggctggacatgggatttttgactcattgctgtagagctttctagatacgttttacatgtatacgcaaacccacatgtccgcaattttaacagagacgagtttatgctgatgggctttttttttttttttttttaccagtttttcacccttaattgtgtgtcacaaacatctttgcatttctctaacgccatgtttaatgatgaccatttgtcagggtgtgccatgacttatgtaaatgtgtatcttgcggaatgatgataattttcccacggccgaatttttcctgtgttcctgacttttctctaaaaagaaaaattcctagaagaggaagttagagagtcaaagcatgtgcatgtttttaaagcttttgtcaagcctgtccatgtgaagagaccaccaaacaggctctgtgtgagcaataaagctgtttattcacttgggtgcaagtgggctgagtccaaaaagagagtcagcgaagggagataggagaggggcagctttataggacttgggtaggcagtggaaagttacagttaaaggaggttatctattgttagcagaggaggggattacaaggtgcatggtggggagatcataagactcattgtccgaaagaagaatgtcacaaggtcaactgatcagttggggcagggccagaacaagtcataatggtggaatgtcataaggttggtcaatcagttatggcaggagctggctgtttcacttcttttgtggtttttctttggctgcttcagacttcttggctcctgcaggccatctggacgtatatgtgcaggtcacaggggttataatggctgagcttcgactcagaggcctgacagctttgcatccaacacttatcctcaactctaagaagtacctttttgtgtattttaacatttctgaaatcaggatattgtaaattgatgtggatgtttacaatggtagtatgatggagcttttctttctttggtcaagccactattaaattgaaggtgctttttaccattaatgtcatcttagaatggaggcatttcagtcctgttaaattacctcccagcaaacaattgtgccagtgtgcagagcctcccaccgagtgcagctgcccccttccccagcccctcccttttcagctttgccaaatgagaagcaatattgtttcttatttatcaagtcagtgcgtttctatatttatgactcactcatgattaattaccattaacatctctcttagcagttataattttggtatgactttttgttttccatgtagattatgactctgtaaaaaattgtgaaaccatatttataaaaatataaagacattttaatgacaaatatagcatactcattatagaggcttttatgtaaatataatttggtgatcttaatttgaaataaatcttaattaaatttctctgaagtcccattttgttaaaaatatccaacgagcctaaaccttggctggcctaagctcatgatgtttccaagtcagcaagaagctctgtccttacccgtagcagcagtgccgagacgctcctcttcagttctgtctgcatttccaagtccatcaatgatggtgcaattgtgttgacataattcattgcctgagaaatgcttacagatttgcaaattccagattgtggtaacatgattgaacatgactcggcgtgaatcactgattgacagaaacaagttgtatgtacatttgaaatgcttgctcatcactgaacacaaagagagaaggatccattttgcctgcagagaatggaaatgactggggccaaaggagtttttgttgaaagtcactgtattgccattaacccaaaacatatttccttcgggctaatactaagaagccactttgttgtgctatatagagcattgcactcaaaatcctgtggttactgatattataaagcagaacttagggtaccattcaaagaaacaaaataggaagttcctatcaagttacagtgattgaagcatttaaaaagtttctatatactgagcagacatctcgccctaaaagaagaacttgaaagcaaccaccttacgtttttggtggatttgagaaaaatagctaaaatgtgcccatagtggatcagcacccttttagataacatcaaactaaacttcatgactttgaaaaaaattgagaaaagtagatgctaagtgggaagattttactgtaaaccaacacctcaaatcaagtgtgtgtatatatatatatgtatatatgtgtatatgtatatatgtgtgtatatatgtatgtatatatatgtgtatatatatgtgtgtatatatgtatatatatgtgtgtgtatatatgtgtatatatatacgtatgtataaaggaacaaaacataaagccaggagattgtgagggtcatttccatccacagaccaatccccagcttcccttatcaggttctttcccagtgctcttaaggaggtgggtttactcccatgctgagccagtgtcagatatatgtttattttagatccttgaaattaacttgacattcctcttcagcaaagaaaagcatcattttccaaattagtgggagcaaaagtctactttaaaagaaaaatctatttggactgccaaattggtaggaacaggcatagacttggcagttaacccttctgctgatcccctgttgccacttctcaaatggcccaacgggtacgagacttggaacacgagcctgcctggctgtgagcactcatggaccctcagtttcccttccctttctcctggaagctggcccaaaatgctgattatggtggacccaaatttatttatttatttatttatttatttatttatttatttatttttaatttttattttattttattttttagacagggtcttgctttgtcacccaggctggagtggggtgcaatggcacgatcttgggtcactacaacctgcacatcttgggttcaagcaattctcctgccccagcctcccaagtagctgggattacagatgtgtgccaccatgcctggctaatttgtgcattttcggtagagacggggtttcaccatgttggccaggctggtctcgaactcctgacctcaattgatccacctgcctcagcctcccaaagtgctgagattacaggcatgagccaccatgcccagtcagacccacttttaaacagcaattttgaaaaagaggggcatgaacacaggatggcaaatgacgactaatgacttttcccccaaatcccattgtaaatcttgtcactgtgtgaccaagcctatttcacccactgccatttgttcctggcccataataaagtaaaggcctgtgagatatttggagagataaatcagcattcagtttaaagagtcagagctggaggagaaggtgggaagcaatgttatcatttagtctatcttcctgccttcaatgaaaatataaaacattaaacgtatatcagaccatcccagtaagagaagaattagtccccctttttatgactttacagaaacatatacttttctgctggaactccattccattgcagtatttacggcttcgcattctgtttttagaagtatgttgctaccgacttgaaagaggatgtcaggttctctgtagcaataaaggggcaggtgtggccatctgtgccatttcagtgacttatctgaataagcatttcaatccttagaaacagagccttcccatggaaaatgcttgattttgacttgcgtcattgtgcagggagtgatatacaccatgataaattttcctgcagaaaagtctttctgaacacagagccatagaaatgaattcttacagataatgtaaacttagagacaccctgacacatttttgttctcttaattttgaatcttaactaaattttgcagatgccattggggtcactgagacaagaaactgcgttcagtggctcatggacactgatgatattagctcaatttatagagttgtcttgtttgcgtcttgatgaatcttgtttacccttcaagacacaaagtgtcactggggctgtggaatttggacagactgtccagggagagcaatcatctcctcctctgtgactgctctaacctctgtcatcccgtctatgcgttgccacacaattttctgtctaggtgcctgtgttcttctttcttttcttcctagaataaacctttattaagctcctactcagggccaagtacttagatagcagctctcagaacacatggggtgagagagctgggaacttgagtctagtagggatgatggataaggaaatacccagtgcagggtggagggatttaggatcaggtcagtacagagtggtgagaacacacaggagaaacagcaaacccaggcctggggtcagggaggtttgcccaaagggatttcctaatggggaatcagagtactccctagaatgatctctgttgctacatggaataccacagactgggtaatttataaagaaaagtttatttggctcttgattctggaggctgggaagtccaagagcatgatgctggcatctggccaggatcatcccacagcagataggcagaagggcaaaggcatgtgtgaaagagagagaaaggtttttaacaaagctcctcccacagtaacccactcccacctcacagcattaatgcattcatgagggtggagccctaatgacctaataacctctgaaagacttcacgtgaataaaatctcagcatgagttccagagaggccaagcattcaaaccatagcaatccctattccaagtcatctaggcaaaggagggctagggagaagataggctgaggagcagaggataaaagcgtggctctccagagagtgattctcacagagatggggcagagtcattacgtgctcctgccctgaggccctgcactgccagagagaagcatcctctcaacaaatgcttgtgagataaaggaatgatttgatttggaacaataaccgaccccatgagcgtttttccgtttctccacaggacaacagtaaagggccctttatgagctattagccttttgaaaatttggttctcatcacagagatgggatttcaaagaataaggagttagatcattgttattatcaaaacaatctggcttttttgtgcttttttagtgtttgccatgatctatgtcgttaggcaatttttaaaaatatagaatattaggtcccaatattattaagagagccagaagaaaaaggggcagtattctaccctacagatgatcagctctctgagggccctgcagttctaacagtctgtgccactaaatcgagagggaggaagggcgcccagcactgagaacagttgatgcttcactctccattgttattcagctttgcaggagttcaggaaatgccacctcaaaatatgatgctttggtgtgctgactccttaacagaggacacttggggaacagcaaattcggggagggcctttctctgaactagcttctctgcaaatacaattgatggatctcagttgtcgtgaatcccctcccagggaattgtgtcagccggggaagatgagtacgtggacaccatgcctggagagactactgcctgttctgctcagggctgctcggagacaacttttattacctgagagattgtttatctacataataagacaacctttattcaccatacaattcctctccttgccctcctctaacctcctccccctcacaagaatccccaagcccctgttcttttctgtatctaggatatagttctgtaggcttccatgatctaacccttcttggagtctcatattctgtgggactctcatgtgtacagaattgaatatgctctttctcctgttaatctgtttatatgccattttaatcaatagcccagccaaagaacctgggagggtagagggaagccatcttttgctcccccacagcttccagaatgtctctcatgttatgggaccaaaaagctatttattagtagagaggcagcaatgtctgtggcatttcctcgactcacctgagatccgcgcattatctcagccgccctgggacacagtcacttgctctttagctgtcatttaattagtttgctttctatgtccttagcaaagcaataaaattgagagagaaaaagaaaacttaggcaggggaagagtcttataagtctgggttttattttataatttcataagacactgcaaggtgtgcatgttgctgggagatagcatttttcaggtcactgaaggcatttggcttcacctcctgctcacgacccccgaggcatgagttatctttggccaacaggcatccagaggagcctttagagcctggcctgccactgagactgtcagggcggtgatgacaatcagctctctaagtggttctggctctcaccattgtctgatagtcatggcagagatgcatatcgagaggataatgtgggaaatgctctcaccattattacccagccccaagctgggaaccttctttaagaggccttaagaatataagtagaagcattaacggcttccgctccagagattggtgtgtgaacaaacatctcagacctctggatctctcatcttctctctcctcctttgagccagaacattcatgaataatcatttagggcagaggttctgggccagaaacatctgagatccagtccagcccccggaaatccaaatgcagctgtctgagaatctcatggagagacacaagcctagaaagtgttcaagacatttgggggatttatttcagcttctgtcattagtgtgtgcttaacttcaagggtgaaatccagatcagtactctaattttttttttttggtggggagtggggacagaatcttgctcttgtcgcccaagatggagtgcagtggcacaatctcggctcactgcagcctccgcctcctgggttcaagcaattctcctgcctcagcctcctgagtagctgggattacaggcgtccaccaccacgcccagctaacgtttttgtatttttagtagagatgcggtttcaccatgttggccaggctggtctcaaactcctaacctcaggtgatctgcccaccttggcttcccaaagtgctgggattacagatgtgagccaccatgcccggccaactctaacttttaaaattaattctttggtgctaaagcaagactggcctttggtagggtggatcttctcctcaattccccaggacgtgactgaactatcacaaatgaaagtcctgttgctaaaaccatgcccgaccaagccttccagcctgatactttacatgcaaaaacaggtgtctttgagccaaccttctttgttggctaaattaagagactgcaataacaccaggccaaaacttacgtgaatggtggatttctatgacttcgtgtttattaagctcattctataatgaaggatggtgctgcagccatcagaaacagatgtttgtttgcagtgtactctgatcaacagtcttccccttgagtaatggcctggacgctatctgtccctggtccaagatttgacaaagtgtgcaaacaagtaaatcagacacagtgaaagttagcgataacccaggacagttcttattctctggctttctttaacaaatgactcagagtgtgtggcagaaaaattcatatgctctcactgcagggcagttacgcctcatattttctttaatttgactgattttctgtcccctgcagctcttttcttcaacacagtgtgaagtgaaactcatatgggtcgtccaaaggctgaaaataaacacagcatcctttattcgaaaaaaaaaaaatctgaatttctttgtcttagaatacgtttaattttcggccgagcgtggtggctcatgcctgtaatcccagcactttgggaggctgaggggaacggattacctgaggtcaggggtttgagaccagcctggccaatatggcgaaagcgaaaccccgtctctactaaaaatacaaaaattagctgggcgtggtggcacacacctgtaattccagctacttgggaggctgaggcaggagaattgcttgaacctgggaggtacaggttgcagtgagcggagatcgtgccattgcactccagcctgggtgacaagagtgaaattccatctcaaaaaaaaaaaaaagattaggtttaattttctaatcttccccatgtccccagctcacctcatcctactttcttctaaaatattggaggtgttctgtcgcttttgttctgtggacccttaactgaactctgcatcgtgcaaggagtcctcagacagcagggtccttgtagacctgcgcagtccagcgtggtggccagcatggtggccactagccctgtgaggctcctgtccaacatggtgcccacgtgaggctcctgagcccatagaatagggctagtcccaactgagatgcattgaaagagtaaaagcagacccgattccaaaagcttagtaaaaatgaatataaaataactcattaccaatttttatatcgattgcatgttgaaatgatacaattttgaatatatttagttaagtaaaatattgaaattaattttacttgtttctttttcctcttttcatatagctactagaccattaaaaattattgctgtttcaattggacagcactgttctaggctgtatcctttcacggtggtttcaaaatcaaaaagacaaaagtgttgcagaattacactagcagagtgaattacactagaatgctggcatcatccctagcactgggattggtactttctgggggctatcatttccagcaaactccattggtcccagttcaccttcctcttcttactgctgaaacgggagagttccctgacccaccccggttgcaggacatgcaacaggcatatggctcatcagttcagccaccaccactgctcaaactccttatgggagggggagcatgcagatgagcaggtgcaggagccaggacgagcacttctgggctctggccccacagtagtgtctagggatgggtgcctgtgactcccaaagcccagttagctgtgtgttacagtgcgctcttttaattttgctgtctgcagacagcttaagtgttaaacagctcagtggaccctctgcctttttgcaagggcagagggccagtgtgacagctttccatattccaagttcttgtctggcatccagaaaaatcaggtcacccatggacttgaaggatggtgactgcagggttttattgagtggtggatgtggctctcagtgggatggatggatggggagctggaaaggggatggagtagaaagatgatcttcccctggagttgggccgtccagcagccaatctcctctctaactgtctgcagcagaactcctctcgacattcagatattccttctcttctctcctctgctgctcttctgctcatggagcctggggtttggagtttatatagggacaggataggggggcatgacaggccaaaaggcaacatttgggtgtgaaaacaggaatgcctgttcccatttagggccatgggtttccaggcttgagggtcaggcctttgctggggaactgccctcttctacccaatatttccctgtctcctgtctgtaacctcctcatctcctcactacaacctgcacctcccaggttcaacactgtgctcccatggaacctcacatccatcatatgatcaggacacagctgactgtgaactctgtgaggccatgaagaatggccagtgccttaccattcacacacagtacatgcttgatgagtacttgtggaatggagggagcattgggtagagcaagggagaggtgaattgtgactcctctgaaactggaaattacatacgttctgcatctttgcaggctccagcaatgcacagcatacattctgagtggagttcctgagtaggaacttttggttgaatgaatgagctagaacagggtctctaaatggtgcatacaagtcactcggggatcctggtaaaatgaaagattctggtctagtacttcttgggtggggcctgaaattcgggttttctgacatgctcctgggtgatgctgatggtgctagtctgggaaccacattctagggaactaactagagccagtgctgtgatgtgaatttagttatcaacatggatgggcgtcccttcaattcatgtctcatggatgctccaactgacagtaactgtttcagcctcctctctatctgtgactctcctctccccctagactccagaagattcagagctgctatggtgctctgttaggaagaccaagggcatgggtgtcatctccttgagaaaactctctcatcaatgtgactctcctaggattttgctgcaaaaccttatcctcctccattgaaagccataaacctttgagtgtgtctccctagcctcgactttctctgggacttcactcccatcctgccccctctctggctagcgtcttcattctctctcttttcatcatcttttgctgttttcaaactgattcagagctctctgttgtgaagccttttccaccccatcatgcctgtgatcttagcctctgaatctagctgaccattgaaccattggaccaaaattatggcctccgaggtcactaaagtactttccctggcagaaagtcttagttattcctcttgtactcaggattgacctctccattctcagtactgggtttcctcagcactgtgctatcctcttctgcttctcagaagttgaggcttttccagctactactgcttgtttattctgcaaaggtttgatgattgccattattctgttaggtccttgcaacttcatgataatcacgtggaattagaagtgacttgaatttgaggtgactgcaacctatccaaatggaaatatgcaataggcaaagtgcatcttaaaagaggagttgggaagggtggaatagattttgagaagttgttagaagagaggcagtcaattaagcttgatgttagaatgctccctgaaggggcaaatgtgaagggcagaaaaacaaatgctatctccacgtgctcttacccactgacctcaacccgcctggatctcttctatgggacccttaagacttacacaagaatactcaattcaacccatgattgtgcattgtatcatggagtacacaattgtccttcagctcttttatgctttataaacatccaccttagctgtaagctacttgactccagcacctggattgccacaaagagacactgatcacctactatgttctagcacctggatcttgggaagacaaagatgaataagatacaaatcctatccctttagaagaggagataggtggagacagtttcatatagagggtgaaacagtttaatagaggtatgagtaagaaacagggcttgggaagaaaacaccttgatcattttggctgaggctgcaggggaaaggggccagaacaggtatacctgcagggcacctatgagactgctcaacatacaataaagggttaatgtatcattttgactgattgattgattgatcattgaggagctgcaaaacctccaaagacaaaagtctgtaagatgtgctggcagggtgtccccaaacatgttcaggcctctttccaaagctggccttgccccaagttgcccagggcgggcccaggtattcagggaaagcatttcgcctcccctgctgtgctagagagcataaggatacccacaggcacatgggacaaattgggctcaaattgccatatggcttggatttcacatttttactggcgtagcgtaatcatttctacagagtctagtgccttgctgcagattgtaaatgataaggtcacgaggattagggaccagttaaaaattatagaagacatatgctgtgcgttttactaatgaatggccatattcaaacatgttcactaattaatggcaatatttgaatgggcccactaatgaatggcgatgtttgaaagtggcattgaatttgatactctgtgaccagtgctccagttctagaaggagccaactgctccataaggtctgagaaatgctcattttaaagcaaaattgggcaggccttgcaggatggtaaagggaattctcagttagatattgaaatttgcccgccaagaagtttgtttagatgaacaggatggtgtgaacatatcattgaacaagagttccagcttgcaaccaggtcctaccttagcctttgggaacaaggtaagccatgacacaaatgccagagctggggaccttggaagataaggactgtccccataggaattgttttcagaaatggttacagtaaagagaaagtaagaaaagaagcgggggattagggaccgagagcatacagcactcccaccccagcttcccctgtcctctggcagactgctgcagtcaggtcacctggcaagcgtcactgagagccaagtctgcaaagctgaggctcacgacacagccacaagtgagggaagctgccgttcccccattcactgtttctttctctctaacctggacctctaatttgttggctgtctgtgtttaaagccgctgagcttaaattcattacaagtcctttcctggcaggcgggccagattcaggcccatcagaatgagacgaccagctccatgtgtgttgagctgaggaaagtcagagtgagcctgaccacaggccactcctgacccagctttggctgtgtagacaagacttaaacgtggtcagagtaattgctttggctaggaacacaactctgtggtgacaaaacatgtataaagaaggtcttagcaaaagtgctgggatgtatttgatattcttttaaagcagcttgacaaaggcggtggttgagaccacagcgtgttggggaagcagcttccacccaccttgctgctaagcctgtgactgacaaggctcgcgaaagcaatcaaaatggaaagtccatatgcccttggacccagctatttcatgtctagaaatttctgctacagatttcctttcacatgtgtgaaatgacctgaagagcgggacattccctgcagctttgtttgtcatggcaaaatattggaaggacctaaatgctgatcggaggggctggtgaaatgaacgaaggcacatctatccactggaatattgtgtggctgttcaggaagaatggagcagctctccgtgtgctaatagacagccatctgtagcatgcattaaacgaaaaaccaacaagcagagtacagcacattatacaatgttttatagggtatttttgtttaaaaatagcataaattgatgattgagtgcagaacatatttctggaacaatacctatacaaacaggtgacagtgattgtctctgggaagctatgtagctgaccaaggaggaaaggagacatttttcacaatgtaccttttgaatctgtgctacctgcacatattttgcattcaaagaatacctactttttaaaaatccatgactctgcaaatgatatttcagtaacgctcttaaagaaaagaaaaaaataaatggccaatacacatttttaagtttattttccctttaagttatggtaaaaatcaaaactattttggagtaggaagtaaatgtaaatgtctttgtccgtaattatagactggatagttaattcccagcagaaccattgtcaggaggaccaccttatcatggatcttttaatgtgaggtgctgaggtcagcctgttgaaagtaagctcagtgggtcttttctcctcattgcatgaactcatcttctctgaggggccctagttctgagacaggtggtactaaagtttcctactagacggtactcatagtgagtgggtcagtgcagactgcacaactgaaagatgggatggttacgtgcacgcgcatgatgatagatgttggtgtaagaaaaggggattttcggggatcttttcagagcttgcaagaatggaaattaaaccaaagaaagtaaggacctgttcaaagagcaaacctaaaacaaaaataagcctagggctgcagggtgttggaggtcacaatattttgtgggaaactaattggcattgtttaatatccctggggattagtacagaatttgtgaaagacaaaggaacgtgggtactctacagagctgtatccagcctcctgaaaattctttctttttagccctttggagaccacacatagaacactgtcttcgtctgtttgcatttggagcttagcacagtttaagattgcctcacaccatgagagtctgtgattttaagatgttgtgtacttgaaaggaaataaccttactttcttcttttcaaaattgtgttttaatgcattataatctaacaccatctccgttctgtggcactgtcttgtcagaacgagttttgcatatatcagcggctggtgactcatagggagacttcctctcttgatagattccctttacagaggctggacttacgtatctctgctgccatcttctggaaagctacacaccaaaaagaaaaatatttcatctattcccaaagaagtacaaatgtgtgcttcatgcctttgatgtttgccttgactctagtaaggggtcctaagatggtatttgatcctctcctattcttttaacacagaatttcagagccgtggaagaaaaataaatgcacataatagaatgcttttataatagatgcagccatgatagaaaacaggcacaaagaaatcttggcttccatagagagatcatcatcaagccttattttaagggtcattgcttgtaggtacctactggctctcaacctgattgatcagcagccactggaatattccgattgcattagaagctgttcatttgcttccttttcatgcttccacagagaaagtacacatacagccccttttgaatgtgttcattatggaaatatgggaaagcaaactcaaacatcaatcaaatgactactgcactgacatgatattgaatgagaggcatgatgggccattcacatagctctctggtagtacagagcgtctaagggggctgacagtgacttacctcagcatgtataccagcaaagagaggcctcatccctttctagacagcagtcttatgtcttatgagtagtttacaagtgtggcatttctggggaggtgtcagttttacccgagattcacataacagtcattattatcagtatactgggaactgctttaattaacaaggcgcttactaccctcttatttttctacagactcttaccacttgttaaacatcatagccccatggagaaaactatttgttgtgttgttgtgtttactgtgtaccagaaactgtgttaaatattctttatcttattatttcttctttgtagatgcaaaaaagctcaagcaaagagatgttgggatcacacagataataaatgatccaagaggcctcagactccgggtctctctacctcaaagggttcacttctaaacactaatctacatctggtatttaaacatgtaaagatctagtacacgatttcacagattaaaatgtgctattcttttatatgttgcctagggccaagattttactcatcctaaaagtaaatactcaacacatattagttgcaagacaaaaatatgacttcaatgttaagaatagtttagctattatgcaatagaaaaaaattggcttattgaatttagcctctattaaatctttttttttttattctatacctccttttaggcatttaggataagctgatgactagaattaagttaaaagtgtggcaccaagctctcaagcttgaaaacataccaaggagaatgtattaggtgaccatgtttattgtcaaatgaaaggaaaccaccacactgttggaagtggtgaactttctcctggtgttgaattctgagaggaatttgccatatggctacctggaatttatatatgtatatatatatagcgagagagagagagagagagaggtttgaactataattttgcaaataacagggaaagtttaaatagttttcattacatcagttcttttgcaaaagattgggaataaagtgaccttgttaaattttttctttttctttttttttggagacagagtctcaccctgtcacccaggctggagtgcaatggcacaatcttggctcactgcaacctccgcctccagggttcaaacggttctcctgcctcagcctcccaagtagctgggattacaggtgcctgccaccatgccagctaatttttgtattggtggttcacacctgtaatcccagcactttgggaggccgaggcaggcggatcacgaggtcagggttcgagaccagcttggccaagacggtgaaaccccgtctctattaaaaataatttgtttctataggagctttatcagccagagcttcaccagagagaccagaccagcaggatgcttatatcaaatatacatacacatacacacatatatgcatatatatgtgtatatccctacatatatatacatgcaggcacacattgtatctatatatctgtgtatacacagatatatggagagatttactggaaggaagtggcttacacggtttcagggctgggtaggcacctcctaaatccacagagtggccatcaggaagggcaggctggaactcttgagcacagcctgacgctgctgtccacaggtgaaatctcttcttcctcagggaaggctcagttatgctcttaggcctttccacagattgaatcagcccccttcaggttatctaggataatctctcttacttaaaataaactgattatagatcctagtcacatctacaagaaagcttcacagaaacaccaagattagtgtctgcttgagtaactgaggaccatagcctagccaagttaatacataaactctcgtcacagggactataatacagtccatgtgtttgattgccttctaaccaaatctataagggaatagactttagagagccaatgaaataagtatgtattattttatgattgtttaaagacatttaaaatttctcgaaaaaaaaaaacaactctacggaaatggatcacatttgttagatccaccacaagagaagacaatcctgaaaatgtatacggtataaacaggactccatgtttcctggtatactaacttccattcggttaatgttgactcataaggtttggagaggtattatgcagcttaagggagcctcagcaaatgtaagaccatttttaagtaatagcaaatccctgggtaaatttcagccttctacatggttggttaaagaaggatccaggcgccccagatatgagacatgcagctcagcagaatggatgtgaaaatgttggagctaggtctgctttcttccccggcaagctttttctctagaaacagctatgccatgggaagtgtttgcaaactggcccgaacactgtcttaagaaggagttttgtatctgcctaacccagagttccccagaattctgttccccatgcccttagcggttcagtacatttttcacggtatttctaggccaaaagaaatgcctaacagttgtggttatgaaaggttttgtaccacgtagcatagtaagaattaatgtcataacgacttaatagttatctgaaatgataattcacacaaatggaaggaaaaattagctttattttattcttaaaaataatcacgtcttggccaggcacggtggctcatgcctgtaatcccagcactttgggaggccgaggcgggtggatcacctgaggtcaggagttcaagaccagcctgaccaacatggtgaaatcccgtctttactaaaaatacaaaaattagccgggcgtggtggcaggcgcctgtagtcccagctactcaggaggctgagacgggagaattgcttgaacccgggaggcggaggttgcagtgagccgagatggtgccactgcactccagcctgggcaacagagcaagactctgtctcaataaataaataaataaataaatcacatctttgttccaaatggatgtttacatggtatttgttttctattctggtaacttccaaaagcccacctttgcaaagatacaatgtcaccaaaaggaaaatagcacaatctacattaacactgggaactaccttgagttaataaatcacatagtgttcaatagccatgctgtgttttacttaaaattctagaatatcccaggcacccctgtgagtttgttacagtaccgcagggcactctggtgcgtagtgtgagaactgaaggttgagagtcttgagtcctggataatgtaattgaaaacccaaacattttcaagatcaaatcagaccttctacattgcacatgagacagattcatgttacttaattgggaaggaccactgcatgatagatctaaatttaaattatactttgaatagaagcaaattagccagtgcctccctgtgaagtcatcaccggaatattcctgcagcatttgcttgccttttgccatgctaaagtggggaggctttcatttgatatgctcttccctttctcttatttctcaatagtccattctttgtagtactggtgtgaaagggaatttaatgtctttgtgtcaggaaaagcctatttattctgacaaactgatcagcctccagggtgttcctctaccatgaaactgattttatatctcatccacgagctaataagatgtgaacggttttccctttcacaccaacagataagatttgcttctctagaaagcagtgggctgagaccccattgccagttctccatgattgggcctcccgtccacatttttccaacaaagcatgtaagagcagaggaatgagtgtgaggcagacccaagtattaacagataaatgtttttaaaaataggagaaaatcctagaactcaactcactattcagtgaattcgcttttagttcagagaaaataagatgtcagaagctgaaaccaggtaatgttggtgatttgtgtaaggacgttctgatgcacacacgctgtcccaccaacctttaaataaagtttacatttcactaaatttgagttcagtctctctgctgtgagaagaaataagaatataatatgctaaaagtgatggcttgaagatcaattgtggcatatctctgaagagattgtttccttataaaatgcttttcctttttgtttctgatgtcctgagattaaaatacttttcagatgaacttttaaaacaagaaattggacgtaggaaaggagaaaactctgttcacatggtgaagacaacatgaaggaaaaatagtgttgagtaaaagccattcttttttgaggcaaggaggaattatggtatattttgggatagagttggttttatatcctggtttctattatttttgtttttcaattcaaatcagtcctgtcttaagcaaaattaggctaaattcctaacttatactataaaatattagtttgagaacttgtaagtctctgtaaatttttgaatcttccagacactactttcagcatattatattcttatttattactgtatcagttatttattgctgtgtaaaaaccaccctaaactttaatgatttcaaataacaacagtctacttggaatatgacccagtcacatagctggcaagttggtgctggctgtctactaaaagctcagacagggctattgttgcggctgaggccgcagctcttctccatgtggggctcccatgggctgttgagcttccttaccatatggcagctgggcttcaagagcaagtgtcccaacaggaaatggaagcttctggtttcttgaggcctgggcctagaaagtggtacaccatcatttctaccatattctaggagtcaagtactcaacacatctggctgtcagcagaagagacataaagcccacctctcaagggaaagaggatactgtcagtttgcctctatgctctaagaccaccaccatcatccacacaccatacttgtggatggcactctctcctctgctgaaatgccttctctgaatacagtttctgctgtgggagatgttgcctacaacttattaaagaaagttccattgaaagaaaccagttttctggtgaggaaactccttcctatgaaatggagtaggggcaaaatagtccctgttgttcttatctccttaaagtttagaacacattgtatgctgtgattgtagccactcagcatgtgctatctcactacctctcccaggggtcatatgagaaagctatcgctgttatcctagcatttccaaggtggaaaccaaggcacagaaaccaaggtggctttcccaaggtgtttcaggtggcaggggatgggatgatgactccagtctggtgtgttccactgctgatccacaactcaaccgtgacagtaacttcagagcatggctggtggcgatgagaatgggacgtgctttcaggagaggtccatggatcccagacagacagccctaaacgagcctctctggcattcactcttccagctttcttctttgtacgatggcgggtagagggcattggttccttgggcgtcttcagtcccatggtgaatgctgctcatcatctctcagtccgtgtgtctctgtcctaatctcctcatcttgtaaggacaccagtcagattgaagaaggcctcccctaacaacctcatcttccctttaccactttaaaggccctgtctccaaatacagttactttctgaggtcctgcttccacctatccattatgtgggggcacggttcagcccatagccacccatttctttttccataataggcttttaatacgaaagtaagtccactgacatgggcatataaatcttctgtgaatgcaaacaaatattgaatgtaaacaaatattaaagggaatgtcttgaatgaagttttttccttacattctaataccaattaaactttgctgtgggtatttatttgcattactgtgtgtattagtctgttctcacactgctataaggacatacccgagactggataatttataaaggaaagaggttcaattgattcacatttgtgcagggctgagtaggcctcaggaaattcacaatcatggtggaaggggaagcaaacacatccttcttcacatggtggcaggaaggagaagaatgagagctgagcgaagggggaagcccattgtaaaaccgtcagatctcgtgagaactcactcactatcacaagaatagcatgggagaaatcatccccatgattcaattacctcccaccaggtctttcccatgacacatggggattatgggaactacaattcaagatgagatttgggtggggacacagccaaaccatatcactgtgtcttccactagactggaaacatcttgagggaaggaaatgtgacccatcatctctgtagccctgctatggtgcttggaacactcttgagtaaagagtgaacaatcccatcaaaacataacttgatttctctttgcaaaaaaagtatttttatacagaaactgttgcacaagccagaggaatgaatataatgaatttggaaaaggaaaaatgtgttattgccaaatgcaacctaatgtccctaattaatggatgtgtgttcttttgcagtttgccttctgccgggaatgtaaagaagcgtaccatgaaggggagtgcagtgccgtatttgaagcctcaggaacaactactcaggtacagaatgccctactcattcctccaagcagggctccggatacagtgggggactggagccgtttcctggaggtcatggagagttccattctaaaaaagcaagaagcagactggtagctgacagccatgggaatggggccgtggcttctcccagaatgactcccctccttggggcacagtgtagacttcccagtggccacttggggcatgtccaaaatagcttttccctgggcagatatggaacagggacaaggcatgtgagcattttcaaaggagtccttagaggggaaataaaacaacttaacagtgtctaaatcagagaaatccatactaagtctacttcaatgtttttaatgccctagtttagaatctctggtgaaaatacctctgtgagtggcatgtacagaaagatgacattatgtaaggatatcattgtcctttagcagcatcatgccctatgctaactggtgtttcagtcctcattaagtaaagaatgtgttggccgagcctcactctctaaggtgctatctcagtcttaggaaagtgcaaatgcattttattttatttattaattaggatcaaccaaaccttcagggaaaaagagtaaaaacgtcatcacagtagatgaatttgctcattatttttctcccaatgtagatgttaacaagggtttaaacaccaaatctttgcaaataaatcctttagtcattgtactgataggaacctagtaaacagacatagaaatcccagaatattttgattttacaatagagaatgttaaagatctgaatgctctaaaatcagagcatgaataagtgtatccctatatggaattctgcagatgagtttatccaatattagcataactaaataaatagaactggtgaatttgggtcttctcgtctgctcctaaattgccagccatgagcatatgagtggatttaggactgagttgccatttccatagcccaggcagcaaatgctctttctgttaattttattttagctcagggacattcaaacgcgagcttaccaggtactgacagcaaaagcaataatggcccagagacccctgcctcaggaccgctgtaatggaggcgggtatacctgaggctctgggaaacggagttagtctagcaatttacatccatatgctctgagactgcaaacatggcagaggcttccacaaagtgatactctggcatctacagtatttatttggaaacagtagctgtaagggaaagaagagcattgcttaacctaaagccatccaggcgcctgaccctccctctaatcccattcattcttcagtcaagaggaaccatccagccttggtgttaaagattaaggtagcccaaattaaatgtttttaaattgttaaaaccttaatattggattcagaaaaataggaaaaagaaagttagagatgacctaaaccatagatgtccagcatcgggggaactgtgtctgcaaatagtgtcaattagcagacattaagttgagcatttgggtgggtcaagcagctgctagactctctagaaaaatgcattgaaaagtatatttcccggccgggcgaggtggcttatgcctgtaatcccagcactttgggaggccgaggtgggcggatcatgaggtcaagagattgagatcagcctggccaacatggtgaaaccccgtctctactaaaaatacaaaaattagctgggtgtggtggcgtgcacctgtaatcccagctattcaggaggctgaggcaggagaatcgcttgaacccgggaggtggaggttgcagtgagctgagatcgcaccactgcactccagcctggtgacagagtgagactccatccccaccccctcaaaaaaagaaaagaaaagtgtatttccctttagaggctcataggggagccatggggggagatttactggaaaatgaatatcgtaattacagtaatatgctaaaccaaagcttagcaactctatagctttatataaaacacttccaggtttccctggaaaagtcacagaagatgggtcagagttggtcaggacagcaggatggtgtggtaaaggacattccagcagagggtgccacatgggcaaagttgcagaagccagaacctcttcaaccagactgtgtcctctgttcccctgtgtctccaggcccaagatgacatctgctgcacagacatttaatagatggtttgttgagtgatggcagcatctataaagaaagagacattatttcattttttttgaaccagggtctcactgtgttgcccaggctggggtgcagtggtatgatcttggctcactgcagactccttatccttggctcaggcaaccctgccacctcagcctcccaagtaactggaactgcaggcacatgccaccacaccaggctactttttgtattttttgtagagacagggtttcagcatgttgcccaggctggggtcttgaactcctgagctcaagcaagcctcccaaagtactgagatgacaggcgtgagccactgcgccccatgagacattatttcattcattcaacaaatatgcattaaacacccgtaatatgttaggcatggttctaggccctcgggacaaagagtaagacaacgtccctgctcccatggagtttctacggcttcaatagatgccacagaggttgcacaagcaactgacatgataggaattctgaggaggtatagttaatccacatcagggtcatcccagaaagaactcaggatgaagcagccctgcagttagacccccccaggagatgaggctcttcctgcttctggttcctgatcacagggccagcctccaattcctcttatttgaaaacaaagcaaaccaaccagccaaactaaaaagatgtctgctggtgaacagttgccagacaacggaaagcaactaattggggtctttgctgccatgttttcctacgtctctgattcggtcagggtccctcgggagagagaagccaacccagatgggcacaggaggagatgttaatgaaagggatgacctgcagaggcgggctggggacacaggaaccatcacagggctgagggcctcagagcgagcatcactggggagccatgaccaccccaggcctgtaaaggcagggggaggaagagtcccatgaaccccatgagctgcagccatggagaaggggcctcatgacaggaggtgtcatcacggagcatccagcgttgcctggaagtagccccacacaggaagggagtgagcatggacatcttgcctcctgcctcctgccatccgatctcttgctaatgtctcccatgggccataccccaccgaagccagacacaagggatcctaggggcacagcccatgggagccagccttccagatgcaaagcagagaggggaaagaatacagaattaccagcaccttctctatgagcgaatttaccaatcttcccaagtttccttatttcaaccatagctgcttttggatgtgggaaggcacgaaccaaacaagctatttcttcaaatttcatgacccaattcgatttgataacagaatgaagggcttttattttcatagagctggcttattttctgttccctacatttctctcaagcagcatggtctccaggaggatgacctctgcagtttcattgacctgaaatctttgaaaggatgacactctacacatctcacaatgaaagcccaattgcagcctcccttggaaccgaaggctttagatgtgttctcacatctgaattttgctaataataactaaataccctcatcagccctcttcacactttctttcaattccattcagttgcagggttctttgctttgagccatttgtgactcgtttctgctgttcttccctttagcattgattggtttctgttcttgcacattacatgctccagccaggagagcccatttctcttgagtcccaatcagcttttcctatcagttagactgttggacctaaaacttaatgtattttttgattaatgcaataattctttaaagcaaactcaaaaattggctttaaattggttttaaaatattgaacaagctttacgttgaaactgctgggagtttgggaaagcagtgacagaagatcaatccatcacagactaacgagagtccagtcccgtttgctttccttgtttttccctgcttgttctcctccccgtgttccagttccttccgcgtattgcccctggaggcttgctaataactacacacttgctcttgcaaaagccacataaactggttctaggtagttgatgttcctctccctattcagcaggagtgcagactgagacttccagatttttagtggtgctctctaaagccgcagaagagatcaatttcagtggctatactttacctaagtagttggggatcagcaactgctctctctaatagatctacagtgtctgaggggaatgtgcccatgcctgcctaccaaccatgcctcctgctcaacattctaggcccagatcatgttacctcctcccagaagccatctgccctccccactacatcctgtaagctttcagacaactgtacattctgatacattcgtcacttgaaatatcgtttctctgtatcttcacaaaaagtctgggctttgttttgtttgtttgtttgtttgtttttgttttgattttttttttttttttttttttgagatggagtctcgctctttcacccaggccggactacaatggcgctatcttggctcactgcaagctctgcctcccgggttcacgccattctcctgccccagccttccaagtagctgaaactacaggcacctgctactgcacccggctaattttttgtatttttggtagagacggggtttcactgtgttagccaggatggtctcaatctcctgacctcgtgatccacccgccttggcctcccgaagtgctgggattacaggcatgagccactgcgcccggcctaaaaagtctgggctttgttagtggagggtttgtgcctgtcgcatcctgtatcctgcagtgcctggcacagagtaggtgctcattaagtgtttgttgaatgaatgacaaatccctccttcatccacacacctccctccctaccatgaagctgggtaagtacaggaaaagaatagacagtagcttcagggctggattatgtctcagtaatcttttgaatcataaaagaaaattagatttccacagtaaacctcagttccttccatctgcctcctaaattagaaaaataaacccaccatttgcttgggataaatataataatttgcttgggatatgcacttgtatcgtgcttgattacaaagcactttcacgtacaccatcttattctgaggcttatctcaagtttttgtgatagattttgtccataggcaagggagagggagggagagtggccacccaggggcatagagttgacaagccccagaccattattttacccaggtctttgggagctgcaccagccagcactgatgaccactccagtcccagtgaagcagaaatgcgcttccattgttcttactggtcactctgccttttgaaagagggggatgagtgggctgttgttggcttgtcaaacacaataccagggatggccaactcaaatgccaacagcaacacaacccttaaatgagtgaggcagagttgaagcctgcttcatggacctgtcaatattttgataaggatgcaaagataaatttcattttcttctgcttttcctattaaaacaaacagaacaacaaaaacacatcaacacaaaagcctgcaagcataatgacacatagccccatgctggggcgggtgggggtggtctgtggcaaactggagtgggcatggcttgttgtggggtgttggggagacacctgctacacagctccccagttcaggtccatgtttacccagcagaaatgtgagcccaatggtaccaggccttccagtgtgattttgtgatgtcagtagcataaaatccatgcgtttttgttaaatatctttatttttaaatgttgagaattaacatttttttaaatcttaaacacatctataagtggaattttggctgcaacgttgtgttacacttcctacattatgtgcctttgaacctcatttcaactgtgaatttcttataattagtggaaagaaggaagaagaaggatgctcagtacacatttataaagcaccttttattaccacgcatagtactaggcattttggatacaacattaaagatagacttggtgggaggctgaggcaggaaaatcgcttaaagctgggaggtggaggttgccactgcactccagcccaggcaacagtgcaagactctgtctccaaaaaaaaaaaaaaaaaaaaaagatagacttggactttggacttggccactgttctcatagggtttgtaatctagtgaagtagaaaaacagtttgacaaataattaaaatgttgtatgctaagaggcacgagagagtgttcaggatgctttggaagcataaaagtgggacctggccagttctccacggggttggaggaattgttcattgaaagaagtgaaatttgagacctacagggatgagctcttcaggcagggaaggaacttatgggtgtcctaagcaaagggacagggtgtgtaaagttctggagatgagcatgaatgacacgttcagggaggtggaagacactcccttgactgtgccataaagtgatggtggctgtggccacagactaggctggagacggagccaggaaatgaagggccttatcagccacaggcaggagcttgggatttagggcagtgagaaggcatctggagattttttaaagattgacgtcatcagatgggtgctttcgaaagatctctggctgtaatatgaaaaacacttagtagggaattgtaatagtacatgttttccaggaagaaaaccctgagctgcttgagattcgagtgcagactgtgtactggaggatgctgtggggaatcgcatgaagcagtttgaaggaaggctgaactgccgtgcagttgccacagcaggtcctagaaggagctctggagctggatgagccttctgagttgttgtgcatggacacagagtggtcaggccttacatccctatgcatagaccaggttttcgatgtgggcttcccgcagaaggaagaaaggctttgggtgaagcagctttcttcagctgggggcacttcccgggtagagacttggcagagagctgtctgctgcggacatacccagcagcagggatatcagtcctggaggaggggtctggccagcctcacagcatctgctgtcgtctgccccttgcactgcctggagacatttgcttgtggaatgagagagactggagaaatgtacaaatggaaggttagcagggtaaactatatgtagctcatgctgccacagctggtcttgaagttgcagctgactcccattgacttccttctctcctactcattctagattcccctcgcccttagagaagacctctaggtggcttacctggtggggtgacacagacatcatccctgatgggtccaggctcctgggtgccattctaaagccatgactactgaatgatttgctatcaacattgggcaggggaggaccaagagatgccacagtgaaccacctgggtgccaaatgcattcttcccatttaaataccccattctataactgcagccctgcctgctcctgagagtcagttaccccttccaggatggcaactccctttctagcctgctaatcccttggcaatgcaacataaagtgaccagaactcttgctgtgttctctggcaaaagtactctcttgctggaagccagggcccctatatatgcaaggccaggttgcacagatggagagcataaactccaagtggaccactgggagtgagaagtggggccgtccctacttccaccccttgattcctgaaccattgcgttctacctgctggagacacaccctgcaccatggtagttgttgattcagagtgtaaatctcaccttagaggatagcgcccacatcacagtgcagctccagcggcatcgtgcaagcctggtccatccgtctcatcaggtcaacagcttctgggcagtaggatgtgtgacaggaccagtgttcccatgggtatgcacccactgggacacaatgcagtgccatgcagggtgccggcagcctgcagatgctagtgctggctgaggctctgttgccaagaaaggcaaacccacacccagaaaaggagtcacttcctgtcaagatggagtgtcttcatcttccctggtgtcactgtgatccacctgacacccactggccagttagttggtctcctcgaggagtggaggacacacaggactccgtgccgctctttgttgccggcaggttgaatgttggcggtgtggcagatggggggatgcccgagctggggggcctggcagggcttcacctcaccaccacgcttcctccacacgggagtgccctggcccaggactgctgtggccagtggcggaggctggcagtggtccactggccggatccctccatctgcttgttgaagtgctctcctgtgagctctgccatgctgtgcaaacatgcggacatgtcctgcccctcccatgggtctgtccacgtgcctgctctgcagagctccttgtcttacctgtcctcagtcttccagattttctctgtccctgcccttaaagaggctgccaagacgtttgccactgcttaggagcttgtatctcttcctaactcaggactctttcctttccacacacagtccactgtcagctgctgcctcatctgtttgggctgctgtcactcaataccgtagactggctggcttataaacaacacacatttattccttccagttctggaggctcagaagtcaaagatgaatgcactagcagatttggggtctcatgagggaccactttttggtttgtagatgacgtcttctagctataccctcacatggtagaaggggcaagacagctctctggggcctcacaggatgagaggtgactggttaatgccctctctttataagggcactaatcccattcccgagggctctgacttatgacccaatcaccttgcaaaggcctcacctcctaatcccaccgccttggtgattaggtttcgacataggaatctggggagacacaaacactcggaccatagcagttgcgttgcccaaggctctgcttattgacagggtctcccctcaccactctttcaaccctaaagaggattacaggatagcgacagtgcatttttggcttgcagccgtatgttaagctaactcaattgtgaaccaagcttggatccctcagtgtgtcataaggaatctccccagcccggccactaccaccgtggggccatggttgtgagcccaaggagaggcagtcatgccacggtgtggatggcacgggggtctgaggacctgcttgtgcagctcgctcacgccccgtgggcctgcttgggcctgggcctagatgccccacttctgtcttatgacaattgctgcacagatgctccaactccacagggctcggtagcgtgccaggggctctctttcaaatggtccatcgttctcagctgctgaacccccaaaatctttgctgggatgctcttattggcccgcaggtagccccacgtgacctcttttccctccacagacacctggaatccacagggtctgcctgcgtgcacagccgcagagacagggcgcttgcatgccgcctgaccctgccctttgctcctcggggccccactcagagcttccagcactttcttccaacagtgacaggctcctctttggccactggcgggagggattccagctctaactccattttagagtttgcttcctaggactatccaggcaccaagtgccacaggttataggttcccaggagaacaggctctgagacttgcaggcagggagtgtcttggggtgctctcaacagcaccttcaggaagagaaggaagcagggttgggcagaggtggagtcccactgcagtgcggttgccacagaagactgaggggagccagaggtaggaggctagaggtgagcccttcgcatccaccctccaccactgggcgtgagctgccctatcgccgtgatgtgacggtgtgacctcagtcccaaggtggtgggactgggagcagagcagagcaccccctaaaagggccaaaccagagacacaccaggcaccaggaatccggccagggaatacagaggaggggatgggcttgaggtcggatctgcagaacttggcagtggattagaagacaggatgagaggagacgggttaatgttgatgcatgaatgtctagcttagaacgatggtggtgccattggctggaagaggagacagaaacaaaagcaggttgttcggggagacacacattcattgtggacatctcagctaggggttcagtggggaaaggagtggatgcctagaccacctcagaggagaatccaggctggagccagcgatcaagatgcaagactgacaatctccaacgaactgccccttatccatgctccccacacccacacccaccccttcagagttacagtccaggagaggctaggaggtgcacctccctcagtggaggacactgaagcagcagtggctccagggagctgagatcttttttgatctattttgccccagcatctcaccgcagagccgtctctcagccattgactgccttcacacacaaatgcagtcccagtattgggagatgggtgtaatttattattcccggagatctagatccccggttatttgggagtgtattttctgaactgcttgttggtttaagtaaagcaggtttgatgccacttctcttgaatccatgaccctggacccgccgcctaagtggatgtgcagatgggatggaacggctgcgacagatctccattaaagccagcgcgtcgttcgggctcggccttgcgctgtgaaaagctgagtcagtgccaggacagcacccgcccctctgcagtgcgtttccaaggcactcagcttgtgtgcgaaggtttgctctggggcagcagaaatggcccttggcaggtcgtcaaaggcccggtttcatttcctcctcttccaggcaagttgctcaaaggctcacagccttttcgtcgcctgccacacagagccagtaagatctaccaagctataaataatgaaatgagtgtgtgtttcgccgtttgtaagttgcaaagtattacaaaatggtgaaacttgggggtttgggtttttaaggctgaatgctaaaactgtcaggcactgtggagagaggaaaggaaagataagattgactgggattgaaagacaagtgaaggcatgcttgcgtgggtacacacacagtgacaccacacgcctgcccctggaggccgatcctgaccatgcagacctggggctggggctctccaagcgctctcctgcactgcagaaacccttcttctcttctggactgtcactccagcacggcagagcaccaaggctctgcaacgcacttccctggggtgcagcttccggccaggggcgtcctccctctgcaggagcctcagcacccccggggggttccctccacccccaggagttctgccttgaggggcatggcctgcgggtcccctgagctcgctcacctgtgggggtcacggcctgcgggtcccctgagctcactcacctgtaggggtcacagcctgcgggtcccctgagtcttcctctgcacggccacagtgcagcctccaccagatgcctgcctggcctgacacatgggaccctcctctgaaaatgatgctgtcctgaaggcttttggattccagaggggtttcaggatcccagcagagttggtaaaaaaggtctgaatgtaaattctgaaccgactttgcaagtctataccctgtataccctgtgtactagactccataaacaagcagctagaacaagttcgcaatgtggaaaatatttttatagaaacttattgtcacagctacacaccacacacacacacacaccacacatatgtcacacatgccacacacataaacataacgcacacatcacacatacacaccacacatatataacacacatcacacatacacacacaccacacatacatcacacatgccacacacatacacacatacacacaccacacacatgcaccacacacccattacacacaccacacacacatcacacaccacacacatgcaccacacacccattacacacaccacacatacatcacacacaccacacacaccacacacccatcacacacaccacccatatgcaccacacacccatcacacacaccacacatatgcaccacacacacataaacatacacaccacatccacatacaccacacatacacaacacacacggcgcacacatatacataacatgcacaccatgcgttacacacacaacacacgcgcaccacatataccacacacacatacatacacaccacacacactgcacatacagcatacgcatatacacaacacacatacacacagaacacacaccacacacagatacataacactgcacacactcgccactcacatacacaccgcataccccacgggcatttggagctcctcaaaggaaagcgcccctggcaattctctgcacaccccactcagtatcaggagggaagcagctgcagtgcgcctctgatgcaccagatggcgctaaacccttaaggaaaatgctggatttgtccagaaacaaaaataaaatgacctgggggaaaagggagtgaacgccactttgaaaggcaccccagccacgcctgcatagtggcccagccgacaacaggcaagagggaatcgaaggactgtgtccccaggaggagcatttctgagaggtgtgcagatttgaaaagctaacagctggatcctggcccccataattccttcattaaaaacggggctggcaggggggacaaaatattgtcactccacagaaaagcatgttgaccatgtgtgaggaaaacggttcacctgctctacacttgttccttgcaagcacagaggcatagcccgtttaaactcagcaccccgcaagcacagaggtgtagcccatttaactcatcacccctgcaagcacagaggcatggccatttaactcatcacccctgcaaagcacagaggtatagcacatttaaactcagcacccctgcaaacacagaggcatagctcgtttaaactcagcacccctgtaagcacagaggcatagcccatttaggctcagcactgctgttctccagggttgcatttaccttctttcagcaaggactaggtgttcccacccgtgtctgaggaatccaagacaagcagagggggcttgaagtcaaacagatctagtcttaaacatgagtttcagcctagctgtgatgggtaattttctgtgtcaatgtagctgggccacacagcccagttgttggaaccagcagtagtcaaggtgtcgctgtgaaggtatttttgtagacgtggttaacatctatactcagttaactttgaggtcaaggagatgaccctctataatgtgggtgggcctcacccagtccatggaaggcctgacgagcaaagacctcggtttcccagagaagagaaaaattctgccctaccgagtgtggtggttcacaccggcagccccacactttgggaggccagggtgggaggatcacttgaagctaagaattcgaaaccagcctgggcaacaaagtgagaccccatctctacaaaaaatattttttaaagatcagcagaggacagaagcatgtgcctgtagtcccagctactcgagagcccaggatttccaggctagagtgagctatgatcttgccacagcactccagcctgggcaacagagtgagaccctgtctcaaaaaaaaaaaaaaaaaaaaaatagggtctctctgtctttgttgaccacagtgtatgtagaccttctgcgagcagtagttctccgaagctctgcaggctagcgacatcggcatcacctaggaatttgttgaactgccagtccttgagcgcaatcccagacctatggattcagacccagaggggtagtgggggagccacagcacaagcgcttccggtgccgctggtctgagagccgccgttctgctaatggggaagctccacaaggcagggattgttggcttgctatttgtcatctctcttgtttactgggatgtatccccagggtccaggacagtgcctggcacatcttagacacccaacacatgtttcttgaatgaaaatatttctgcattcactctagcaaaaataatagtctactttgtgccagaataactatactttgcacaaaaggtaggctctgtggtcggctttgacccctctcacatcctattagtgatgattccgcattcagaatcccatctatgtggataattttggtcactgctgacctaagccaaccaaaaactagagaatgtcattatcaaaaatacaaatcagcatattttctagctcaagtgtagatttttcccatatgtcaacttgtaacaatagttgaacacaaagcacttttaaaataaccaataaatggtacctattaataattctgctacttaatatttatgttgttccatttcccccattaatctcaaaataggttgatagatattattttaattcacttcccctttaggaagcatttagggccccatggggcaagactctgtaagatctcgtctgtggcacttggcacacattccactcctagcagaaatcaccactgttagaatcattgtcaaaaatgcccttctgggccaggcatggtggctcatgcctgtaatcccagcactttgggaggccgaggcaggcagatcacctgaggtcaagaattcgagatcagcctggccaaagtgatgaaatcccatctctactaaaaatacaaaaattagcgaggtggggtggtgcatgcctgtaatcccagctactcaggaggctgaggcatgagaatcgcttgaacccaggaggtggaggttgtagtgagccgagattgtgtcattgcactccagcctaggtgacagagcaaaactccgtctcaaaaatagataaataaataaaaacaaatgcccttctgaattgcattctaaagcatggcttggggagtttggagcttagtggagtagccttgtattgcttacagtgtagccttgtattccccggagcccttggctagacaccccattaaatcccaacactctgatgatttctcttaaaaaaaataacaaaataggccgggcgcagtggctcacacctgtaatccaagcactttgggagacggaggcgggcagatcacctgaggtcaggagttcaaaactagcctggccaacatggtgaaactccgtctcctccctcagcctcccaagtagccgggtgtggtagcaggcacctgtaaccccagctacttgagaggccgaggcagcagaatcatttgaacccaggaggtggaggttgcagtgagcggagatttcaccattgcactccagcctgggcaacaggagcgaaacaacgtctcaaaaaaaaaaataacaaaatacatttaaatatatacatatatacatattctccaaaaagagatagtcataagacaatgtgagaacaacaaaacatgttttggtgacacccgttgccaagcagtaacgttgactagctcaaggcccctgaaaagtgatgccattttcttactcaccagcaggaggcgggctgctcacacgcagcagtgctcaactggcccacctgcttgactgagccaggaaggctgctgtctgcaaaggtggaaggtttcagtgtttgtgagaagagaggcgagcgttgatgagaaagctgacatttaaaagctgtcattcacctgaaagcattcatagctgaattaagccaactctgttttcatgattaatgacaactgctcttttttggaaaacaggcttaaatggatttttaggattagaatagacttgtctaattattggctacacaggtgtcacaaatgagtttctcttaaagcaggaaagataacacatatgcagttccttaagttattctagcttcaatgtatatcaatgtgtctcctaggcgctaattcggcttttttttttttttttttttgacacagagtcttgctctgtcgcccaggctggagtgcagtggcgcgatctcggctcactgcaagctctgcctcccaggttcacgtcattctcccatctcagcctcccaagtaggtgggactacaggtgcctgccaccacgcccggctaattttttttttttttttttgtattttgagtagagatggggtttcatcgtgttagccaggatggtttgatctgacctcgtgatccacccgcctcggcctcccaaagtgctgggattacaggtgtgagccaccgtgcccagcctaattcagcttttaaaacctatataagtacattttgatttaccagtggagttttgtgtgtgtgtgtgtgtttatagagacagggtctcattatattgaccagtctggccttgaactcctagactcaagtgttcctcctgcctcggcctcccatacttgtgtttttaaaggagatttaaggccaatccaggccttcagtggtcttttccatgtgtacaaactcccacagggtcatattcccatctctttagagatgatcgtgatgattacaataacaaagtaataatggtggtgatcatagaaaacacacggttagcattcagggtgcacctggctctgtgctaagccgtttgtgtgttgatcttactcacgatgacccttgtgaggttattcctcttgagccacagatggacgatcatgcctttacctttctgagggaattttgattctctctgtctctctctatatgtatatgaaatatatttcctataatcatatgaaatatatatatgaaacatctatatataagtatattatagatgtttcatatatatatttatgaaatcgctattttcagccatgaagtatattaggagagagacttgtcctgttccacccccacctccaccacgcgtgcgtacacacatgcatgcatgcaattcctcctgccacgggtgagcagtagacaggcacagaattctatgcaattacctaacagttacactgccccgtgagagccacactttattgcacaatcgggcggtgatgctgaatcacaacaaaaccttcccctcctggcaacacaataagcaggcattgctttagagcttgatgactaaggcgggaacagagggtaagttacccagctcaccatgttcctcttcaggcgcaaagggagaatcgccctccagaggatgaatggttcccaaacctcccgcccctcgcaaccccttagggcatttttagggattctaatttctgtaccccgccacagacctactgaatcccaatctccagagtctggacacaagccttgggatcatttttagaatcgctttggtgatcttgaacctgtgggcacccagccactgcttgagatcactccagaaggatttaaacatcagcattaagacactcatgaaggatgcaaagcaaagatgtgctcctcctggtagaaatcccctctcggaagtggcagtcaaaggtctaaaccagtggcctgggcaccgcccactcccggggtgtcatagagctgcttctcctgccccccaggtccctggggctggcagcagtggcagcagtcactgggtctgggactcccctccctccccgtggatccgctgggtgaggataggaagcacaggaagagctgtgatgctgagaagggcaggaactccaagggccttcttggtgaccctttcccacatgttaggtgcagtgggacagttggagacaatgacaaagaaagggcatgagctttggcagccgtggcctcctggtgtccttcttgaaagcactttcggcaggttggggaagggagaaccggccaggcagcagcgatggcccagggcagaagggcgggtgggcagctgggagtggagttgcagtgctggtgccaggggaagcaggcaagtggagggcaggtgagccactgcagtgaggggaggggggctgggtggcttctcccactgtctttaccacaagctgggtgctggtggtggtggtagttgctttcgttgttgttgttttgagacagattcttgccctgtcgcctagtctggattgcagtggcaccagctcggctcggtgcaatctccaccttctggattcaagtgattctcatgcctcaacctcctgagtagctgggactatatgtgtgcgccaccaggcccagcatatatatatatatatatatatatatcaagactgaggttgctatatatatacacaaatatatatacaaatatatatacaaatatatataaatatatatacaaatatatataaatatatataaatatatacatatatataaatattatatgtatttttagtagagacagggtttcaccatgtttcgcaggctggtcttgaactcctgaccgtcgcactggcctcccagagtgctgggattacaggtgtgagccactgcgcctggccacaagctgtttgaaaactgtgctctcaaaagtccccggggacttccagatctccatgacagcatcttagccttagtcccttagccctctttgtagcatgtgacttgataatgacaggaagaaatcaaggctgcaggggcctggagtatgaacccaggcagctcggggctccgattctgaaccgactgctcgcaggccaggcggcctgggtctgaagttatttagttttctgagactgatctctccagctgaaatagttaatgacaagctccgtccttcagggatgcgcagttactacattctgtgatgtgggcagagcccctgccgcacagtgcccttcctcatgtaacagaagcgtccttacttcttcaaagccttcccctcctgggcagcagggtctcggacccgccggccgcccctccctctaacaccctgcagctgtcccagcgccatgcctacacagctctgtgttagcccgtgccgaggtctgagtcatcagattaatgggaaaatcagcacaagtagcgtttgaggaacagaatgccatgtcgttcattgggaaaggaatgctgaactttgacttctaagttagataacagaactgcttcatgccctatggaggaataaaaccataacctttgagcacatactgtctaccagaaaaaaaaaaaaaagaaaagacacatcttattagttttctacaccgtaacccctaactctccaatcaaggccaagatctgcctgggcccttgacagtcccaggaggtcagcgtgaaccccacccccactgcaaaagaaagtgggtagctgtcctgccggctaaaacaccctcccctagcttggtactgttaaaacttcagacacggccgggcgcggtggctcacgcctgtaatcccagcactttgggaggccgaggcgggtggatcacaaggtcaggagatcgagaccatcccggctaacatggtgaaaccccgtctctactaaaaattagccgggcgtggtggcgggcgcctgtagtcccagctactcgggaggctgaggcaggagaatggcgtgaacccgggaggcggagcttgcagtgagccgagatcacgccactgcagtccagcctgggcgacagagccacactctgtctcaaaaaaaaaaaaaaaaaaaaaaaaaaggaaacaaaaaaaccccaaaaaacttcagacacattaaatctagcagagtttaattgagcaagaaaaaaaacaaaaaagcgattcgtaaattgggtagccttcacaattacagcagattcagagagactccaagggtgcctcggggtcagaacaaatttatagacaaaaagggaagtgatggacagaaatcggaagtcaggtacagaaacacccgggctggttacaagttggtgtcggcctcatttgaacacagtttgaacactcagcagtgtatgagtggctgaagcatggctgctgggattggccaagacccagctgttgttacagttgcatactctagagttagactttcaatcttgtctacatattaagtcagacacactcctaagttgggttttcaatcttggctaagttcgaccacaaggactcaaatacagaagtacggagtccttcttaggccatacttagtttgctttaacagtattaaaaaccattttgcgacatcagcattttggtcttttcctagggtttggggtattttctcttccctaggctttcttctctgtctctgaccttcagtgtgggcatctccatgagggggtccttgactccttggctcacgtgtgcctcggcccctcagcagctctggtgtcctgtggacatgagggtgcctcttaacccacgctgctgcccatggcttacaggaaccaaagctcagcccaggaagcctcaacctcaggctctagatctggggaggtctctcttcctgcaaactgctggcatctcactgcatcttctcacagtggaagaggcaagagagctctctggggttgctttaataagggcacgaatcccttcataagagctccaccctcatgacctaatcacctcccaaaggccccaccttccagtagcatcaccttggtgggtaggatttcaacatatcgatccggggaagaagtaacattggcccagttgcagagtctgtgaaggaaatgataagggtacatatccttgcaggtgaaaacagaaattgctgctctcaattttccctcttccagtctaaggatcaaaccctcctagctacctccctctcccctgagtgaactggcccatccagtagctcagtgcacactagtgtggaaatgtttacacgggtagtcttttgtaatcactcctaggtattaaacttgcagtgtcctgatttgaaggacgcttgctgctggaggtgttacatccagagccgtttggggaaatcctagtggctttctggtgggcctgcaagttatacccactctgccttgtgtgctcgggggatcggaagtcagagaaaattggtattttgaaaagtaattatttctcttcttttgctgtaactttaatctttcttcctggacagaacaaagcatattaatataaatttgcaattttccagtttgtaattcctctccagtaatgtgctattgacaggcaggaggtttcttcaagttgagctctgaatctttctcttgggctgagtataacatcctttgttagaataaacattgtattcgcccagttgaaaatgctcttaacttggcaacatgtaacaaaggctttaggtgtgcacacacctgagccagaaacttcagcccctgagtgctcctcttgcagacaaggcctcccagataagtgctaagactctagagtttagcaagacctgccctcaatgataatctgtccacacgggttgggagtgctgggatatttgcagtcatttctgccattttattttatactttctattacattctacatttctatagttttacttcttgcctttcttttgactcttttgtttgccatttccactgtatttttccttgtttagaagcaaattgctttctcttgtattgattaccctagaatgtaaacatatattaatgtaaaaaaatctaaggaccctctgcctgaatcatgccagcacattagaatcatccaattctcacacttctgtgctattcttgtccggcatctagttctactctgattttttttttttttgagacaaagtctcactccgttgcccaggctggagtgtactggcaccatctcggctcactgcaacctccacctcccaggttcaagcaattctcctgcctcagcctttcgagtagtgtaggcaccacacccagctactttttgtatttttagtagagacggtttcgctgtgttggccaggctgatcttgaactcctgacctcagatgatccacccgccttggcctcgcaaagtgctaggattacaggcgtgagccaccacacacagcctacttggattttttttttttaaccagcaaattaagcatcgtttacagttttagacaatcagtatttcctgtgatttaccatacgttacccattttctttttcttttctcacagtttcttcttgcagctcctggctccttctggacttttcctatttccatgtttcttttttttttttttttttttttttttgcggggcgggtggtggcagatggagtctcgttctgttgcccaggctggagtgtagtggtatgatctcggctcactgcaacctccgcctcccggttcaaatgattctcctgcctcagcctcctgagtagctgggactacaggcacccaccaccgcgcccagctaatttttgtatttttagtagagacggggtttcaccatgttggtcaggacggtctcaaactcctgacttggtgatctgcctgccttggcctcccacatccatgtttgtttgtttgttttcttttctttttttttttttttttttgagacggagtctccctctgctgcccaggctggagtgcagtggcgtgatctcggctcactgcaagctcagcctcccgggttcacgccattcttctgcctcagcctcctgagtagctgggactacaggcgcccaccaccatgcccagctaattttttgtaattttttgtatttttagtagagatggggtttcagcatgttagccaggatggtctcaatctcctgacctcatgatccgcctgccttggcctcccaaagtgcttggattacaggcgtgaaccaccacatccggccccaaatcatgtttctttaatgaacttctgttgatgggaaatgctgttttttattactgtgtttttatttatgctcattcttaaaaattaattttgcttggatagaattctaagtgggctggtattttctgtcagtgctttgaagataccatcactgtctgccagcacccatgcattaagaaatcagctggggggaataattgtaacttctttgtagataatttgtgtgtttttttgccactctctccaaacactgtttctctctcatgctctttgttatctccttccagaactctacttagaaaaacactggaccttctcaccttatccccccatctcttaatctccttttcatattttttacttcttggcattttatgtaatttcttcagctccatctttcagttcacaaattctctcttcatttgtatctaatttgttatgtaactcatcaactgagtttctaattttaattattagtgtttcatgtccagaaaaatggacaaaacaaagaaatttgtttcttttttacatctccctggttaattgtgacagtctcttattccattatcatcacctttatttatttatttaaatataacaaacatatttagtttatactcagttaagtttttttgagacagagtcccactccatcaccgggactggaatgcagtggcaaaatctcggctcactgcaacctctgccccccaggttcaggtacttctcctgcctcagcctcccaagtacctgggactacaggtgcacaccaccacgcttggctaatcgttgtgtttttagcagagacgaggtttcaccatgttggccaggctggtcttgaacacccggcctcaagtgatccacctgcctcagcctcccaaagtgctgggattacaggtgtgagccaccatgcctggccagtactctgtctctggccattccaatatctacaacctttgctggttagattctgtagtttctgtaattctgtgactttcactcatgtagctagttttctcctgtattaggtgactttttaacttttttattatgatcccagatttcttagaattttatttgtgtaatttccttgaggtttggctttttaaagtgctgtgctccacaaaagatatttttgcttccgcctggttccagggtatatgccaatctggtaatatttcaaattaatttttgacttgaggttttttaaagctaatcagataggatgaattcttttcaccaaccctcgtgtccgaggcctgatggttaggaatgttcagaaaaatgttttccaaacctgctgcctcacagaacccagcctgagaccagcacatatctgtcaattatctcttcagggcgggcttttgccctggcttcctccactgagaacgtcaccctcaggagtccaggtcctctgtgtgtagtaaaactggattccacctcccacctggctctggctggaggctttgtctcctgcctgtgcccttagggcctgggaagacccagatgatgggcagcgcgggactaagaagatagccccacagcaaatgccaggttccttcctcccgaaccaggaggatttgctgtctttaagggtttcctttgccttcccaccctatcagccgtacgtttaaaaaagatttttttccatatttgatccagcatttttaggtgtgtggacctgggagaaattgcccttcacatgcagtatgccatgttgctaaaaaatggcattttgaaattattttctgataagtaaaattgtatttttctccaatttgtatgacttaccaacttgccaccaacaagcaatctaaaccattgctgcagagctacagagccctagacctgaaaaagaacagcgtggaacatgaggccggggtggcgttggggtgcaggtcggtggggggatgggtgtttgccacgtgtcactgacggttaggaccacccaagactctgtggtgactggaaggcgtgccatgaagatgcatacctagttaccaagttgtgaaatggccctcactaaccacagcgccctcactgggcctctgccgtgagtggatcttagcaaaggaagcactcattgacctaccgttgcctccgagcagctgactccacgttattctagcaaagtattcacaaatcacgtgacaccctggcagttctcaagggtgtttcctttgtgcccatgatggctcattaacagaaacgaaattggcttcacccagtgaccagccctaggcaaagcttgtctgtggtgcccccaccactgtcagggataccacccatgtgccctgcccatttcacggggtcctattttggatgtttggtaacccctgaaagtttagtggtaacccctgaaagtttggtaacccctgaaatttggtaacccctgaaagtttagtgccttcctgggctgcgtcattcattcattcacttgcctgaaatgtactgatcgcctgctgtgtaccagattctatgccagaaactggggatatgaggatgtctcaaatgtgatcttggctctggaagaattgactttccacagaaataacagaaacatgaacactaattcctaaagaaactattaaatgcagtacagttattttcctcataatacttcatctataaagactcaaaaactttaacatttcaaaaaggcttggaattcgaaagtgaaatgacaaagtttggattcatgtttttggtgatgctgcatcttatctggggataatcagcgaatggctggtccttaaggtcacagatgtcaagcacagctagcccaggacctcttgcttccacccccaccagaaaacctccttatacatgatggtgcaggcagcacccagctctcggtgacatgaataatgtcagcaaatgtattaaaagcttgccacactggagtcattctgagtctttgaagaaattaactcatagaatcctccatacccccaatgcacaaggtgtttcatctgagagataaagactgtcagagagcttagggaatgtttccagagtcacccgtctgggtagagctgggatttgaaccagacagctggttccagggccacagtcttcactcacagctcccactgccctctctggcacatcgacttcatttcctgttcttgctcctgtcccttctgtgacaacatttggagttccccatttgccaggtgcaaggaaggataacaagatgtagagcaaagtttaaaagcaaagattccagagtcacactgatactcccacttaccagctttgggccatgttttcacccatcgaatcctcaatgtggaataaaaactagatcctcacttcacatctgatgaagtgtctaatgagaagtgtatttgagcattgatcaccttgcctgcattttaagcacctgataggtgttatttattacaattatgcaaaacaacagaatagaggagctcacactacaaaaccaaacaatctcttccccgctcctacgcatacgccacatgccagggagagtgtccccatccgcctagtagctgtctagcatttgtcaagtgcattgatatttaggcttcttgcccgaaggcactcctgtcttcaagaatttcctgtaccgacgtacagggaacataaactctgatcccagtaatagaaagctgagattaaacgcctttcctctttgtttccccaggcctacagagtcgatgaaagagccgccgagcaggctcgttgggaagcagcctccaaagaaaccatcaagaaaaccaccaagccctgtccccgctgccatgtaccagtggaaaaaaatggtgagtctgtgctgagcagagaatgaggatgtcgtgtgctctttgggggagaatcatacccatcagggattccaggattaaaggagatgctgtctgaaggtgcctggtgtgttgggtaacccctcgattaatgttacccattatcactattattattgtttttgttacacagaaatatttaatgagtgagtagttccatggctatgtgaggcacacagttagcatttatgtggttggaaagggaataaatatagaaactagaaccaagatatggaaagtggttgaggataagtggcagtcaggaggcagctgtggtttttctgtcctccctggtgaccttccccagcgctgatggctgcaccgtatgaccctgttgtctgccggccgtcagtctgtagccttccccagctttgcaacattattcaaaattaaaccctcgtctatatttaaagatccctgtggcctgcccctgatgactcacagtaccagtgggggacttcctgctgtctatcctggacatgccactcagggcaaagccatcacaaccagtggtccgagagccctttctcaatgtgatgcacttgtacgtgtgcaaggcagagtcagcggcaccatcacagatgagcaatgacacgaagccaggcgcagcctctcccagcttctccttaatgagcatcagctacgccctggctggcaggttgcccagagctgacttgcgggagggaagcccggccatcccaggatgggcactcaagcctctctcttttcagttatgtccttcaggaagttttcattaatacaaacaagacggtgcttgaacacatcccagagccgcaggtgctggcttagctcagtacaagtccttagtgctgtatcagtggcttcctgcagagaaaataaataatttacccagcgtgtccttattactccattgcatgcagcagtgctcctagaaaatgaagggattggcatgcacctataaagagcagaaggcggccgggcgcggtggctcacgcctgtaatcccagcactttgggaggcggaggcgggtggatcacaaggtcaggaggtcgagaccatcctggctaacacagtgaaaccccgtctctactaaaaatacaaaaaattagccgggtgtggtggcgggcgcctgtagtcccagctactctggaggctgaggcaggagaatggtgtgaacccgggaggcagagcttgcagtgagccgagattgcaccactgcactccagcctgggcgacagagtgagactccatctcaaaaaaaaaaaaaaaaaaaaaaaagagcagaaggcactgatgggatggaaggaaagagcttctctagtctccaccaccactgggtgcactgggaagtgggagggaaagaacacggaagggcccttcccaggagaagatatgtgatggtttgggataaacaggcctggtatttcgctgacaagggtgtaaagcacagagattagacagtcttgatctgtagcccaggctggggtgcaatggcgtaatctcggttcactgcaacctccacctcccgagttcaagagattctcctgcctcagcttcccaagtagctgggactacaggtgtacgcaacacacccagctaatttttatattttttagtagagacgggatttcactatatgtcggccaggctggtctcgaactcctgacctcaggtgatctacccgccttggcctcccaaagccaagctgggattacgggtgtgagccactgtgcccggccttaatttttgtttgttttgttttttaataataattctcaaggttggtgaggacatcataagttagcgtaacttttctggaaaccactttggcaatacctatataaagactttatattatttgacccaataattctacctttgaaaatctatcctaaaggactaacctgaaatatataataggcaaacacacccacacccccacacacattttaggaaaaaaggtgccaactgcagcattatttatattagcgtaaactgaaaatcatcgaagtgtctaaaggcctcagtatgagaaagattggtttattttgtgataaatcggtggtaaagcttcacacagcccggcactgcagtgttgcaggagttaggactctgccatggactgtggctgtgtgagcaccagtttgctcgttcataagatgggtttcaatgggacttcctcacagcatgggcaggaggagtaacagagacggtgcatcaaacacgctccgtgagacgtgctctgattcgtgtggatgaaggttatgaaggcatggcggaaaggtttacatccatcctcagtgagaaatcagaatttcaaagcaagtggcacatatgtctgttttgaaacaaatgtgtgtgtgggaaaaaatagaatcagaagaaaaagactggaaacaagatgttaccatgtcatagtgagtagctctaggcataacaggaccaaagaggactttatttctttttatgcttttctgtaataaacatgtgtgacgtataaccttagaaaattagtaaaaatcagccaggtctctgtctgcagtggggagggaaaggggatccttaaacacccacccatgttcccacttctggcaggcgtcacaggcacggcaggtggagaatttacccagcaggtctggggtccatgccttagtggcctcctcggtagcccagactctggtggtggcagtttgcaagataagaagtggtcagcgaggctgggagtggtggctcacaccggtaatcccagcactttgggaggccaaggcaggcggatcacctgaggtcaggagttcgagaccagcctggccaacatggcgaaaccccgtctccactaaaaatagaaaagttagctgggcatggtggtacatgcctgtagtcccaactgcttgggaacctgaggcaggagaattacttgaacctgggaggcggaatttgcagtgagctgagatcatgccattgcactccagcctgagtgacagagcaagactctgtctcaaaaaaaaaaaaaaaaaaaaaggaagtggtcagcgaacctggacctgttgctttctgtttctctcctccgtggttgtttggttcagcacttactgtcggcttgtggggacacctgagacacttcacctttgtgacacataacatacagcccagtcttgtggccttaaatactatccacatactgatggctcccaaatctacaccccaccctcatctcgcccctcggtccgactccaatagccagctgcttccttagtgtctccactgattgttcaatggacagctcaaatttcacaaagcagagtgctagctgctcctagaaaaccttttcctctagggtgcaccccacctcagtcaacagcaccgcccagttcctcaagccgctaagctaaagctcatccttcattccatgctcttcctcaccctgcattcaatccccggtcaccacggccttccccgtgctctgatccagcgtctgcccacctctgactccacgtccccagccagtgccctgcttgcccgcctcctcttccaagcacagcttcccaaaagggctctcgcctccactctcgcatatttatgatccgtcctctacatagacgtgtagacttctcaaaggccatgtcagtcctgcccttccccccgggggtccccactgacattgcaaccacacagtcccgctcctctccccaggacgcttctgtgtcgtcactgcccatggctggctccttcctgtccttcagatcttaccccagctgacctcttctcagtcagaccgccccttaccaccctgccaaagacccctgccctcctgttggggggcactgtcaacaccatcccatctctcgagggggaggcactgccattccctctgcagggggcctgcctgtggatggccttgagccctctgggaaatcacctctgccaagacaattagttctggctccctccccttccccggagagctcatgtcccatgactactggttggtcataatacccaacccactaacgaaattcaggaccaccctgagagctgccccatccccagagctcctggacgtcagctcaggcctcttaggctgtgcccgagctgggcttctcctctgcccagtctgccctcctccctttccatctcagtgtctgcttccccctttacccaacgagtcccacccaccagtttaataataatttcatagcaccacttccttcccagatcattgcttaatttgttcatttacatgttccccatctgtcgctctttagaacataagccggtgagatcagggaccttgaccgtctaggctccaatcccagaagagagcccggacaaaaaatatttgctgaattaaaacttagcttgtaggccgggcgtggtgactcacgcctgtaatcccagcactttgggaggccgaggctggcagatcgcttgagttcaagaattcaggaccagcctgactaacatggtgaaaccctgtctctagtaaaaatacaaaaaaaaaatagctaggtgtggtggcaggcacctgtgatcccagctactcgggaggccgagacacaagaattggttgaacccaggaggtggaggttgcagtgagccaagattgcaccattgcacttcggcctgggtgacacagtgagactccgtctcaaaaagaataaataaaacacaaacacacaaaaacttagcttgtaaagtttagagatatacacataaaccgatctttttaataaaataacatagaggaagcaagctatcagggcacacagacccggaggaggaggcttcctggaagagatgataccagccaagaattgaagaatgagcagatatgagcaaggcaaggaagagcaggaggaggcgtcctaggccccaggactgcatgagcaaagacaccgggtgtgcgcgcgccggtgtgcggaggcagcccctgctgctcgtgttccaggcaccgcacgcaggagcctcagctgaagcagtaggtaggatgcagaattgaggtccctgaatggcaggtttggggcttggacttgatcctgtgaggcaggcagatattctaggatgagaagcaggaaaattattcatcggatctgccctggactcagaacatgctggcagcctccaaagatggagttgtaggagtcaaatggttcgtgactgtaggaaagtttctccctgtcgggctatttcttggaaatattgtgatgtactataaatgaaagcactaattttttacctccaaatttttaacttacaaacagaaaagctgagacttgaagcttattagcgatggcctaaactgtttaaaagtgcatcactgtaaccgaaaccgacatagcctctatgaccaaggatgttacctggttgtcaccaaggttcgtggcctgttacatactcagctgtgtttcaggaatgcccttcctccctcagagaagctgaaatgagaatgcgaggaatttccattttaagcacaggctaaaccctggtactttctcctataatccactccagtctccagaaatttcttcacttccatctcaagcagatgaaattctggctccattccctgactgagtgtgtgcttctcctcaaatgtgccttcaggttgttcagggacttccacgctctcattaaatctagtggaagaattgctggccggagccacgatgtcgactgcccggcgtaggctgagcttttcatggtttgagtgtccatctgcagacagaactcactacaaaggaagccatattcccttcatgtctatatccacaaatctgcgtgaagtttcagctgcttcctggatgcacttacttttaagctggcaaagcttttagaattgcggtcctccatgctcctccatggcctgggtctagctctatggccttgtgtatattaagccctagggagaaaagaaagctaatgacgtgaatatcttctcttcccatttccattcttactgtaccaggccattgtaattctagcttctgtaccaagatatcatttacaatgctagtatcccagattcattaaatgcttggtattaatttttggcattcggtctaagtgtagaacaaacaacatgcttcttctattctctcattcaataacaacagtcagcacagaagacttctgtgacggaatgtgcgggggtttttccccacgcaccaagcaagcaatcagttctgcagtggacaccggctgagtgtcctgctcttcaaccctggcgctgtctaccaggaaatagtgtctgatccctcaggctgggggctcagtcccacaggactgccactcaccggtctcaagtctgggcttccggaagttctgatcgactggcttcaagttgagattcccatgactccctctttgggttctgttatttgctacagtggctcacagaactcagggaaacacatttaccagtttattataaaggatattacaaaagatacagatgaagagatgcagagggcgaggtatgggggaagggtcgcggagcttccaagccttccctgggtgctccgcccatcagaaacctccatgtgttcagcaacctggaagctccccaaaccctgtcctctggggccctctatggagacttcctgggataggcacgatggaagcatggacagccgtgttgaaatgcggtgggacagaaaggctttgatctcacgctaaaagatggagtggggagaccctgcaaggcctgccggtctagattcttcttggcctccctgtgcagcattccttcctccaggggatggacaggactctttctgaaatccgggtcttataacccacagtcagaacagctgcggatggttccagtcctgccctgggctggtaaaaggagggcaaggaaaggtcggagggagagattctcttttctggcgcctgtttctgaggcctgaattgccccaacattatgacaaaagactgtaacaagagctatgggagttataagccagggactgtgtatgaaaaacacatctatcagccaggcgcggtggctcatgcctgtaatcccagcactttgggaggccaaggcaggcagatcacgaggtcaggagtttgagaccagcctggtcaacatggtgaaaccccgtctctactaaaaatacaaaatttagccaggcgtggtggcaggtgcctgtaattccaactactcgagaggctgaggcaggagaattgcttgaacccgggaggcagaggtggcagtgagcccagatcgcgccctgtactccagcctgggcgacagagcgagactccatctcaaaaaaataaaataaaataaaataaaatatatatatatatatacacacacacacacacacacacacacacactcttcatacatatttgtgtttatatatgcttatatatattaaatatcacaataggaaagtttcttaccctttcatttagaattgctttaatagttcattaagttttaatgtattgctcaataattttgattgaatatattttacgatacatgatataataatgatatatttatgatatgataaaatatttatgatattttagagaaacaagtggttttataatgtcacaccatataacatattatttacatcataaatatacaaccatgcaatatgtgctgaaaatggcacaaacctaagtggaaagtatgaagataaaagtgttgtaagttttctcctttattttccacagatctgtaatttatgatctttaaaacaagccagaaaggattaggaaaacaggagattttgcatgtcggcaagttatcttaaaacaaatgcctattcctatatattcataaatattttaaattagtgaaagttctcatgccaggtttctaataataaaagtgagacagcaccgaaccaattacttggaaaatttggcaggaaaaatcaattaacaagataattggtaagagtgagtaatggagcaccttcaacgctaggtgggattcaagcaaagaaactgcgtttgccggggttttccaggaaatttggacagaaacagttctctgtacatcctcatacaaatcacttcctcctcccttcagttcccccacagcgactgaagcagggctgtgtgcactccagaaactcatggagtctatgtttaacaagtgagggaggtgaataattccaaaataagttccaagataagggacttttcctcttatgctgaaaataacctgttctgtgaatgacaggacattggaatcacacagaccttggtgagatcattgtcttcaccatttaaaagtgcttcaccttggggaaattctatagcagagtgatgctcttatctcaaagtgctttgggaagcaaatgagataatatacatagaacacctagcattattaattacttcctttctatccctctcatcttaattaaaattttggatagcattaaggaacatattccctattaaaaataatatgctggctgggtgcggtagctcacgcctgtaatcccagcactttgggaggccgaggcgggaggatgacttgaggtcaggagtttgagaccagcctggccaacatggcaaaaccctgtctctacgaaaaattcaaaaattagctgggcatgttggtgggcgcctgtaatcccagctactcgggaggctgaggccagagaatcacttgaacctgggaggtgggggttgcagtgagccaagatctcgccactgcactccagcctggacgacaagagcaaaactccatctcaaaaaaaaaaatagaaataataataattacaatatgctatcccagttcctgttttatgaatttggccaagccaagtaagtggcactatagaaagagcaaaaataaatcaaaatatatttaaattattatacattatattaggttatatcatcaaattttatcaatatatttaaatataaatatatttatatatattttaaatataaatatataaaaatatatttatatatattttaaatataaatatataaaaatatatttatatatattttaaatataaatatataaaatatatttatatatattttaaatataaatatataaaatatatttatatatattttaaatataaatatataaaatatatttatatatattttaaatataaatatataaaatatatttatatatattttaaatataaatatataaaatatatttatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatatattttaaatataaatatataaaaatatatttatatattttaaatataaatatattaatatttgaatatatttaaatgaggaattgacccctatctatgaaacatgaagtgtttgtctctaaatcccctttcaggagaataaagtcagatttacaaataaaatttgttcccgacaaaagtgacatgcttcaatttcattcatttcttaatgaatatcatcactttagagctgccctattgtgctttatgaagtttttcccctcagttaagtttctctctgcccttgtattgcttgtgattattcgctcagaaagtgatgtctaggctagcgtgctggtttgggaatgcgtgttttccaggtacttgctgcgaacccaccacacctttgttttctgcccccaacaggaggctgcatgcacatgaagtgtccgcagccccagtgcaggctcgagtggtgctggaactgtggctgcgagtggaaccgcgtctgcatgggggaccactggttcgacgtgtagccagggcggccgggcgccccatcgccacatcctgggggagcatacccagtgtctaccttcattttctaattctcttttcaaacacacacacacacgcgcgcgcgcgcacacacactcttcaagtttttttcaaagtccaactacagccaaattgcagaagaaactcctggatccctttcactatgtccatgaaaaacagcagagtaaaattacagaagaagctcctgaatccctttcagtttgtccacacaagacagcagagccatctgcgacaccaccaacaggcgttctcagcctccggatgacacaaataccagagcacagattcaagtgcaatccatgtatctgtatgggtcattctcacctgaattcgagacaggcagaatcagtagctggagagagagttctcacatttaatatcctgccttttaccttcagtaaacaccatgaagatgccattgacaaggtgtttctctgtaaaatgaactgcagtgggttctccaaactagattcatggctttaacagtaatgttcttatttaaattttcagaaagcatctattcccaaagaaccccaggcaatagtcaaaaacatttgtttatccttaagaattccatctatataaatcgcattaatgaaataccaactatgcgtaaatcaacttgtcacaaagtgagaaattatgaaagttaatttgaatgttgaatgtttgaattacagggaagaaatcaagttaatgtactttcattccctttcatgatttgcaactttagaaagaaattgtttttctgaaagtatcaccaaaaaatctatagtttgattctgagtattcattttgcaacttggagattttgctaatacatttggctccactgtaaatttaatagataaagtgcctataaaggaaacacgtttagaaatgatttcaaaatgatattcaatcttaacaaaagtgaacattattaaatcagaatctttaaagaggagcctttccagaactaccaaaatgaagacacgcccgactctctccatcagaagggtttatacccctttggcacaccctctctgtccaatctgcaagtcccagggagctctgcataccaggggttccccaggagagaccttctcttaggacagtaaactcactagaatattccttatgttgacatggattggatttcagttcaatcaaactttcagcttttttttcagccattcacaacacaatcaaaagattaacaacactgcatgcggcaaaccgcatgctcttacccacactacgcagaagagaaagtacaaccactatcttttgttctacctgtattgtctgacttctcaggaagatcgtgaacataactgagggcatgagtctcactagcacatggaggcccttttggatttagagactgtaaattattaaatcggcaacagggcttctctttttagatgtagcactgaaatccttgctggagggaagagaggggatgaactcaagttttccacatcctgggacacctgtccctcttttcctaactgcctaagataacccatttcttccaaccatctgaggacagtcccgtcgtctcagaggccctgcaccggggagagactgggctctgcagcagccacatcagcattcacagcttcatgtggcttcactgtctgaaaatctaccgactccaacatggccccacggtgacaacagacctgtgacaggaagcccaaagctcacatagaaatggtggacagatcaaagtctctatagtaagggaaaaaaagagaggtggcaggcatgagccccctgcacccagtggctcgtgtccatactgagtccagaccctgatcaaggcctgacttagtgtcactggcagtcccactaaattacacttccttacactggcccgatgcgacaaatcaggtggctcccttctgtcacgtggagcacacagtgttttccatcatccatagctttcttcctgatggtgtttgcattattgcgccttcccaatctgcatgctgcgttgggcttgcggtgcctgaacaaggtttgctcccatgagctcaggcaccctaggatcccctgttagactattaggctgtccagcatggtctcctttcccttcttggtggtggtcttttccctttccagaatagaacagtgattcttaaaataagttagagcaggccgggcgcggtggctcatgcctgtaatcccagcactttgggaggccgaggtgggtggatcacgaggtcaggagttcaagaccagcctggccaagatgatgaaaccccgtctctattaaaaatacaaaaattagctgggcgtggtggcaggcacctgtaatcccagcttcctgggaggctgaggcaggagaatcacttgaacccggggggcagaggttgcagtgagccgagatcacgccactgaactccagcctgggcaacagagtgagactctgtctcaaaaaaaaaaaaaaaacaaaaacaaaaaagcaagatcatccactacacatgaacatgaatcacagtattatttgcacaggaagggtgtaacaaaatatgaatgtatcaaaaaatagaaataaagtctttgcagaaaaagtctgtttttctctgaagtgtgttgagattatctgacaactctaagattgtacttaaattgtcaataaagcatcaaaagagcttctgagtctgtctttgaagatacattttcaatcaatgtgaagggtgacggagggaatcacaggctgtattactccatgggcctcacttgtggcctggaggaattacctggtgatgaaatagccattcagtgacctggaggaattacctggtgatgaaatagccattctcatatcaactccaagctccagattaccgctggctgtttctctttgttaaataagagtagttttttaaggctatcaaaatttgaaagggttccaaaaagcaaaccctcattcataaaaatctaaaagttactttcctgccttactagcaaacttttctaataaaagtgtttaaaagagaagtttgcattggaaaagactatctataaggattttttctcatgtcattctagaaaatttcagtgactttgcattgctgtcaatgtgggtgtgttgacgctgcattttcaaagaactgctttagtggccatgcattgtttatttcacaatgagcccatggtggagggatctggaatggaacattccgagatagggcctgcacaacattaggcaaagaagtacacactgaggtcctctgggtgccagtagccacaggaaacactccgaggatatgcaaaggtcatgggaatggtggcccaggtgatgatagagcaaaagggggcagagaaagtgggtgagctctgggtgccagggtgggaaccccacctccaaaacgcacctgtgtaagagcttcggggacaataatagcatgcaccacgttaggttgttgtcacaactaattaatttgcctaaagcacctggaacagtgtgtaggataaacgaagcactgtgtaattgttcgctattgttaaaaaatgaaccagtcattggaaactacagaataaaataacagaaaacacaaaactaatgcaaagtgatgacaagtgccaggaatatctatttgagcacacaattgtagatttagggattcgtgttagaggcgggtgactcatgttgcatatacgtatattgtattatcttctagacagccccagaagtgttcctataaaggtaagttgctatgctagctgtgtgtgtgtgtgtatgtgtttgtgtgtatgtatgtgtgtgtgtgtgcgcgcgcacgctatatgtgcagatgatgtccagggtgtgaattcgggttaatattgtgagtggaaatgaataagcacaaatgcgaaatgcttatgcagaagacagcattagacatggggtaaagccggcaatccctgtttgggtagtggacgtgcctcatctccatctgcccttactagaacatttctgatagtgtggagaatatcgatgttcagtttttttaagaaaatcctatttcaaaacaacattgagcctcttttcaatccactgtgaataaactgtctcacacaaaataagaaatgttgctgtggtttaaataacatgccgaaaaaaaaaaaaaaaagcagggagtattgtccgggaagacctgcttgaccatacagatgggtggcactggcttgagggacccaccatgctcgctgatctcatcctcagctgcataggaccaattttgtcactatatcaagaggtgactgggccccaaaagactaacgctaacctaactcttaagagaacggggcataaaagctaaaacgtcagtttacagtttatatttactatgagaagcttccctcctgatgcttcatacgtgcttttccatctggctggagtcattctttaaaacccctgccttctccttttgacaggccaacctgtgggcttcagtttgatgaatttgtcccgcaaatctttgctaaactcctggtctacattaacgctcttggtgcgcacttacttccccaatcgtagcattgaacgtgcaacactttaatcacttatttacttacctctgctcccctagggacagagaagaagagagctgtgtactcactgttgtatacttagcaccatgcctagcatagaccacactctatcactatgaaactgcatttttaaattctgagcagttctatgtggaaaataaaattatagcggaaagctttcttgttgagcctagactcagagctaaatgacgttaactgcatcatgttattgaatagtgtcacctgcccagatgcaccaatttccataacaggctgggcgcagcggctcatgcctgtaatcccagcactttgggaggccaaggcaggcggatcacctgaggtcaggagtttaagaccagtctgaccaacatggcaaaaccgcatctctactaaaaatccaaaaattagctgggtgtggtggtgcccgcctataaccccagctactcgggaggctgaggcaggtgggagaatctcttgaaccccggaggtggaggttgcagtgagccgagatcatgccactgcactccagcctgggcaacaaagtgagattccatctcaaaaaaaaaaaaaaaattccattacaaagataagtctagcacagactggaaacctttgctctcagactagggtaatcttatctcaaagagtccctgagatacctggtcaaagggatctgctgtggagctcctcccccagctccccagtgcctcaggtcatctcagctgaacgctgggtgttcctgaaagctcccattgcatgtgcagaatgaaactctagtgtgtttctgtggacagtttgtttcatccacaattcttggatttttaatttcaaactcgaagagtgtcttttttgagagatgctgtttagcatcaaatcagcactcagcatttctccctgtaaggttttctttatatgttttgttttgttttgtttttgttttttttaagacagagtctttgtcacccaggctggagcacagtggcacgatctctgctcactgcaacttccacctcctgggttcacgcgattctcctgtctcagcctcccaggtagcttggactacaggcgtgcagcaccacggccagctaatttttgtatttttagtagagatggggtttcacaatgttggccaagatggtctcgatttttacctcgtgatccacccacctcagcctcccaaagtgctgggattacaagcgtgagccaccgcacccggcctatatttttttcattacaaaattattattacatggttacatgtccattatagaaagtaaaaaaggcaaaaaagaaaacataaaaactaccatctagaaataattttgcatcttatttccacttaaaaatatatgatgagcatctttccatgtcaatagatttctaaagtgacatttttttcaggaattcattatgacctactgtatgctaattaatttaataagtgtctcttttacatttccatatctaatttaaaagtccaggccatgcacagtggctcgcgcctataatcccaacactttaagaggctgaggtgagtggatcacttgagatcaggagtttgagaccagcctgggcaacgtggtaaaaccctgtctctacaaaaaataaaaaattagctgggtgtggtggtgggcgcctataatcccagctacttgggatgctgaggcaggagaattgcttgaacccgggaagtggaggttgcagtgagccaagattgcgccactggacttcagcctgggcaacagagcaagactctatttcaaaaaaataataataaaataaaacctggacagttaggggcaaaggggagtaggttggtcaccctgcctgtgagtagcaggtcccaagcagcaacgtgcactcacaggcccccttgtaggctcggcaccctttggtttaagttgcttacttaacaagctcctactcatctctgaaatttacccccatcctccctcaagccaaacgaatcaagaggctgacacttccaatactgatgcctcccaaagaagtttatcccactaaaaacaggatcaactgaagcctggcaaggcttcatactcccaaaggacctgccacgtggtatttgagaacctctcaattctgaaacagctctcttttagcacctggctttatcttcaggaccatttttcacaaaggcatttagatttcatgatttcactggagttccatgtagccatcactgaatctccattttctccagctgattttcctggaatgagctccccgtgggtctctaggtttggcatgctcttcccacacatcggtctgcttcttcccttcctgaaggcctatcaggtcaacccatcacatctatagtgctcacctggtctccccagctagagtgctaactccatgagggcagttccttgctgtgtttattgatttcatggataagtagagaccagtcatcaacagtcatcagctaaggggctcatccacccccttcattgcccactcaccttggatctgtgcaaaacaattggaaactgggattgtagaaccacacatgccaagtgccaccaatgaaactatcatttagaaaaactgccatcgttccttttaatttgggtgtaattgaaaagtcattatcatttgcttttcttttcttgcctttcctgcttatttattgttctaggtgaagttttttagtcaccaagctttttcattcattttatcatcttggtagcccaaacaatgttagttaaaatgggtctcctagttggtttagcaaatactagatacctctctttgaagaatgggatgcagcacctcccaccagtttttttttttttctctctgaaagtagttgacaacccctagggcagcataatttcaacaatagcaaaaacataaatgcaaaaccactcagtttcaagtgtttgcaagaactctaagcaccaggaataaggcacaagatgggaatcagagacaccacagtagaattcagagacacacacagcaatcacatccttgtaagtaagtaactctgaacatagctcatttctactgtgggtcaccaaacaccaagaagcacttggaagcatgcctggcagttgataactggtagtgacctatcaacagcaacatccatttatgtcagaggatgctggcctcctcattcaaccccttaggagaatcatgattgcttagcaggttcatgtgaaagagtgagttacaaggtgacagcaactaggtcctatggttcccagacctgcttcatagatacggcaaaacttttatttgaattggctcacccatgcatgtttattcctgtccctgatggtgacactgatagggaaaaaagtattccaggaatgacagttgcaaagttcgccatgccatggtcatgcaagggaacgatgctggtctgaaaattctttagtaataacattatgaaatcagagaatcccagaactcaagtgtgttcatgaagactagaaagcatagtccattccaggggccagcaaatgttcctgtacaaaccagatagtagataatttaggctttgcaggccataagtctccatttatgtaatgaaaggatgtgaccaaggagcaagagaggattctgggatatgtcttaagttcttcttggatggctgtgggcctggagtcccatgagccaggctgcagagcacaggagcagagccagagccaagtttgcctgtgagactcgggggtggcaggaaaaaggtggctctatttacacctgctgaaatctcacggtctgtgagacctccaacggtcaggttcagtaaacacttgaatcttaggagagaagtcctagaaatactttttatgtagctctttgtgttaccgatgaatcatttttaataaatagacccttcaaaataataatttcagatgatagcttaaaattgtaaagaaatgactcaagagaatttgttatgttaacctacttgtacaagattagaagtacatctctaattgcttgttattttagaataaatattttccttccaaattaataatctgatgagagatgaacctataatttcagtgataagaacagaagccatggcttaaggtgaacgtggattcccagggcatgaacccaaagaaataattaaataacagcaaacaaaccaaccctggaggaattacatttacagtacataagggaaaaaaaaattaggaggctggggaagagaggttggaagaggttttatagagcagagttgatccagattgtctaaaatttaaacctgtggctaaaagaatatagagtcttgacccctttgttgttattttaattacgtaacattagaggcaacttttgcgaactaatctgaagaaatacttacataattttagcagtccagtccatttcatttgttttctttttcttctaatttcctatgaaacaaaaatttatatatatattttttcttttggaagtctctctctgttgcccaggttggagtgcagtggcacaatctcagctcactgcaacctccgcctcctgggttcaagcaattctcctgtctcagcctcccgaatagctgggattacaggtgcccaccaccacacccagctaatttttgtatttttagtagagacagggtttcatcatgttggccaggctggtctcgaactcctgaccttgtgatccacctgcctcggcctcccaaagtgctgagattacaggtgtgagccactgtacccagccaaaaattattatttaacatgaaaaaaagagcaccgtatagtatgatcgcctttttataaaataaaatcattgttttttgggtttctagccaccatctatctattcttccatctgtatgcttggccaacattgatgacaggaatgatgcttaccaaaggtgatactggctttttggatggtggtgaaatttggggtgatttttcttttcttctttatgcttttccatatcacttgaatatttttatcacaaggatgcttcattttcaaagacaaaaatgaaagtcattacttaaaagagagaaggccaatagaaatctatcgaccggcctcctttgtgaatatgtggtagggagttttactgaggttcgcgtggggaatatggctacgctacagtctccacttgggtagtccttaaagttagagaagttgatggtgtccggggtgccccaggtgttctgtgagagttgaaggtgcttctgctgatttgaatgtcttcaaatgggtctgattagtgagtgaactatcaccaggcgctcccacaccaggtggtggcatggatggtcactgtgcagatccgatgatgtacctgaggatatctcagggcctttttgatcaaacaactctatgaagactttcaggccacaaaacctcttcaactgctggatttcctttcctatgccttgctacatctctatattaatactcgttagttgtacttaattttgcttgtactacatgtgcataagctaaattatttgcaaatggcccaaagaactgaatccctccacatatattataccttacatgtggatattttaaatgaagaatgataaaacctgtttcaacagcatggatgaaccttgaaaacattctgcaaagtgaaagaagccagacacaaaggaccatgaatttaatgtatgattccatttatatgaatggtacagaatagacaaaaagttgattagtggttacctacagctgagcagaggagggaatgggagtgactgctaatggccacagggtttcctttggggttgatggcaatctgtgaatatattaagaactattgaattatacacttcaatgggtgaattgtatgatatgttggattctatctcaattaagctgtcaccaaaaagaaatgaatggaagatagagaagtaaacagcaaatatgaccttaattttcttttttatgagacagggtctcactctgttgcccaggctggagtgaagtggcacaatcacagctcactatagcctcgacctcccaggctcaagtggtcctccagcctcctaagtagctgggactacagctgtgtgccaccatgcttggctaaatttttttttttttttctagagacagggtctcactttgttgccctggctggtctggaactcctgagctcaggtgatcctcctgcctcggcctcccaaagtgctgggatttacaggcatgagacaccatgctcagctaaccctaattttggggggtacttgttggtaggcgagataaaaggtggtggtgaggcatttgttttaagcctctagcacatttatgactatagggcgggagccagaggttgaaagtacagagggacaactaagtgctctaggagacataggattggctcaaggaggactagcctcaggcaagaagaaagccagtaggacgcccaagtgcctgttctctgctctgctcactatagcccctgccatgaaaaccagttgtcttttgaatgaaatcaatcctgctgccccagccagagcagatgagggcagagacagtgcctgacgccacaactgcccaccagtgatgctccaggtggaggggctgctactggagaaggatgaccctgggagaaattctgtggaatccagaggaaaagtgtgccttggagcagagctgcagctgcaccctgacaggaatactgtgtccgtcccctcccctccactctctcgccttcctccacacccccaacaaggcttcggggaccatagttttagttcagttccacagaatatcagtggtgggtcatgaacatggaaaagacgctcacatgaggaaagacaatcagcaagtcaatcaattgcatcttactgacatttccagtctcgaggataactatgcaaatgtatgcaactgtggtcttttgccttcatcacatatgtggaagtaacaagtgagcctggcttcctgttagaaatcaaagtcattttcagtattcaaataattatctttaaaatagtttcctaacaattaactctaataacatatgttcaaaagaaatagaaatcttgaatctcctaatactctttcctggaatcagttggtattctgggtaaaaacagcacccacatggttgaagtctgaaccgcacatttttaccccctaggcactgagtaaatgcaccttaactttaactctgttagagaagagaacacaggatctagctacgttttcagatgttctagagtttgggtgctgagctcttcactttagacagacactgtcaccatagggcctgcacacacatcttcacaaatgaatgagtggatgaaggtaaacggcaaaggcctttcccaaccaaaggaaaaacacttgattcagcactttaagaacaatgaaataaatttttcaaaccacttttaatgagtgggaaaagaatgtgtgtataagtaactgagtgaatacattatttctagttcaacaacgtgcttaaacttcctaggtgaaagagtgtttggaccagacagtagtggcagatgtgtctggaaacagaaaagatcagcagagaaggaaggaacaggagggcatggaggctgtgggcctgtcactcagcactgcagaagtggggcaagaggatggcaggaagtgagggatgcagcagggaacagagcagatgcctccaccagcaaccaggccccatgtccaagtattcccatttcatcctcacaacaatcggatacatagcatttttattactcccattttataggtgagtagaaatgattccactgagataagcaattgacacctaggccatcttatgtggaaagcatttgggaaaaaacaaaaacaaaaaacggcagacctaggtaaccaaatagacgtgatgatgaaaatggcccaagtcatgaggatagacatcactgaataaaactagacaggtggggaggtggaggcagcactttgtcctttatgaataaaagccaaacttctccacatgtttcaagtctctgtaagatccaccgcagttccctttccaggcacttctgtgaattctcctcatgtgctccaggctccagcctttaagaaggcacagcttaatttttagtagtttcaaatcaagaaaaatgaggggcagggaggaaagaagggaaaaaagtgaaaacattattttggagacttgtagccagaaaaaattttaaaattcagtccaaactagaaaacaaaggaaactttaaagcattaggcgagactagaatctaataacaggtgtactatagttcattttgaaatataatttttctttctctagtacccgttttcactaatgacaaataataggacaaatttatgtgtaaaataagcgttagtctttttatgcttggactgtttgcataaagtcagcaagaataattatttgccacatagtctcttttatttttttaattggctttgctggaactttgttcatagggaatctcagattacacttccaagacttgagcccagccacagatttatctgtgcctgcaaatacctgtattaattgggtgaactcctcaccaagttcccaagataatttggggctcctgggcctgtcagaaagtgacattcttcacttaccacaggtcagaaacctgtacaagaactgggtagacaaggtaggaggccagctttccaaaggggcttttattggctttctaagtcaactctgatcccttaaagcagtttctttatatctgaaagtatgcaactccagtcaaagacttggttaaattaccattgtcctcaactgtatcctgttacaaaagaaaacagattattattgaattatgcaaataattatactgatacaaattaagtatgcttgcaaatagctttcaaatttggaggaattaggtagaaagaaatatgctttagattttgctcacgggagtgtagttaacccaattgttaaaagctgtaaatagttcaaaggggttttctggactcagaaacaagagttagtaatgtttcaaaacaagtcaaaaaaagattatttcagttttccattagtttagtctacatagttaactcttgttctgttcaatgtttttgaatacattacctgtctatgagagtcttggaagtttttcctctattctagtgtcacagtctccaaagttattaaacacctgccttcgagagcacctgtcagagtcctgtagctgattataaaaccaccttttgaaaaggatatgagtacaacaactgtggataacaaaagttttaaaacagtcttttaaacacaactgacaaggaaatttggttacttctatggcatataacaattttacataatgatagttactactgataatatatactaggacatatcagaatcacaacaatctcatacaattctgaaacacatactaataacacactcatataaatataatccaaagaaggttaaatgccatttcatatttgacaatagttcctgtatgattttattatatcaaataacttgaatatgtctcttttggacttcaggggatctaatatcaaaagattaatgaggaccaaagtttgaatctgatttgcgaaagtttgtcaaacataaaaagtttcagccgggcacagtggctcacacctgtaatcccagcactttgagaggctgagatgggcagatcacgaggtcaggagttcgagaccaacctgaccagcatggtgaaacccccgtctctactaaaaatacaaaaattagctgggcatggtggcacacgcctctaatcccagctactcaggaagcacaggttgcagtgagccaagatcgcaccactgcactccagcctgggcaacagagcaagactccatctcaaaaaacaaaacaaagcaacaacaacaacaaaaagccaggcgcagcagctcacgcctgtaatcctagcactttgggaggccaaggcaggcagatcacctgaggtcgggagttcaagaccagcctgaccaatatggagaaaccccgtctctactaaaaatagaaaattagccaggcatggtggtgcatgcctgtaatcccagctacttgggaggctgaggcaggagaattgcttgaatccgggaggtggaggttgcggtgagccgagatcgcaccattgcactccagcctaggcaacaagagtgaaactccatctcaaaaaaaaaaaatgcttaaaacagttcacatcacaaaataggatcacaggtcactgtaaaataagtcattcatttagccaaagtaataactcaaagatttgttaaaaaaaccttaattttttgagagaggagacttaatttcccaaacaataagccttaataaagatagcatgaggccaattaaaatgtatctcaaaattttataaacaaatttattaaattttaattatcttgactgtaagatataatttctataaatttttaataaactttacaatgtttttattaaggagtgggtgaatgcttctggaaaaccttgttaatctgccactgggcccagatgctggtctcgtatcagtgtgtctccaatattaatggttaatttacagagaaactgaactaattttctctctcaaatttggcacttccaatctcaggtacccacttcttccacagcagttcctggaattgaatagttataacctctgtccctgtgtcttatgaacagtttattttgcttggcatcttctactaggtctgaagacgaggctttaactgctttcagtgttcatgatttagcaggacttgatgtcctttttagacccaggagtcaaagccctgtaacttaatggcacaaggactttaaaagcaaaaaacagaaagttacatggatgtaacaaacttaagtttaaaaaaacctcagtttttttttctaagcaaaatcagaactaaataacaatggcgtagccattatttcagtaaaacataaaatgtgtttgttaggccagttaccaaaaggcaaagagaagaccttctgcagtgcgattgttgttccctctggggaatccatttaggtaacctgccaagtcaaaactaatgaaaagagtacttcaattagttagacataagaagagtgtttcctgggtaataagtgcaaattttcagactcatagaacaatttaaagccagaagcacagaatgttatgttggaagaaaacatttccttttgaactttaagataaaacatttttagcatcaaactataacaaatagttagaacccgaggaaaaaaaattccaggagctgataatgagttgaaggagagagttattatctcagggcttttcaaagggaagggaaaactgaaaacagcaagacacaataagagttgaactttgggtttaaaataaaaagaaatctcttgtaattttattaagagtcaatctgtacatttaaaaatgtcattgttctaaccaattattgagtgtataagtgtatttttgtatcaaacccaatctctagaaacgctattataaataatttccctttaattatagaaaactcgatacaagtcatttatacatgcttgggcttcctgtttcattctagacatccctctttcttaaataaccagtcacttcctgccagcagaaaatagtagaaagaaataataaagaaaaaagacaacaaaaaagaaaaaaaagaaaatgaaataactagtcattttattttagaacaaaattttgccatacaagattttttcgcatacaaaattattttccttttaacctttcttgccaaaaaaaaaaaaaaaaaacctctttacatttgtaactttctttatattgctcttatttactggttactttgtaccttgtctcataaataactttttctttcgagagctctgtcgcctaggctggagtacagtggtgcgatctcagttcactgcaacctctgccttctaggttcaagagattcccctccctcagcctcccacgtagctgggattacaggcctgccccacccacgtaaattttgtctttttagtagagacgggttttcaccatgttggccaggctgttcttgaactcctgatctcaagtgatcaacctgcctcagcctcctgaagtactgggattacaggcgtgagaaaccgtgcttggccatcataaataaattttaaataatctctgaattagataaaaattattctcatttaataacacatttagaaaaatgttttcctataattttttaaaaattggaagttagacatttaattagactctattatttaacttaatgtaactttagattttaaactatgtgacaagtttacagacatttatgccattacatttacctaattaattttttaaaatagtttacccaggttacttatgaaaactgcaatagttataatttaaagttatttccccattaactatttttatagcctgtgaatttaaggttttcctaagaaaatcttaaggttacataaatgaggtgtttttttttttctgttttgccagtaactcaggatttagctgttttcattaaacagagttaaatgtcttacttgttaaattgtacacaaagataattctctttcaggctgtgttcatagttttataacctcctgccaaattttgacacctagcagagataaatataaaaatatttgaccaaggccgagcgtggtggctcacgcctgtaatcctagcactttgggaggctgaggcgggcggatcacctgaggttgagagttcgagaccagcctgaccaacatggagaaaccctgtctctactaaaaatacaaaattagctggcatatgcctgtaatcccagctactcaggaggctgaggcaggagaatcgcttgaacctgggaggcggaggttgcggtgagctgagattgcaccattgcactccagcgtggtaacatgagcataaactccgtctcaaaaaaaaaaaaaaatacttgaccagtaaatttaaaccataatgtatattgacaattttgaagccatttccaattctatttcaccaatattttaaaaatcagcttatctattaaagattgactcaagtcacatgaacttgaaaaagcctttgttaaagtctccatttcttctgataaggtattcgatataagtgcttttttttcttctttaagccagttgattagagctcttttatgtctttttagtagtgaaatctcatatacacgacacataaatacatagacgtattagacatgcagataaaagtagatcttatacattcataagccctcttattttttcctcctattttagatttccaatttcttgataacctgtgttagaaatgtttgttcttcggtgctataaagaaatagcacttgaacataaatttaatttcttcagcaaggccattttttttactttgtgcagaaagggtacactcgccagcagttttgccacaagagtacaccgaacaaaggagacagggtcatttataacctgacatgtccaccttactgctgtgcctggtttccatcagctggaacgggacctcacattctgtatttgtcctgattggctagcaacttacaactttttaaaagaggcaaaggcagaggagaacaaaggaaggaggaagtaacttgtggaatgctgagaaaggtaaaaacaccttcaaatacggaagaggaacaggctatgacttaatgcttgcttggaccagtataagcgtgccagggcaaatacttaggctaaattgtgggagctaagaacataaagtacattgatttccttattacggctaacagatacttaagaatgttagcacaggcctttgaataaattttgcttctaagagaagttactatttattcttaattagatggggaggaaagcctttgaagaggaacctctactttactttttacacctgttttattatcctagccagttgtcagccaggtagccctaagtttgcatattaaggaaacagctcctgggggaaaaatcagatatcaaagtttacatctcaaagtacagagggaaagagtctgatgtgctagagggagattaagaacggatgccaaatcaaacatgaaactatagaaatctatcataggattgtataaggagaccaattttatttagataggtagttctaaatttagtctctagcttttaactggatctctgagctctgggcagagcccacactgaatcctgtgtctcccaaaacatataattttttgagactagaacacatgatgcttttacagtgtacctattttttaataaagacatttctctaagtgtctaaactacactcttccttaagtaaaacacccaagagtagactctgctgaagtaactattttagtcagaaaaaaaaaaaaaaaacatcaggtaacacaatacaaaagcaaggaatttaagatataggatgaacttgtctgtttacacttttagggttccaaaataaaaaacagaggtttcaccccaaaggggagtctgacaccttctctgctttctttaaggaatcacaggctgttagaaaatgttttaggtctctcatgtagcaacgtgtcaagagcaaggagaggcagcaaaagttaacgtagaaaacagatttcggtcaactgagaagaaagaaagaaaaaaaacttttcttataaaaacaaggttctacgagaggaaaaaaagatcttttaaataaacacacacacatacacacacacacacacacacacacacacacacacacacacacactggatattagcttttaattaagctgacttttaaccactgagctccttagaacaaatttttaaaatcttattaccatattttagctgggccaaattgctgatatttcaaaagtagcacaaatatcaaaccgaaaaggacttgatttaggaaccaaacccaggctgtagtagtggaaaaaaagggcagaactaagctattgaactgcagtggggcaacagccattgctctctttcagtgtggcttggctagcaaaaacgtggccttgttatggaaataaagcccctagggcagtcaaaatcaaaaatcgttccctttttttcccttttgctggccatttttttctttttccttttttttttccagctgcaggaatgtagccaattcagaggacttgttccccataatttgaaacttttctttggatttgatcaagttggatggagttggtcaaacccaatgggaaaaagaccaaaacaacaacaaaacagaaacaaataaacaacaacaacaaaagagttaagcaaaacaaacaattgcacaatttatacgattactgagcgctctaatggtaaggcgtaattaatactagctggttgtgaatcttgactttagtgattaagaagaatttccaagacaaaaaaaaaaagaacaattcagctacttacctaggaatgggtcccaggttgaagactgctctctaccatcctagaaacaggagaaaaactcaaacttgccttgcctgttggaagtgagctgcaagtccagaaaagagttgcctgccttccatcatcatggaagcaggaaaacttgccttcattgttggaagcaagcaaaactccacaaaagtacttgcatagcaaaaaaaaacttcagaacttgaccaaattttgagagaacagtgataccctggagggagggggtgcctaggcctcagcaaattttcctgttggtttgagccatagggatagctcaagctggtaccaagcaacaacagatttgtcaaaggtcaggggcccttccactcacaatcccttcatgattaccaatttgtgaacccaaagtatccaagacaggtctcaatcaatttagaaagtttattttgccaaggttaaggatgtacctgtgacaaaactcaggaagtcctacattggtgcttctgaaatagcagcaatttgtcccagctgaaatatagtaatgagatttaaaaatatttttttaaaagaagctcaatggttaaaaatcagcttaattaaaagctaacatccaagatgtgtgtgtgtgtgtatgtgtgtgtgtatgtgtgtgtttgtatttaaaaggccttcatgtttttgtttttcttttttctctcctgggactatgtccttttttttttttctttctttcttaggatggagtctcactccgttgcgcaggctggagtacagtggcacgatctcagctcaatgcaacctctgcttcctgggttcaagcaattctcctgcctcagcctcctgagtagctgggattacaggcacatgccaccacgcctggctaagttttgtatttttagtagaggcagggtttcaccatgttggtaaggctggccttgaactcctgacctcgttatccacccgtctcagcctcccaaagtgctgggattacacttaaaaaaaaatttttttaagtgcactgtaaaaacatcacagagtctaacctcaaaataattctccctttttggaaacccaggattcagcataggctctgcccagagcccagagatccagttaaaagataggaagtccctatctaaataaaattggtcttctcatgcaatcctgtgatacatttctataattttatgtttgatttagcatccacctttaatctccctctaacaccaccaggctttttctctttgtaccttatgtaaattttgctatttgatttttacctgagttgtttcctttaatatgcaaatttcaggctatttagctgacaactgcctaaggttgtgaaacaggttatcaagaacctggaagtttaagataggaaaaaatgggggggtctttatgaatctgtaagatgtacacctatatttatgtgtggtgtacacaatgtttcactactgaaaatatataaaagagctctaattaattggcttaaagaaaaataaaggcatttaaatactgtatcagaaaagggaaagactagtcaaatgctttttcaagtttatgtgacttaagtaaaatatttaataaataagctagctttaaaattattggtaaagtaatattagaaacgtcttaagaattaccagtatacatttctgtttgcatttattaatcaagcaatttcatacttatccctcccaaatactgtcagggatactgtgtcaaaacttggcacaggggttacaaaactataaacccagcacaagacagaatgatccttgtttgtgttacttttaataaataaaacattaatattggtttaaaaaatagctacatcttgaattatttagtaaaattaccataacgtcaatcttgtggctttaagcagtctagtccacaggcagtaaggaggtttgttttggaaaaggagtgttactgtctttgtttgatagctaaactataaactaagttcctcccaaagtccaggaatgaacaaggacagcttggaggttagaagcaagatggagtcagttaggtcatatctttttcactgtctcagttataattttacaatggtggtttcataactttaaatcatgactatcacagttttcataaataatctaggaaaacaattaaaataaaataattaggtaaatgtaatgggataaatacttgtagacaaactcgtcataatttagaatctaaagttatattaggctgggcaacgtggctcacacctgtaatcccagcactttgggaggccgaggtgaatggatcacttgaggtcaggagttcgagaccagcctggccaacaaggcaaaacaaatctctactaaaaataccaaagttagccaggcatggtggtgcacacctgtagtcccagctacttggaagttgaggcatgagaattgcttgaacgcaggaggcagagattgcagttagctgagatcgtgccactgcactccagcctgggtgacagagtaagtatccatctcaaaaaaaaagaaagaaagcttaaagaggaataatttcatataagaaagaatcttgtatggtaaatttagtctaaaataaaatgacttgttttttaagaaagagggatgttcaggacaaacaagaaagtccaggcatgtcatgaatggtctgtgtaagtcacaataagaggatttatttaaaaaaaataacttttatgtgatcaaattgtttataatcaaagggaaattataatgatcttcctagagactgggcttgatgtaaaaaaaaaaccacttataccctaaattattggttagaacaatgaggttttcttaagggttgatttactcttaataaattacaagagattttaattttttttaaccaaaagttcaacttttattgcatcccaggtttttcggctttctctccccttttaaagggcatgttttcttaaaggtctaaaggaaatgttttcttccaacatagtattctgtatactacagaagttttttcttttgccttttggtaactggcctaacagattttatgttttatcaaaataacttctatgctattattattaagtttggtttgcttaggaaaaaactgagactgaaatttttttaaattaaggttattacatctgtgtgcctttctgtatgtgcttttaaagtactcgtgacattaagttacagggctttgcctcctgggtctataaaggacaccaagtcctgctaaatcttaaacactgacagcaattaaagcttcatctttatttacttatttatttatttatttttgagacagagtttcactcttgttgcccaggctggcgtgcaatggtgccagcttggctcactgcgacctccacctcccacattcaagcgattctcctgcctcagcctcctgagtagctgggattacaggcatgtgccaccatgcctggctacttttgaatttttagtagagatggggtttctccatgttggtcaggctggtcttgaactcccaaactcaggtgatccgcccgccttggcctcccaaagagctgggattacaggtgtgagccaccgtgcctggtcaaagtttcatctttattgattggcatcatagatgatgccaatcaaaataaactgcattcctgagatacagggccagaaattaaagccattcaattcctcaaggcccagggactatcatggaagaggtgggcatgtgagattataagggccaattttaagagagaaaataagttgtttctctgtaaattaatcattaatgtcaaaggcacactgatgcaagactagcatatggactcctgtgtcagattaacaaggttttcttgaaacattaaccagttccttaataaaggttataaagattataaaaggcttatggaagtttatgttatgatcaagattaaaatgttaccggttgtttacaaaattttgaaaaacaaatttaattattgaaaaggctattcagaaactcaaaagcatgtgaccatttgtctctcacctacctgtgacttggaatccccctccttgctttgagtcttcctgcctttgctttgagttgtccctcctttccagaccaaaccaatgtacttcttacatttattgattgatggctcatgtctcgctaaaatgtataaaaccaagatgtgcctcgaccaccttggggacatgtcgtcaggatgtcctgaggctgtgtcatgggcatgtgtcctcaaccttaccaaaataaactttcaaaattaactgagaactgtctcagattttctgggtccacactctgattagtccaacctgggatcacacaatcacagccataaacttgtgtctcagccctgcttgggtctcagcccatgttttgcccccaaacatgggtgtgttcaaaggactggggcagcagggtggtccttcctgggccagcagtgagagtgctccacctgtccagccatcatcactacagacatctggaaaaatctcaggtacctgccccaaatagtgcttcacatgggacagtctcccttctcacctgcaccccagattcaggtcagagtgccatgaactctttgcaaaaagacagctatgcaaaaagccccctgcaaattcacaaatctataaaaatccatgcagactcctcattggcacatttgttccgtgaatccaaacttactttgcttcctctgacacagggtttctcaagctcagcagtgttgacatttgagctggagaattctttcctgtggggctgccctgtccactgtaggatgtttagtggcatctctggctcctacccactggatgccagtagcaccctcattgtcacccccaattgtgagaaccaaaattgtctctagacattaccaaatgtcccctgggggcaaaatcacctccccattgtgaatgtgatgccctacactatttctacaacattgtatgtttagatttatttcatgtcttcctttcaaattccccatatgtattcaccagggcactttttgacctaaatttcttggctgcagactgttttctcatctggctgaaatcatctggtaacagcagtgtaattcctctgggaagatgtactgggcatgaccatttttggagaaagcccaggttattctggtagtgaattgtaaactgctcttttagccacaggagaattggcctcagagcagaggtaaaacataaaattaaggcaattcaggaaaatctttccacaggctgtactttgcctgtggataaataaggactatataggagtatcccgggctccttcccctacctgccaagagggctggaattcacttacaatcaaagctcaagtctccagaagcaaagtaacagaacctgggtttctgcttcccctggaaagttttcagtttcccagctccactgaagactttctaattgtcgagattttctgcaaattaaaaaagactgtgtgaattatttgtataaataaaaatgcactgtggcatattttagtgtttctatttatcaaatcactttcccaggtacaaaatgatgtcaagtgcaaaattcatccacaggacctcttatcacacattattttcacaataccaagtagagtctactgtctattatttcaaagtgcttctcattttacatacttggcagatacctacatatagtaatgtcattttctattgtcaccactacttttttattttattattattattattattattattattttttttttttttttgaggagttttgctcttgttgcccaggctagagtgcagtggtgcaatctcagctcactgcaacctccacgtcccaggttcaagtgattctcctgcctcagcctcccaagtagctgggattacaggcatgcgccaccatgcccggctgactttgtatttttagtagagagggggtttctccatgttggtcaagctggtcttcaactcccgacctcaggtgatctgcctgccttggcctcccaaagtgcagggattataggtgtgagctaccgcgcctggctaataccacttctttttttttttttttcttttttttttttgagatggggtctcgctctgtcgcccaggctggagcgcagtggcgtgatcttggctcactgcaaactccgcctcccaggttcacgccattctcctgcctcagcctcccaagtagctgagactacaggcgcccgccaccttgcccagctaattttttggtacttttttagtagagacggggtttcactgtgttagccaggatggtctcaatctcctgacctcgtgatccacccacctaggcctcccaaagtgctgggataacagtcctgagccatcgcacctggccgccagtaccacttcttaactagctgtgtcttccattccattttggatgttgagctaaaaacctcaatttgctgaagtaagcaatggcttttctttggacataagccagaacttgcctactagatgttttgggttggtgatcaagagatgattagtcgggtggaattttaccattcgtgcttttttgttgtttttaaaattttttattgatacacatatttatacatatttatggggtagaagtgatattttattacatgcagagactgtataataatcaagtcaaggtgtttgtggtgttcatcacctcaacaatttctcatcactttgtgttaggatcatgtaaagtcctctcttctagttatttggaatatatactttgaaatatgcgatacatttttgttaactatagtcaccctactctgcaatggaacattagaacttattccctttatctaattgcatgtttgtacctgttaatgaatctctcttcgtgccccctccccaacacacatttttcctagcctctgggaaccatcattctattctctacctttatgacatcaacatttttagctcccatatatgtgtgaaaacatgtgatatttgtccttctgtgtttaccttaacataataatctccagttccaaccatgttgctgcaaatgacagaatttcattcttttttatggctgagtaatattccattgtgtatcagtaccacattttctttgtccattcattcactgatggacacttagatggattctgtatctgggctattgtgaatagtgctgcaataaatatgtgagtacaggtattcctttgaaatactgatttattttcctttggataaatattcagtagagagattgctggatcatatggtagttctacttctagtttttcgagaaatatccatactgttttccatagaagatgtactaatttacatcctctccaacagtgtataagagttcccttttctctgcatcctcccgagcatctgttattttttatctttctaataatagccattctggccaggcatggtggctcacccctgtaatcccagaactttgggaggctgaggtgggtgagcccaggaagtcaagaccagcctatgcaacatggtgaaaccctggctctacaaaaacaaacgaacaaaacaaaaccactgaaatacagtggatgagacacatgatccacagaatcccaggtcagacatgaaggttatacaccaccagactggctctccattagtgggcatttcagagtctctaggttagatgagaaacattctagattttccacttcaaaaaagatgattgctcacaaatagaatgagtgctagcatttttgtccctctagaaacctttttaaaatgttcacaagcattgggtattctgtaattttgacttcacataaaattagtacagtgatacagactttgttttcaaatatgaggtagacttttaaattttgttttatttatttacttctattttcatttttctgagacagggtctcactctgtcactcaggctggagtgcagtggcaccatcatggcttactgcacccttgacctcctgggctcaagtgatcctcccaccacagcctcctgagtagctgggacaaatgtgcatcaacacacctggctaattttgttaaaatgttttgtagagatggggttttcaccatgttgcccaggctggtctcaaacctctgggctcaagtgattcacccgccttggcctcccaatgtgctgagattacagacgtgagccactgtgcctgggtgcatccattttaccaggggcatttggggcactccgtttctactcctataactcaaatgagtttatttttaagcatcacttttatccttggtttttatatattatacatatatttaagaaagtttttgccaggcgcagtggctcatgcctgtaatcccagcactttgggaggccgaggcgggtggatcacctgagatcaggagttcaagaccagcctggctaacatagtgaaaccccatctctactaaaactacaaaacttagctgggtgtggtggtgggcacctgtaatcccagctactcaggaggctgaagcaggagaatcacttgaacccaggaggcggaggttgcggtgagctgagatcgcgccactgcactccagcctgggcaacggagcaagcctccgtatcaaaaaaaagaaaaagaaaaagaaaaagaaaaagttttaactctccatagaatcatctcccgtgcccagcctgaggtagttaagccagaaagtaacatggaaatttgcaagatgcaaacaaacattaaaagagaatctatagaaaataaatatagaaaataggatatatttttctgagagaaaaattattactaatatgttcattcttgctaccaatttggtgtttaataaatgtgtcttgaatgaatgtatgggtaaaaactagatttttttctgaatatgaaaataaatacctatataccttgttgtatataggtatacaagcacctgtatgtcttggtcttctatctttgaggctcattctaatttaagcaggccaggaatagaattaaatgcatggactggaaggcctaattcccaaactaaatagaagtaactggacaaggaaacagatttttgctttgatttgaggaaagaggcattaagacctagccttatatatttgtgtgtgtgtgtatgtgtatgtgtgtgtaaacatatatatatatatttttttcttacagagaagtctgcatgtacctttttgagtgactcccttgtttaaaacaacaatatctgattagagttaataatactaattgcaattgtttattaagcacttatgtgccaggcaccatgtaagaatttcatacatatgatctaatttcgcttttctctttcagccctctgaaagagttgacttcatctagcatacgaagacatagattcttttttttctttttttttgagacggagtcttgctctgttgcccaggctggagtgcagtggcatgatcttggctcactgcaagctctgcctcctgggttcacgccattctcctgcctcagcctcctgaggagctgggaccacaggcgcctgccaccatgccaggctaattttttgtagttttagtagagacagggtttcaccgtgttagccaggatggtctccatctcctgacctagtgatccgcccgcctcggcctcccaaagtgctgggattacaggcgtgagccaccgtgcccggcagaaatagattcttgaagaagttaacttactaaagtttgcccagctagaaagtagtctaaccttactttgttggagtccagggtttaggatcttaactgcttctctgcacagtactttctttagggacaggagttgtcaaagcaaagattttttttttcacctgcatcattagcctcaaagtgagtgcatcactaccaggtggagaagactatcctacaaggattattttctcactcaatccaccaagttcagtcagttggttttaattcaaactgtaaaaaatatgccagaatcaaacattctgtcttcccacaggtgtgtgaaagcaaacaggtggcgtcactggaagacattggtgactaggtgaaatgtcatccaagacaatgtttcatgaagacaatgtttcataaagacaccggctgattttgccaacaatttcactttcctaactcttatctgatgtcactatcctcccttcacagtgggaataatacaatgcttttttcatccagggaggtggcagttttactggttgtcattttatttatcaaatatgctgattgttctaactaatatcttataagcttcttttaagaaatctattactcaatttaaaagatacaggatagaataatgcaatttataaaataaccaaaacatgtccttaaattccactattgtaatagtaaccatgcttcttaaacaatagttactagtattcttattatcaatgtcttttattttatcctgtaggaaattattcacttgtacaaataaaatagaactacttgggatttttaaaaatgatccttccctccttcattttgggtaatatttgaagaaccactgttcaggagaaaataccattaatttagaccaagaaatgtccacaagattcatgtggacaaaggaaacacataataaagaaaacctagagtttgcaaaacaaatagaacttgataactgtggtacctctgccctgagcttccagtctccttccccctaactttatgagcagtgaaaacttcatatcaaatgtaccctggaagacgttttccaggaaaagaaagcaacccccttgactagacaatgagcagttgtcaagctgctagggaccgatttgttcctagatccagatggggactggatccagttcccatgcagctgtgcacagcaactgatcttctcagatgtggaacaatgaggctttcatcaggacatatcctatggtgagtgctagacagaactcaaaggctggagatggagagggatagtgttgagagctggggaagggttaaaaaactcaccctctaacctgaagagtcacattacaggttttcaaacacattggttagtagagaaggaggccaaaatgaaaaacagaaaattcttcataacctggagtttctaaagtgcagtgctcttcatttcaaagtttataacgcaatcagcactgaaccaatgctgtttcatagaacactttaagataattgctttgatgagcccacagaacttatttaacaacttgctgctgatatcattatgctaaaacttgggatgcgtatgaaattttggaagaaaaaaggaaaataataaaccgtcggattgggaaaagagattgaaatccagctatttcttctaagttgtgatagtaagtagtcatgattattagatatatctctttcatgcctcactttttcagtgccctcctcccatacttaggatacatcgctaaagttgctaggaagacagggctgaatacacagccctgcccttggcatacatggtctaatttcaagggattgctttaaatagaattctctgctagagctaatcggtgtcaaatatgagaagaaaattatcctttcatagaaggggaaagtctgccttcgttcaatggtgtgcctgtgcaatgatcgtgccgtcaggtttcacaaaagcctctttgtaccgaacactgctgatgcaatgaatgtgaccacagtagagcctgtgccctcttttgttgctgaatgtagactcctacaatgcagtgccacctacttccccggctttgttttcataataactggtttgcatttttggtactttaaccaagtgttgtagcccagtgcttttaagatctatgattaacaggaattttaatatgttgtattttgaataggtttgccaagctcctgacggtttccctaatcaccaggaacttaaatatcaccaaactgctcacaaagagcctcagctgcaaaatgcgtatcctgccaggtgtaaggtttctgtctagaccaatgagaagggcttgaaggtcactgaattcccacatggggtcatgcacctttccacgtcctgaagacacatcagaaaggattttcacatttatgcatccattctttcattcattcaactccctaagttatttggggccttatgtgtgacatctcttgctagatcctgagtggagcaggttaagcagagaggggcaaaagagcagaatcaaaggtaaagattacatcatctctggaaaaaaaacgagctctagaagacattgtgttagatcctactattgtggcaatgtataattcccaaagagtataattatattgtaattgagtaggagaatgtcattattcttgagagatatatatttaggggtgaagtatcatgatgtctacgacatcaaacagtttggcaaaaagtatatacatatgtgtgtgtatatgtacacatacagattccactgtggtcacgtttgttggatcagcagtgtttgggtacaaagaggattttgtagaacctgacagcacgatcattgccactatatgtacatatacacatacacatatgtatatatacacataagcacacacacacatatatataatgtgtatatactgtgtacatacagtcatgcctctcttaacaatgaggatatgttttgagaaatccattgttagggccaggtgttttgagaaatccattgttacggtggctcacacctgtaatcccagcactttgggaggctgaggagggcagatcacctgaggtcagaagttcgagaccagcctggccaacatggaaactccgtctctactaaaaatacaaaaattagccagacatggtggtgcactcctataatcccagctactggggaggctgaggcaggagaatcgcttgaacccagaagagggaggttgcagtgagccaagatcacgccactgcactccagcctgggcaacacagcaagactccgtctcaaattaaaaaaaaaaaaatgcattcttaggcaactttgttgtgtaaacatgttagagtacacttacacaaacctagatggtatagcccatgaggcacctgtttctctcaggctaccaacctgtacagcatgggactttactgaatactgtagataattgtaacacaacggtttttgtgcatctaaacatagaaaaggtgcagcaagggctaggagcggtggctcatgcccataatcccaacacattgggaggccaaggtgagtggatcacctgaggtcaggagttcgagaccagcctggccaacacggcaaaactccgtctctactaaaaatacaaaaactagctgggtgtggtgacgggcacctgtaatcccagctactaaggaggccgaggcaggagaattgcttgaacccaggaggtggttgcagtaagccaagatcataccactgcactccaagctgggtgacaagagcaaaactccatctcaaaaaaaaaaaaggtacagcaaaatccagtatacagtataaaagaaaaaaattggtacacctgtgtagggcatttactctgactggagcctgtgggactggcagttgctctgggtgagtcagtgagtgagtggagagtgagtgtgaaggccgaggatatgactttccgctcaacaccgttcacttaggctagactaaattcatttaaaaaatttctttcttcagtaataaattgatcttatcttactgtaacttttttactttaaaaactttttcatttttaaaaaacctttggactcatttgtaataacaaagcttataagacaaacacattgtacagctgtaacaaattttcttgctttaggtccttattctatcaatcagcttttttctatttttaattttttttttactcttaaaaccttttcttaaaaactaatatacaaacacacacacatacacctaagatcacacagggtcaggatcaccaatatcactgtcttctgacatctggtcccactgggaggtcttcaggggcaaggccacccatgaagctgcatctcctatgatcactgtccttcttctggacacctcctgaaggacctctctgagactgttttacagttaacttttttctataaagagaaggcatacactctaaaataatgattaaaaagtataggctagtaatacctaaaccagccacattgtcatttattatcattacccagcattatgcacagtacataattgtatgtgctagatttttatatgattggccccacagtggatttgtttacagtgctgcattgtgatgttaggacagctatgatgtcaataggccataggaatttttcagctccattattattttatgggaccattgtcatatatatatatacacacgcatatatatatatatacataaaatgtgtatatgtatctctttaaagatagcagatacgggccgggtgcggttactcacgcctgtgttagatatgagttctaaatttatcttcaaagaataaatatgtcagtatattcaattctttgccttctacttttaaacttaacttcctcgtaaagcaacctttttcaattacctgcttcaccctgactcattctgattacctgctgcaccctgactcattccgattacctgctccaccctgacactcattcggattacctgcttcaccctgactcattccaattacctgctccaccctgactcattcagattacctgcttcaccctgactcattccgattacctgcttcaccctgactcattccgattacctgctccaccctgactcattccgattacctgctccaccctgactcattccgattacctgcttcaccctgactcattctgattacctgcttcaccctgactccttcggattacctgctccatcctgactcattcctattacctgctccaccctgactcattgcaatttcctgctctgcccttaaccatttttcccaccaaaccactcaccccctcacgctctttaaattagccaatcagaattagtttagcctgtgcagtctaaccctagccaatagggaaaggatacagcagcaggggccatgtgcgtcagggataagaaccccttcccctccctggtccaagtgtgcactcaccattgccccatctgtaagggcgcacccttctatagaagtacattgccttgctgaaaattaaaaagaaaattttatattcgagtgctatttcttttgcagcaccgaaactttatttataacaatttgggggctccctcgtgatacattccccttccgggcagtctctggttctctctggtgaggacgtgcgccccgccgccttgtgggggcctcaggggtgagaaatcaggacccacccagttccaggaataacccgagctctcggcaacgcagaaagaaactggccagcaacctagcttaaaggatcctcacatactgcagcggtgactctgtgcacagaccaaggaaggagaagccgcgggagccggtaaagtacttccttgttggtcaaattctggagggctaaatgtgtgtgtgtgtgaatgatcacaaacaaccctacttgtggtgttcttcgtgtggatggtgacaagtcctactgctggacagagtgagtgggacctctccggggttccgtagctacctcatatagcttagggctgatcctgccatgggatttataccggcactctaacactaagaggggcctaactctcccttgggggagcagccagagaggacaacacgagtgggaagtgtgcaagggaccttcagagggggaaagggaggaaacaggtcaaccttctagagcagcaaggcaagacaccccctggtttgaggggttgagccttccgcaaatttcagggggttgaacctcacacaaacctcctgtagtaagaaaaatattcagaactcccctttcctttcttctcagggaaagaaagagtagctgcactcccaccggtccctcccctaggggaaggggaaggagaggggagaagagcagcataagcggctggcagaggcagagaaagagacagagtcaaagagagagagaggcagagagagagaaagagacagagacaaacagagagagggagagtagtaaagagaaaacagtgtaccctattcctttaaaagccagggtaaatttaaaacctataattaataattgaaggtcttctccctgaccctataacactccaataccaccttgttgccagtgtaaacaaggttgtaacccaaaagccctgaggtgactgacaacccgtagccttcctaatcaaaaatccttaacccagtaacccgtggatggcccaaatgcattcaatctgtagtggaaactgcttcgctaacagaagaaagtagaaaaataacttttagagtaaacttcattgtgagcacacctcatcaggtcagaactatcctaagtcaaaaagaaaacaaaagatagcttactgactcaagaaccttaaagtatgaggctattctgttagaaaaagatgatttaacatgaaccactgaaaattcccttaacccaccaggtttcctaacagggcatctaaatcttaattaccatacaaaggtccaaccagacctaggaggaactaccttcaggacaggactgtagatgcttcctcctgggtgattgaaggaaaaagacacaatgggtattcagtaagtgataaggaaactcttggagaagccaagttaggaaaattgcctaacaattggtctgctcaaacgtgcctgcgagctgtttgcactcagccaagccttaaagtgcttacagaatcaggaaggagtcatctatactaattctaagttaatatggactgaacgaggtcttattaatagcaaagaataattgaaatcccaaacttacaaggttttcaacaaaagtaaagtttgctaaaagttaagagtgtaacatgtattatcctaacgtctaatcttgtggccttagacagtctagtccacagaaatgaaggaagttcaatttggaaaagaatggttatcatctttgagaaaaaacaaagggggggggggagaatttatgtaaaaaggaatattatatggtaaattcttgtcctaaaataaatgaactggttgtttagagaaagggatgtttgcaacaaatcagaaagttgaggcatgttgaagaattgtctgtgaaagttatgggaaaaaaaagttataaaagggaatttatgcaagaaatgttgtataatttaaaagtaattaggcctcctgaatgtaaaactattgaagaaacagtttatgtgtaaggtgtgtaaggaaagtaaaacgtactttggtaaaaggattataaggagacataagagtgtggatttttacctacattaaatggttaaaaaaaaattgttttaaaggtttaggcaagttttgaaatgttaattgaaaaggaaattctgtgtgtaaacatattgggtaaagttaaagggatatcacccagtttttctgagaactggacattaaaataaaagcacaacatgtttttcttaaagcactaacctgctttttaacaaaaattataaaaggttaaaaagcgtctatacaaatcttaccatatggtcagacattaaaaattggataaatatggctacaagattttattaaaattaactttaacattaaaaacacactaatgtaaaggtgaaatttagcttatctggtataaatatcatacaggaagcattggcaaatataaaacggtgtttggctttctttggtctaaaaaataataaaaataggtgctaaagaaaatttctcagcaagaaggtgccaaggactataaagtccattgctgatgtccccacatgtaaaacaaaagatcaatttcttagaaattatatacttggtttatcttctactttcctttccctcaaaactaaaagtcttttagcacaggtaccagccctagaatttccggtaaaccagcaccagcctgaggatcacattctcatcaaagggtggggagaaggaaaacttgagccagcctgggaaggactttaccttgtgttactaatcaccgagactgctgttcatacagtggaaaggggatggactcatcacacccgagtcaaaaaagcaccgccttctccagagtcgtgggccatagtcccaggggaaaacgctaccaaactaaagctaagaaaaatttaactctttcatctattctattactttttcttctttcctcactctattgctgaccatctagttattaacataaccaagtcaatttcgcctcaaactattgcatttggtgcttgccttgttataccctgtgggaacttgccaagtcagagacagctctctacttcagaaaagcacctctgtccctcctgactcttctcagattaggcattagtgaactgggaccatttaatccgaggagattttgataaagaccccggcgtcaaccaggagtcttgccctcccaatgtacagcttttatgccatagttggtccagcattctgtggaccactaaagagcaaggatggaccgccccaacctgtttttgtaatttcctaaaactgtacattcatgttactagagggacagccccccactaagtgtcagctaaaccagtgcaatcctatacaggttattatctcgaatcctcaaacttcttccccttttctaagccggttccctcctttaagccagttttatggtatgggggttgaggtttgagggacagaccctattggattctttaaaatgtatttctttgatcccgcactgcctgcaccttcttctaagccttcttccaaaacctctcacaacggaataattgctcctcctccatctaaccacaagaccaagatggctgtcgtagaagttaaagacttaaaacaagtattggcaattgaaacaggttaccaagttgcaaatgcctggttggaatggatcagatattccgtccgcactttaaacgaaagcaattgttatgcttgtgtgcatggcaggccagaggcccagattgtcccctttctagtagggtggtcctccagttgaccaggagtgggctgcatgatagctcttttcccggatcctacagcctggagtaacaagttgtgccatgctctctctctgctatatcccgaagtccggcatcctatgggccagcccctgagggccatccagcttctgtctcccaacactaagttaacttcatatctctcacgacagggaggaaacagcattccttggagacctgaggggatgcagtgagcttaagaattttcaagaacttatcaatcagtcagcccttgttcatcccctagtggatgtgtggtggtattctggtggacctttactggacactctgccgaataactggagcggcacttgtgctttagtccaattggctatccgtttcaccctggcatttcatcaactagaggaaggaaaaataagacatcataatgcgagagaagccccttatgggtctttcgactctcatgtctatttaaacgcaactggagtcccacggggaataccagatcaatttgaattccgaaatcaaatagctgcaggatttgagtcaatatcttggtgggtgacaattaataaaaatgtagattggataaactacatctactacaaccaacagtgatttagtaactacactagagatgctgttgaaggaatagctgagccattaggggctacaggccagatggcttgggaaaataggatagccttagacatggtattagcagaaagaggaggagtttgcattatgattaaaactcaatgttgtaccttcatcccaaacaacatcgcccctgatggaagtataacaaaggcattgcaaggtctgactgctctgtccagtgagttagccaacaacttacgggtaaatgacccctttacaggatggctagaaaagtggttttgtaaatggagaggaataatagtctcaattcttacttctcttgcagcagtaatgggtgtacttattcttgtcgggtgctgtgtcacaccatgcatccgtgggttgatgcagaggctcataaaaatggcacttactgaaacctcccttcactatcctccaccttatccagagaagattcttcttttaggaaatcaagcagaacaactaagctaagacatattaaagaagtttgaagagaaagaactgtaaggaaatgcaagaggaggggttgttagatatgagttctaaatttctcttcaaagaatcaatatgtcagtatgttcaactctttgtcttctacttttaaacttaactcctcataaagcaaactttttcgattacctgctgcaccctgactcattccgattacctgctccaccctgactcgttcagattacctgctcattctctgccctgagtcatttcaatttcctgctgtatcataaccatttctcctgccaaaccactcaccccgtcactctctttaaattagccagtcggaattagtttagcctgtgcagtctaaccctagccaataggagaatgacacagcagcaggggccacgtgggtcagggataagaaccccttcccctccctggtccaagtgtgcgctcaccattgctgcatctgtaagggtgcaccattctatagaagtacattgccttgctgagaattaaaaagaaaatcttatatttgagtgctatttcttttgcggctccaaaactttatttataacacctgtaatcccagcattttgggaggctgaagtgggcagatcacctgaggacaggacttggaggccagtctgaccaacatagagaaaccccatctctactaaaaatacaaaattacccgggtatggtggtgcatgcctgtaatcccagctactcaggaggctgaggcaggagaattgcttgaacctgggaggtggaggttgtgggtgagctaagatcgtaccattgcactccagcctgggcaacaagagcaaaactctctcaaaaaaatataaataaataaataaaataaaaaataaagatagcagatgttacaaaatattaaaaatcagtgaacctagacgaagagtctaggggttttcgttgtatttatcatgcacctgtttgtgttgttttgaaatttttcacaatataaaattagaggaaaagatatcatctctcatctcaaggagcttacaatctacagaccaaatatttttttctaataaaaagatgaagaagactagatcttagggtcagaaatcattggtggggcacgagtaagctgcctccacaaaccccaactcccagaaggtgggactgtggcagatgggttgggttcgcctgagcccccgcttctgcccagaggttttagcaggttcctgaggactgggctgggccatgggtgggcacaaggcagactctttggcccacagtggaggccctcagaagaccaagagtccaaatgtggtaggagttattaagaaataattttaggcagataggaaaaggggtccttggaaacttttcatctcttttaaagcagctcctcaaatgtttatttattttccttttttttttttaatatatggagttttgctcttattgcccaggctggagtgcagtgggctatctctgctcactgcaacctccgcctcctgggttcaagcgattctcttgccccagcctcccgagtagctgggattacaggcgcccaccaccaagcctggctaattttttgtatttttagtagagacggggtttctccatgttggccaggctggtctcgaattcctgacctcaggtgatccacctgtctccgcctcccatcgtgctgggattacaggcatgagccactgcacctggcccaaacctttcttgtctaacaggaaagccccagcatttagagccgggcaggcaacctttgatatgcaattgcaggccattagaaactggttccactccaacatgatgattccctcccttttctccttgccctcgcatttgcctggcaacatggctgccccccatatccccacgtgcctagaacatcatggtgccctgcatttgcatattaaaagctagggtgggagggccagtttgtttcccgggctatgtgaatgacatgcctagtcaaaccaatcccctgagccctatgcaaatcagacaccgcctgctccagcctcttcctgtacctagcatgtggggtcttctctctaggctttggagcccacctccctctgtctctgaacaggggaacttcttccttctttcttctcccttccttcttgcctattaaactctccgctccttaaaaccactccctgtgtgtccctgtaggtttttccaatttgacgtgagatgaagaacctggagttccttcactcatcagagccatatcacagggtctcctggccaagtccaaggaggactggagaggggcccctgctatgcagagtccctcacctgagcctgtgccaggccttcgtgctggaggtgcaccacagatgcggatggcccaacagcacttggatggatatttagtaaaggagaaagcagagaggacgcttataaatataaatcagaaagaagatggaccaaaccccctgctttgtcttggctcagaagggctttgcagaaggccatggaagatggcatgggatgccaccagccagccagatcacacgtagtgatgttcacactcaagttgacctttctgacaccttgtgatggttaatactgagtgtcaattcgattggattgaaggatgcaaagtattgttcctgggtgtgcctgtgacggtgttgccaaaggacattaattaacatttgagtcaatgggctgggagaggtggacccaccctcaatccaaatgggcaccatctaatcagctgccagcacagctagaataaagcaggcagaaggtggaaggagctaacttgctgagtcttctggcctccgtttttctcctgtgctggatgcttcctgccctggaacatcaaactccaagtccttcagcttttggacttttggacttaagccagtggtttgtcaggggttctcaggcccttggccacagactgaaggctgcattgttggcttccttacttttgaggttttgggactcgactggcttcctggcccctcagcttgcagacagcctactgtgggacttcaccttgtgctcgtgagttaattctctttaataaactccccttcatgtatacatctatcctattagtttagttctgtccctctacagaaccctgactaatatatgcctcaacttcagggttctttggccttcttctttttttttttttttttttttgatgcagagtctcactctgtcaccaggctggagtgcagaggcaccatctggttcactgcaacctccgcctccctggttcaagcaagtctcctctctcagcctcccgagtagctgggactacaggcacgcaccaccacgcccagctaatttttgtatgtttagtatagacaaggtttcatcacgttggccaggatggtctcgatctcctgaccttgtgatccgcctgcctcagcctcccaaagtgctgggattacaggcatgagccaccatgcctggccattccttggccttctaatgccttctatctatgggccacctcagctggcagtcctagatgatgcccccatccttgaccctcacagacgacttaactccaacctctgccctgctaccatctggatttccaaccccagaattctgttttggtagatttgctccaccccacatgcatgccctaaagctccagtgaggcctcagtataactggcaatacgctcttgttgctcttgttctttctgagtcctggctgtatataaagctgggtcagggggtcctcaaggtcccttttagtggtaaaaattattagactttacctcttgctaatgcccacatccttaagtaaactgagcccctccattttctccttcccgtttccttctcttgctgagtaagaattatttcttttcgctgataaaaccaacccctctgtcatctctgttcttgtatccttcatgcatcttctgggaggttgctctatttattccccttttctctggcatctttgatctctctttgggggctgttagttctcaagcagcacatccagcctgcagggttggtctccagcttctcagttattccttttaagatgaataagaaaatgagtaaaggaagagggctggcctgggtgccctgcttgggtccggggcttagagagtgggcagacactgaggggtgaccttccctgcacagccagtcctgggcaggatgtgggaagggccgggacggagctccctgacactgagaaggacaggctggctggcaccgaggtctgtgttaggaaggatggagagacaggcacccaagggtcctaggctcagctggatgaacatctggttttgtgggaccagatgccgagttctgaatccactgtacctacaaagaactttttgttctcctcagacatagttgagaagaaaaacttgctcagttatattttttttaattttattctttttagtgacagggtctcatttgctgcccaggctggagtgcagtagcataatcatagctctcttcaccttcaaactcctgggctcaagttagccttctaagtagctaggactacaggcatgtgccaccatgctcagctaatttttaacttttttttttttaagagatggagtcttgctgtattgcctaggctggtctctaactcctaggctcacgcagtccccccacctcagtctcccagactgctgggattacaggcattagcccctgcacctggctttcagttggtttttattttatttcattttattttatttattttatttcaagacagagtttctatcttgttgcccaggctggagtgcagtggtgtgatctcggctcactgcagcctctgcctcccgggttcaagtgattctcctgcctcagcctcctgagtagctaggattacaggtgcccgccaccatgcccagataatttttgtatttttagtagaatggggtttcgccatgttggccaggctggtcttgaactcctgacctcaggtgatccgcccgcctcggcctcccaaagtgctgcggttacaggcgtgagccgccgcgcccggcctcagctggtttttaattactccctcgtacccaggtgaccagtgtattttccgtggccttttcttcgcctactatcacttaagcggaagggcacaggactagaaaggggttaaaacccccagtgatactgccaacccaggaggcccccaaccgcgtcctggctccagggctgccattcctggatgtccccaaccccagcttttcccgtgcctcctgctctgcagcccagaggcagccacccggcctttatgtcccgcaccggcagggcccagaaaccagcctccagggcaaaggtggtggcgtcagtcactgcctgtgttgcaatgatgtgtgaaaaaatcctcatggagtcagtgagtgactccatccatccttcctcattccatttaccatcttgcaagtaagactaaaactataattcggagatcttagctgtaagaattttatacaattctggaacctggaaagtgtgtttcctcagagtgatctgcggtaagctgaaaggtgaaaggggcctgttttgggcagaagtgtgacccttgcaaatttgtatgttgaagtcctaacatatagttactgtatttgggtctgtaaagagttgattgagttcaaataggccattaggatagggcctaatatgactggtatcccctgaagaggaggagattgggacacagacaggtacaggggaagaccatgtggacacagggagatgacagctgtctgcaagccacagagacaccaaccctgatgacaccttgctcttgggcctcaaacctctagatctgagaaatcaatgtctctggtttgagtggcccacctggcagccagtcctgtaagtggagcagaaagtgtgggagacggggctgtaaagaggaaagaaagccacccgggccctggacccagaggcagcaggtctgagagcggacggggttcctagaggaaagaccctgggaggcccctgcccgcagaatgtacagagtaccctgaggaggggagaattaccttcagaagcagacagcacaggcgctgcaccccgcacagcgtcactggccacccgggagagcagagacagggagccacaacgagctgatgtcaaagtgtgcggagcaggaagagaccaagcccatttcgccagcgggcagctggcctgggtggcgcccacaaccacaggggcaccccaccgccgttaacatgccatgagcgccaggcccaggacacggccttctcagcctggacaagaattgaagtcgtgggttctagaccagctccccacacccagttccaatcacaccagcatttgggcatctagaatatgaagaaatcagagctagctgatctctagggtctctttttgtactaaaattctatagttttgattcataatgatgattcatagtgagtcaacaagaaaaaggttaaattatgttctgaatatgctagttaggagaacaggcaagcctgtactctattgtgtaaatgtttcaaagttattggaatctgaaaactgttttgttgtttccagatgaaaggttcagataggggaaaattgattttagtggagcttctcatcccccctggtgcacaatgagcacaaactgtacctatctcacttgtgtttcttcttcagagccttctgggcacaaggagattgcaaattgcgccttttcaagttgagagtttcgaggccaaaagaacatattataattgtgcgtataatagcacttaaagttgacatgccatatctaattccaattttctttcagaaaattggattttcccagaaaacagaagttgggtatttacaatgcagtcggcaccttctttcctaagaactcagtgctttccaaataccaagaatctgtcttaaaattctttaaaaattgcaattattgcaaaattaaaagaaagggatttagtggttgtatctctgttccctccctcttagctaaagccacatgacgtctttgtttttcaatccacacccccaccaaatagacaagaacaccaccacaacacccacagatacctacccgcctgacctacagccgcagaacccagggcagagtccagaggagggagagacctggtctctcctgaggacatgcccctctctccacggttctgtctcctccaccctcactcaccaggactttcctggactccgagttcttctttcttatgttctgttggtttggtcattcctttcccattttatcctgagatgaacaatcacacttaaaggaaaagagtagttctctcagtccgaatcctctggcacactggacatgcttgttttctgtgacctcctggggaagggagcactcccacaactcctgttggcgagggcggcagatgcccaggttcatccagctcctccctgccctaaaagggtcccaggacttcccccagttttctctcaagggggacacaaatccttctgtttacattgactcattcaactaacatttgtcagaacgctaatgttttaggtagactcatagaatgttggagtttcgagaagacacaaaaataatctggtccagtgccttcatttggtggtgagaaaactaaagttctgtcaacgaaaagggtcaagttctgtaaaatatttaaagatatttattctgtgccaaatatgagtgaccgtggcccatgacacagccctcaggaggtcctgagaacatgtgtgcaaggtggtcagggcacagcttggttttatacattataaggaggtatgagacatcaaccaaatacatttaagaaatacattggtttggtccagaaagatgggacaactcaaagttgggggtggggggccttccagactgtaggcgaatttaaacattttctggctgacaattggatgagtttgtgtaaagacctggaatgaatagaaagggaatgttcaggttaagaaaaaagattgtagagactggctaggcgcagtgggtcatgcctataatcctaccactttgggaggccaaggtgggtggatcacctgaggtcaggagttcgagaccagcctgaccaatatggtgaaaacccacctctacttaaaatacaaaaaaattagccaggtgtggtggaaggtgcctgtagtcccagaggctgagacaggagaattgcttgaacctgggaggcagaggtcacagtgagccgagatcgtgctactgcactccagcctgggcagcagagcaagacttcatcaaaaaaaaaaaaagattgtaagattgtggagaccaaggttcttttgaagtcttatcatcgtggctgcccttagaggcaatagatgacaaatgtttcctattcagacctttaaaaggtgctaaacttttaataatctcattaggattgggagggcctggaagaaaaacatctagctatgttaatagagattctttacagatgcaaattttcccccacaaatgacagttttgcagggccatttcaagatatggcaaagagacatgctttggggtaaaatatttttattttctttgattgtcttgtaatgttaaatgccagagtcactttggaaagtaagccatgatgtatggatttaaataaaatccatctgatgagactttatggtttgtaaggcatgactccccagaccacttagataggaatgtgggcaagataaaaaacctcagagtttagtcctcagttcttagagaagggacttgcccgatggagaggttatgaaatatgttgctggcagaacaggactggaatccagccacttaagtcctggcctgagcatgcgagggttcctgtcttttcctgctggccatagcttcaggagcaggctgtgcagcttcatgcattgggcatgtgctgtttccaaacttgaagtcccaccctctccatgcctgacaccccaggtggtagctcttgcactggcacatccgtgggctttgacaaggacacagtctgctcttctgcacatgacggccgtcaacactgagataccaaagacagctttgtgttcccccttcacccttgggcttccctccagcccaggaagctaagactttccacacatcaagagaccaaaagagatgttgcttagcttttgattttttctttgaaaaaaaatctggtaaaacataacataaaatttatcattttaactatttttaagtgtacaattcagtggcattaagtacattcacaatgttgcacaatcacagctattcccttccagaactttttcatgatcccagacagaaactctgtcctcatttgctattggctgctctgtgtcttcaaaatttctatgttgaagtcctataccccagtaccacagaatgtaattgtatttggagacatggtcttccaagaggtcaaaacaaagtcattggggtgggccttaatttcatatggctggtatccttataataacagaagatttgggccagtcgcagtggcttatgcctgtaatcccagcactttgggaggccgaggtgggcagatcacttgagtcaggagttcaagaccagcctggccaacatgatgaaaccccatctctactaaaaatacaaaaattgtggtggtacatgcctgtagtctcagctactcgggaagctgaggcagaaaaattgcttgaacctgggaggcggggttgcagtgagccaagatcgcgccacttcactccagcctgggcgacagagcgagactccgtctcaagaatgaataaataaataaataaataaataaataaaccaggagatttggacacagccacagccaggcacagaggaaagaccatgtgaagacacagggagaagacagccatctgcaagccaaggagagagaaatccaaccctgctagcatcttgatatcggacttctgttctccagaattatgagaaaatgcattttaccattttaactatttttattgaactatttttatttaagctagccaggttttggtattttattatagtagccatagcaaactaaaacaccattaaataataacttcccgtacccactgtctccagcccctggtaacctctatcacacagtctctatgactttgcctattctaggcccatataaatggattcatacaatatttgtccttttgtgtctggctgatttcatgcagcatgatgttttcatgctttatccatgtcgtagcatgcgtcagtacttatttctatttccaaataacattaaattgtatggctatgccacattttgtttatccattcatctcttgatagatgtttgggtagtttccatattttggctattgtgaatcatgctgggttagcttctgactttcaaaataagccaagataatagtttaagagaaagagatacaggatttccagagctgagtttatgtcataaaagagtttagaaaattcgtgataatgtaagatcctgttttcgctctctagactggggagaaaatgtgttcaccttgccagctgcccagacagagctgatttatcaagacaatacaattataatggagaaagagtaattcatgcagaaccagctgtgtgggagaccagagttttattattactcaaattactctccccaagcatttggggattggagtttttaaagataatttggcaggtaggagcttgggaagtggggagtgctgttggtcaggttggaaatggaatcatagcgggattgaaatgagattttcttgctgtcttctgttcctgggtgggatggcagaactagttgagtcagattaccattctaggtggtggtagttgatccatccagtgtatggtctacgaaatatctcaagcgctgatattaggttctacaatagtgatgttatccccaggagcaatttggggaggttcagactcttggagccagaggttgcatgacctccaaactgtaatttctaatcttgtagctaatttgttagtcctgcaaaggccgactagtccccagacaagaagggggtcttttcaggaaagggctattatcagttttgtttcagagtcaaaccatgacctgaatttcttcccaaagttagtttggcctatgcccaggaatgaaaaaggacagcttaaaggttagaagcaagatggagtcaattagttctgatctctttcactgtcatactttccttaggtataatttttgcaaaagcagtttcaatccctccctttgggtttcaaagcatcttattcttaaggtgtgggctatgcagatgggaaacagccatcaatcactctggcttctttctcctgacagggggcatagtgggggtaggagttgactcccaggtgagaggagtggaaccactttgtagttgtctgagttttttgagcatactcacataggctgggctgggagtccaaggttttttttttctgagacggagttttgctcttgttgcttaggctggagtgcaatggcgtgatcttggctcactgcaacctccgcctccttggttcaagcaattctcctgcctcagcctcccgagtagctgggattacaggcatgcaccaacacgcccagctaattttttatttttagtaaagacagggtttctctatgttggtcagcctggtct

SEQ ID NO: 12388 - DNA, 94156 bp, Human
  misc_feature (1)...(94156): n = A,T,C or G
tcttccatttgatggagtgaatcgccttttaaggatgctgattaccagcgatgaggtaacaagtgtccccctctctttttagctagagatacaagattccattctcctctgttgtcctaacaaaagtgaagccattttgtgctcagaggcaactctcctgacccctagtctgggccagaaaaacctgaggagctaaataagtaaaagaaagctagcttacctagagtaaaggtggaaaacatggaaactcagagggaagactctagtaaaggatctagagaatcatctgaaccttaaataaagggcaataattagagagaaattttggaacaagtctccaccactcccttccagtccctgtcatttttgtcattttcatccttggtcaaatgactgatacttctggtgtggcaatttagaacagtgatagtggatgaaaaagtagaaaagatggaaaaaataaatgatgacaattttaaggacagtaactaaagtttctttcttccatatggatatgcaattgaagtgtattaaaggaaaagatcaaaggttacagccaactaatcaatggattattgatcaataactgaaaatctatcaatgtgaagtatacaaaatatgcagcttttccccttgccctgctctatactcagaattaggcatcactgatgtctacttgatttctcctcttgaatgtctccaaggcaaccaaactcatatgttttctttgcaaacctgttccttttctggtttccttatctcggtggataacttcatcagccagttgtgcaaaccagaaatccaggagttatttgtttctcctagccttccaccatcatatccaatccatcagagtccttcaattttacttcctatatctatctcaaacagatccatttctctttggctctgccaccaccctaactcatcatctctcccctaaacaattactgctccaaagggcatccactccatcctttgtcaaatgcattctccacactgcactactttattcaacaaatatttttaaggaacctactttgtactgtagtgaataagacagacgaggaatttgtggaaatagaagataaacatcaggcagtcaaaagcactacgaggacaatcaaagtcgggtgatgaaatagagagtggctaaatgactattctagactgtgttcaaacacaagaaatcggtggcagttttaacaaggggtattagttttgacacaggaaaatgaaggaagtccgctgggacgatggtatctgctcctagcatataaggagtgtgtttctgatactggccaataataaaaaggaggttaaaatgtacatgaacattcaatctagggctgtttgtctccaattacctctgcttaaacatagcacttactacctatatggaagtatcttatttttgttaacttctgtatgtctcccttctttagaatgtaagctccatgaacatgcgggccataactgtcttgatctctgcagtaactacagtgcctaagagaactgagcctggcattacggtaggcatgcaaataagtatttgttgcattaacgcacaaattgctgagtgaagcaggagagtagacagagaatataacggattgggtttgggggctgaggaagtctctgctgagctgtcaaggtcatttacttccccttgcaaggttaactgggttataaaatcccggccacgctttagcaccaagcatcaagcgctcacactctaacttatacacacgctcacagccacaaacctctccaactccccgctaggaggagtcacacctccccacccagaaaccctcccaccctctcctctatttctccttccctcccctctccgcggggttccggcaggcttcgaatcacaatgctcgccgggaatagtagtcttccggtccgagcctatggcgtttttaatgcatttccagaactacgcttcccagggagcctcgcggcatagtgaggctgagtcacctgaccaagaccctggagttacaatggcggcgcccatgctgcgctggggctgccgtggaagacgttgggctttcgcccgggttgacggtggttcttgccaccgaagaggggctccgactgggtccacatccaaccagattaggggagagagctcagtggctcagcagcccctccacacggcccagaagacgaggaaagggtattctgtttcatacatttctgcccacctaactgtgaggtggaactgcaggactggggaaataatggcaattacggcccagcttctagacgttttggctgacgggagggcgttgagttataacctggagccccgaaacctaaataaaagcacaaacagactttctatcaactccgcccccatatataaaccactgttttcaaatagatgtagttggggaattcgcgagtgtaaaatagcaaatattttcttgaagggtgcacagacagaagagtggattcggtcatcttactaatagcactagcagtggggacggtgacacgagaagcgggatcatatttagctgattttatttagcgctagtatgggctggcagcgttctaaaggtagaaagggagcctttacctacaagctcttggtagtggtgggttattgtcattagtcagaaaacactagctatctgtgcaggcgttttatgttggaatatgtgtgactagacctaggaggacgcagccaaaagaagagatactccccctggttatatggagagttttgcttatttggccagatatcccctgaacagctgtttatgcttcattatgtaagaattaaatagtttctctttaaatacagaaacatatggcaagtttctaatattttgtttattctttgagactagttggcattatttttactttcagttggaggaacagagggaaattgtccagaaagaagtattcagttttgtattcttttcgtgaattagattgtttccttgtgaatggaaagtacattttttctctcatgtaatggaaatgcaaaaatactttgaatggtgctttactgcatgcagaatttctaatgagttcctactttaattcccctcccttatgggctgtgtttccaaactttaaaaagaaggacttattcttgcagtacttcagatatagaactttatatgttgaaatgattgaaacaaaacaaaacgatgtaaaatatgtatatatatatatatgtatatacacaaaattacttgggagaagagcaggataggaacatacatggatttcatagggaataagcacatttataaggacctggagaggcctatgtacagacccaacagagtaggactgaccagataagagagattattatagcatttaacagcttcttagatttgatagcaaataagcattaaaaaagtaacctgaaattaggtctcaggaattgaaagtgatttgggggaccaaaaatatgccgcatcagatggtttagtgtggtggagttttgcaaaatttttttaagagtatcatttagtggtgatttattgtatctgtgtctctctggttattatacatgcaaaccaaaacatggttgagaatttcctttttaaataagagacgtggaactatttatcattatttctctagtagtagaatgttgccatttatgttaattctagataatgtgggaaagatcagctttcatcatttactgagtgattacttgataagttacagttaatttgttaaatgccgcttttcactgaagtcagccaagcagttgtcacctgatacccatttctaaattgttttaagacgccaaattgttcctttctctatagccttcatgtttatatcatcagcctcctgatgccatgttgtaaatgaattttagtttgccaatctcagtgtaggcgcttattctaaattgttttttatttagtcactgataaaatatgacacatttttaatgtgaggatataacattgtattaagtttaaaacacatataggaaattaacatttgtggtttagacttatagaaattcattcatggtgacaaatataatacatcttaaccattatctctttcttcttagtgaacacaaatgggctgctgtggtaggtttggaaattcatgcccagatttcctccaactctaaactcttctctggatctcaagttcgcttttcagcacctccaaattctttggtttctttttttgatgcatctctacctggaactttgccggtaagattcttatttaatcctattttcattagaaaaatgtttattttatattgaacatggaaaattattttcttgttttaataataacacaactctttggaaatacttatttagggagttttgggtgaagcgggatatattaaatgttttctgaagacccatctctgtgatgctgtttctaagtctgaatatattcatacatgtattcatcacttcacaaacattttagcatgtctactaataccagacattgggctttgagctgggtcataaagatgatccttgcctttaaggagttcaaaaactagtaggggagatgtgtcttataaacaaacagagaacagtgtgattccttctttgaaggtaatatgcagaggatgatttcgaaacccagaggagggacaactaattcagtaaaagaaaggactgttgtgagaaattgaagtaggggtactttaggttaaggaagggttactgaagaggtggtggcctgagctatttgagaagcccaataaaatttaggcagataaatgaaggaggaggaggagtcaactcaaagcaagcagtgtatattacatgattttacagtgtaaggccagtaatgattgtggttattgcaaattaagaaacactcaataatgtagaaaacagccataatatgcagtgagttaactattgtactcacttaaccactcatttttacttgatcctatggaatgactgggcccagtatactcatcagcaagacttttggcatatatttttatataattggttgaatttttaagaaaagtatgaagggaacaagtaaatgttttagctaataaatagcatatggtctgtccaggacctataatatcaactgtgtttggggtttcctgccatctttggaggaaatgtgtatccatggtggtgacaaaggtggggagaggcagacattgtcatgggtaaattccatgctctcaaacatttaaataagagtggaagctggttgaggccgggcgcggtggctcacgcctgtaatcccagcactttggaaggccaaggtgggcgaatcacaaggtcaggagatcgagaccatcctggctaacacggtgaaaccccatctctactaatagtaaactgcaaaaaattagccgggcatggtggtgggctcctgtagtcccagttactggggaggctgaggcaggagaatggcgtgaacctgggaggcagagcttgcagtgagctgagatcgcgccactgcactccagcctgggcgacagagcgagactccatctcaaaaaaaaaaaaaaaaaaaaaaatctggaagctggttgaactgagcactggcaggnnnnnnnnnnnnnnnnnnnnnnnnnnnnnnnnnnnnnnnnnnnnnnnnnnnnnnntttggggcagcatctttgtcttggaacttttctcttccgcattttctgtcatggaggactcccttccctgcagaccatatcaaggatcacctttgatttgctgctgggtccctctgggagaagatagatgtggaggtgtgccctctttctctctctctgacttagagatctatctatggaaagattttttgtttatttgagaagagtgaatattttggttataaatatatgacatcttttttgggcagagattcagatatagtagagatacaataatatttattgtaaaatggaaggcaagttgtcataacacctctacattttcccttccagattcaaaacatttttttcccatgttgtagttaattatcaagagattaggcataagctctgagttcatcctaggtttttccagctgtgaatgtgatggctatcaggccatacttattacagttcactttagaaacaggtccatttgcagataagcatgttttctgtatatagactctccagctgtacctaaatttggtcaaaaattagaccaaattagaaaaattcaaaataattaaaatgccaacattttaattgctttgtaaaacttgtcatgcaccaaaaaagaaggtgcttgttcactgataagcatatcaataacacagtgaaggtgtttgggacatttgagtgttgagagcttggcttacattaattaaatggcagacaaagtctggaaatacagttttgtatgagctaggatttgttttcctcttcagagcctacaacgcttatggtttaagtagcctagatgggttattctgtagacagaggagatctacctcttcttcagaaatgtttctgcctttaagggacctcattttgtacgtgagcaacattatacccaaactcccagaattaagcattgccattcaaaacatttcaaaatcttttgatttacctctaaatagatttaaaatacactaaaacctttagacagttgtccttcccctaagccctatggagatgtataaacatgctctgatagccagactctgcttataactccattcataagaaaccaataatttgagaatatgtttgtgcttccgaggattttagtagaacattatgttattgttttggtcaagtaaaccaaagtgtaagtgtgattcatgatgatacttgaaactctttctgcgcagggcttatattgctcccttctctcctgcttcttccccgccctctacctggctgattgtgccttctcacatggctgtgttctgccactcagccctgaaatgttggtttcccatgccctattctttggctctcaattcttctgttacctgtgttcccctgagtaatctttttaccctcaaataaagctcccctctctcttttaggcaagaaacctatatctattgtgtcctactatatatttccatctgaatgattcataaacatcttaaattcagcagttacagtgttaagcctgttatcttttctccccaaagtttcactgcctcctgacgaaagaataaaccaacaagggaaaatatatgtaagaagaagcaaaaatcagtgggaaaaggataagttatttaactgatggttttggaattggttagctatttggagaaaaagtatcgctcatttcacacatcaaaacaaagttcatatatatataatataagttaaatgtcaaattaaatccagaaatatctaggagaatatttgtttgtccttgggttggggagaaactttgtaggcataaaagcaagaaaaaacagctaattaggcaaaatggcaatttgactactttattcgcccaacatgtttattgacgtagtaattcttttaggaatctgtccttggaaaataaacatgtgggcaaagacttatatgcagagatgtctatagcagatctatttttaaaggtagaaaattggaagtaaccacagtttctcagtgatgggggaatcattgagtaaattataatacatcagtacagtacaacattatgaagccactgataatgtttataatagacttttagtgacataggacaatgctaaagataaaaattctagtgagatgaatagaattttcatgtagattacttaatcttctttgcatcagtttcttataaaatggagataattgactcattggatttgtgtgagaattaaatgaatcagtacctttaaaacacttaaaacagtaattgcatgtagtaagtgctcttattaattaacagataattaacaagtaataacaggtaattaattaaaaagctcttaataataggtaaggtaaatcttacctgctagcatacccataatgattggtggcttttatctttacaaaggctctcctgagttattgtgcacagttacgttgccagtgagagcaaaagtaaatgctacacataacaattggtcacttaaccttgatttcaccagttaagtgatctgccaacaaaaactaacctgggtatctcatcacctcagagatgtatagagaattaagtaaataatgaaaaccagtaaaaactagtatatggataaaattatttctgaattagaaatcattacttttattgcgaaaaagaaggcttatgagcttttttttttccatctgtagttatttggagtgtttctttggttcaacatggtattggctcttgatttagtaaaaaattaggattgtcacttaaaacaattgttataatgtatagtctttctgtagacatttcattcttcttctctgtcggttgtgtcttcattcactcagctggcatatattggatgcccacgttatgctagcccttgtgtagctctagtgacacagttttgaacttggtagacgatagatatgggtgttgcccacatggagcatgaacaagcaagcaggcagttgcactaccttttaataaacatgttagtcgtggaaatacaaggtgcttgaggagcacataggaagagtattcaacacagatataaggaattgatgaaattggccaagtagaaagtgaataggatgtacaaagaccagaagaaaaacaacgtggcttgctctagaaactgaaacgttttccatgtgttgtagcatagaatttgaatatgggcattgcaagaggtgaggctagagcagaaagcatagcctgtaccatataagccctgataaagggtgtggatcccatttgcaaagaggtaagaagacgtaaggagagtgcagggccagaaactccaaggaagtgagtgttttgagaaggagggagtacaagaacattggatgctactgagaggtcaagtaaagtgaggactaggaagtgcccattggatttattaagaagggtatcctttgcaagaacagtttgagtggggtgatggaaacagaaggtaggtggcagtggattgagaaatgtcatggcatggaggaagaagtgagtgtgggcaactgtttcaaaaagttttactatgaaggacaacagaatgcagcaagtgaaaggagacatagaatcaagagaaaacatttattggtcatgtctttcttaatattggagagacttgggaatgtttaaatgctgatgagttatgtagtctatgatagtgtacacttaaaatgtgtttaagaggatagatctcatgttaagtgttcttactgcaataaaacaaaattttttaaaaatgctgatgagaaggagccaatgaagaaggggtaaagacaggagaggcttttgattaatatgatcaactgaacacatgcattttaatccatcctctctgtaacccagagaaaccccactgaaatcatagtgaaagaatgcaaatgtgataagcctacaaaagaatgggagaggagacaagagtgtgtgagagagagatggtaggtggaggagggcctcactttgcagaggatgcactgtgacctaagtgcctgcaggaagggacactagcgagaactgagatgatgtgtcctacacaaccttaaaaacgctcaggatgtgggggcgtcaagtattgtggaaggctggctgaggtgaaaacaaaggggttgagtcagagtctgagtacagtgcagtgagatctgagcttctctacctgaccctctgcagctgccctacccccataggaatgtatagtctttggagaaattcagctcatgacacactttccctgaggccaccagtcagagcaaaaggcggtatcagacagcatctgtagtgaactccaggacctacccagttcttttccctgccccagtgcgggaacttaggtggcctggtatgtccatctttcctcttcccctcctcccccaagcaagaatctgcaggagcttctttgaagattgtgtgaccctagtgggaagaacatgagatattgacatggtgggatgtctctcaatttaaaaaaatctgtctggccacctgattgctttacagtgaaggccactgatgaataagccctgggcatttacataggacttttaattggcattttagtatcttactttaaaatatagattgagagccaaaaatcaccaggcacttgaggagattctccaacatgatagacaaagctcaaaataaaaaagaaaactaaaggaaataggaggctatagataatgcacagggtaaaagaatacttaaaaaattaatagcttttataaatgtcctcagagagataagggaaggtagctgcctctttgaaacaagaacacaatactgcttttaaaaaatgaacaaacaggataaaaacgagctcttagaaattaaaattatggtgcctctccttcccctgggaaagttagaaaataatgtcaagaaaatcttccagagatcaaaaccaatgtgcagtgcattggacaatagaagaaaaaaataagcaaattagagaatcagtccaggaagttcagcatctgattaataagagactcgtgaaaaaatagaaaacagagtcaaggaaactctcaaacaaaacacgtggattaatttcccagaattgaaggacatatatctctaaatggaaagggcctgccaactacccagcctgaggaataaaaatagtctaacatgaaggcatgtcaagaaacttaataacactgagaataaagttaaggtcctaaagcttacagagaagaaaaaaataatcaggtccacatacaaaggattgggagtcagacatcagacttttcaacagcagcacttatacctgtaagagaatggaaccatgccttaaacattcttaggggaaaaaaaattataattctaacctagaattcggtacccaacagtgtcaatcagatgtgacagtagaagaatggtattttcagacagactctcaaaaagtttgcctttcattaccccaggaacctgctggaataatagagaagtttcaggttgccagctctaccatgagaccgttggaagaggaggaaggtggctccagaataaagaattctaggaaaaaatgagagtagggaattagcaggtatctgatttgtgtggaaaaaagatttccatataatctagcctttagaggaatgagcaataggtacataaaaaatgaagcacatgaaaacaatgaagggcttagcaagtctaggaaaaacaaaatgttcaagaaaggaaatgtaatcatagtgttttattagcttaggagagaaacatgtaaataataatagaagcaccagctactgatttaataaaaactgtgatataacttggatattgggaaaagaactaaattcttacctaccataattggaagtcatgttctaaattggtaaagcaagaaaaaagtaacctaagtataggctgtaggaacatttttggccactgattggaggcctctttctccttttcaggccttaagccagtagatgggttttattttgttgtgtttttctttggcggtgaggtgggatgtgggattgtatttgtgttttgttttgttttttaattaggtgatgggtaaatgatttggagctcccaagaaacagactagtagtcaaaagcatttttaaaaacaagatttatttttattttatatacaagataacgttaggtaataatcaaacattacctgtactggtttctcagccttctgctggtgaagtgcttttcattttgttttgttttttgttctcaaagtccaaataatgagtcccctaccacacccctgttctcacaactcttacccttaccctgattttaggagaaatagactcatccacattctagatccatccatactcaagctcatgcatgtaatggctctgtctgcttccctgggggagacatgacctaccatccttttttctaactgactttatggacttttatgttacccaacttctcatggcagggcttttagggagtgggtatattttatttttggatagaaatataatttagcagctaggcacagtggctcgtgcctgtaatcccagcactttggaaggctgaggtggttggatggcttgagcccaggagttggagaccagcctgggcaacatggtgaaaccctgtctctacaaaaaaaaaaaatacaaaaataagtcgggcatggtggtgtatgcctgtagtccgctgcttgtggggttgaggtgggaggatcacttgagcttgggaggtgtaccacggcactccagtctgagtgacagagtgagaccctgtttcaaaaaagaaaagaaaagaaaaaaatataatgtagcagcaagcttgggtaattctttgataaagtaagatataaaaatattgcaaaatgtctcatattgttattctcttatcttgtaacttatctcagttatctctcagaaatggaatgggccaagtcttaggagtccacgttcttaaaacaagtacactgtatcattgtgacagtttatcaaatctatcttttttccagattaaggaaggattgtcacatagcaaatggccaggagccttggccaacaggtgatggattttccaaaggtcccctggcacagcatattatttaaaaataggaagataaataccaaacgagacagctcaaagatctgaaggtggttgctgccaggaacaggacgggacctaggaaggggtggggcggggaactgctgcttttcatgatcagttatttaaaaatacatgtctgtgatattttgtttaaaaaacttaagttaggggctgggcgtggtggctcacgcctataatcccagcactttgggagaccgaggtgggcggatcacgaggtcaggagattgagaccatcctggctaacacggtgaaaccctgtctctactaaaagtacaaaaaattagctgggtgtggtggcggacgtctgtagtcccagctactcgggaggctgaggcaggagaatggtgtgaacccgggaggcagagcttgcagtgagccgagatagcgccactgcactccagcctggcatgagagccagactctgtctcaaaaaaaaacaaaacacaaaaaactgaggtttaaaggaataaagatataagggggagggaattgttgatagaataaggttcctaagaaagcagacaatgtctccagagctgtggagaaagagccctctcctactgtaacccgaggggaagatgtgtccctctgctcccaggtgtgaggaagttttgaggtttggttgtcaaaggttgaggaaacacctctctgatttttttcttttttctttttgttttattatatatatataattatacttgaagttctagggtacgtgtgcacaacgtgcaggtttgttacatatgtatacatgtgccatgttggtgtatttacattaggtacatctcctaatgctatccctcccccacccccaccccacaacaggccctggtgtgtgatgttccccttcctgtgtccaagtgttcttattgttcagttctcacctatgagtgagaacatgtggtgtttggttttctgtccttgcgatagtttgctgagaatgatggtttccagcttcatccatgtccctacaaaggacatgaacttatcattttttatggctgcatagtattccatggtgtatatgtgccacattttcttaatccagtctatcactgttgggcatttgggttggttccaagtctttgctattgtgaatagtgccgcaataaacatacgtgtgcatgtgtctttatagcagcatgatttataatcctttgggtatatacccagtaatgggactgctgggtcaaatggtatttctagttctagatccctgaggaatcgccacacttgtcttccacaatggttgaactagtttacagtcctaccaacagtgtaaaagtgttcctatttctccacatcctctccagcacctgttgtttcctgactttttaatgatcgccattctaactggtgtgagatgatatctcactgtggttttgatttgcatttctctgatggccagtgatgatgagcattttttcatgtgtctgttggctgcataaatgtcttcttttgagaagtgtctattcatatccttcgcccacctttgatggggttgtttttttcttgtaaatttgtttgagttctttgtagattctggatattagccctttgtcagatgggtagattgcaaatattttctcccattctgtaggttgcctgttcactccgatggtagtttcttttgctgtacagaagctctttagtttaattagatcccatttgtcaattttggcttttgttgccattgcttttggtgttttagacatgaagtccttgcccatgcctatgtcctgaatggtattgcctaggttttcttctaggtttttatggttttaggtctaacatttaagtctttaatccatcttgaattaatttttgtataaggtgtaaagaagggatccagtttcagctttctacatatggctagccagttttcccagcaccatttgttaaatagggaatcctttcccgatttcttgtttttgtcagttttgtcaaagatcagatagttgtagatgtggtattatttctgagggctctgttctgttccattggtctatatctctgttttggtaccagtaccatgctgttctggttactgtagccttgtagtatagtttgaagtcaggtagtgtgatgcctctagctttgttcttttggcttaggattgacttggcaatgcgggctcttttttggttccatatgaactttaaagtagttttttccagttctatgaagaaagtcattagtagcttgatggggatggcattgaatctataaattaccttgggcagtatggccattttcacaatattgattcttcctatccatgagcatggaatgttcttccatttgtttatgtcctcttttatttcattgagcagtgatttgtagttctccttgaagaggtccttcacatcccttgatttttttcattttgtagcagatattgcttcttacatctcactctgcttttgggcaccgttttcttcctgtgttggtggctcttgctttccaggtctgtgggtgatgaactctcttagtctgtatgtgcctccagctgtttctgtttccccctcactctggaatagtagtatagaattccaacttgacatttatttcccgttggcacttgaagacatttttccattgtccttaggcatctgtaattgctgatgagaagtctgcatcccttgtcagtaatctgttgtgtcactctgatagctttagccaggatgtgtccatatgtgaatttgtttttatttattctgctcagtgtgatttttaacttaagtactgtaccctggactatggaggtatctctatggaatgaattcctggtggcctctgccagggcccattgggttttattgaatgaaccggtttgtatgttaatttcttggccccctaactgccacacagcttagatagtgccagcgtcaagctgcacacatccaagccaggcacagggtcaagggctcagatttctcaagactctttttcacctatggcctgaagtagctggcctcctccacagcaacccctccagttggtggcaaaaggttttctaactggactagaattttttggctcacagctttatgcaggaagccatcccagctccctatcacatgggctcatggccttgacttctgcccccaaggtgctttaaagcattgacatctgatgtctcatcagcccagttaacaataataatggtagtaaaatcaactaccatgtaccaagtgcttaccatgtggcaggcactgttctaggtgctttatatgtattcacttattctaacctcataacaaccctacctgccgcagttgctgtccttatcacagttagaaagtgagtagaaaatgtgttgtcctgtctcttgtggttacccctggtgtcacatggctttaaactaccattacttctgcggccccaggggattttcttgcttgctttgagcttggctctgggcatgtacacatctgtgtatttgtaaatttatatgtatatataaatgtatgtgtgtataaatagaatacttcatttctgcctcctgcctccatctccctgttccccagcatgtctggagcacacctgctgtcttgaccaaccccctccccgttctgattagtaacccttattctgaatgttttttaggatctttttattttcttattttccctcagttttaggattttatggaagcccatcataaatcttgaggatgaaaaggtcagccagcccatttcactgcttataggcaggattacagctacactaaggacagcattctttgtttttattagtagggattcagcttcactcattatttggacctagtaaaatctctttactgtggtgccaagtcttccttaatttattaagtaattattcacctatagatctatagacaggatcttaggttgtttgcttaaagttagttatttcctatttaacaataccattccaatttttctacttgtaatactttgtatatggttgtgaaatgggaagaaaaataagaaagaaaatatatttgtttggtaaaatgtcatgggctttacaagtctgtttcataattggccaagtaatatttccagtaatggtgagatttcagcaaagaatcaagtttgtttgaaatttatgcatgtgcaaacccatgtttacacatacacacacactcactttttgtcatcggaaatgcttgccctctcctggtgtcagttcccacgcaggggaaaggggagaggacaccgttgcctctgccgtagctggctggtaggaatgctcagtgtggcacagtagataactcctgataatcaggctgcactacaattcatttaataagaaatgagaagctctgctcttgttttgcttgtctgaaagctcttatctgtatgtaacatagaactccctagcaactgtgaatgcctcttgtctccagaactggggaaaagaccataaaagctgtttttcacacatgtatgcaagaatattctcctcttttctcaggatcagcctgtttaaaaaagcattcagggctttccatatcaaaggtatttagaattggccctggaagctatggaatgaaaacaggaatgttgtttactacattttacaaaactttcttttattcacaagagtgcatactattattagccagaataaggggaatgaagaggggaagaaatatgatgtgaataaatatgatgtgatgcctgccctctgggaactaacaaacaatgcaaatgctgtgctttctgctagagattccttctggaacatatgtatgcacattgcagcagaaggggtcttgcctccctgaagaaatagtgatgtgaacgcttttctaaagtactttggaattaatttattttttagattccttatgacagatttcgttcaagctaggtaaatctgcagcattccgactctgaacatagaagatattggtgataacttttgttttgaagaacctgctagatttagaaacccttgactagtctagggagcatcaggctttctgaaatgcttttctggctcttaattctaaacataattataaaagttgtttttaactcaaaatgtagaaatgaaacagaaattgaagatagcatcattagggaaaagtctttaaatacgtacatttataatcagatctacatttatctctccgtccattcacacttagatgatgtttagctatttaagaagacaaaatgtgaccattttctatgaaatttctttccatttcaatgatttgctttaatgtaatctgaaagatttataattatgttgtatactcagacttgcttcttgccagtcactctgcaaatcacttctatagttatcctccatgcttttgagagtgaggtgttgcagggattaggtgttttgtatagtgacccttgtcaccctaaaggaggtatgtgtctgtgagctcatacccacaaatgtggaatgttccttttcagcttttactctgctgatggtctaaacctgccttataacttagttaaccggatgtctcccatgaactcagtgactcatgacaatgatgactttcatgttcaggaggcagcatgatctcacctccctccctgtgggaagcatttgactccttccctgccatagatctttttctaactttcagtgggttcttgaaagcctctctcttcacagcaattttcacttccctacctctctaccagctttgcatgcaatattccccacctgaaacctaaccatattaataataatgcttctactatttttatttttattttttttagagacagggccccaccatgttgctcaggctagtttctaactcctgggttcaaggagtcctcctgcctccacctcgcaaagtgggattataggcatgagccaccatgcctggcctctactttctatcaatatgtatttgtttcatacagttgactgaacatctttttatgttttatgtatgttgtttataaggatttctgtgtttgattatacgcttctaaagagcaattcatggatctttcttgggctacttgacagtaccttgcatagaacatgtgtatagcaccccttgtaaatatttccctatatacttgcatacacgtacatacacgtgcgtacacacacgaggcatccatataaaaggattttcctgtctaaaaccctttagctattttttaaacttctttatgggtctcttgtcctggctgaacataagacaaccttttcttgattacccaagcttatcagcaacatcagttattgctcagtgttataatggtggcttcaaggtctattgaggtgtgtaaagctttttgatcctacagtaaatggctaaagatagccattgtttttaggtttcatattacagtgtttttccctgcttttatggttatgtgttcctcactgggtttttaaagctgctgtcagtatatttggctctaggaatcccttcttgctcatttttcacttctcaatgattatttctgattagttcacaaagtcagattatcacttttgtaaatataaataagaacaaagctctgagtagaaacctgtcctacaaaagaaagtacatggatgctatgaaagctatttagcatcaccatgtgacaatagaataggaagaggtcctgaaaatcattcagttcagtccttttaatttacagatgagagaactgctgttgggacttacccatggtcacacaatttcttaacattccattcagattagaaccaaagtttctcacttccagttcagtgattagctctcaacctgttccactatagttgaagttgctggaagtcagatttatgtaggtggctattattttacagatatgtatatatgagtatacatccaaaaacattaatctcattaacagatgtgtgtgtaatatgtttatagatgtatgtccacatgcttatacacatacagaggcactgactacacagcactgatgctggttgtatgcaccatgtgttatgatgccctctaggtgtgagatctaaacctagggagagagcaaagacaagaatgttgagtcagaagaagaaatggataaaggaaatctcacctaattagcctccaattcagggccctgtgcatcggatttccccagactcaccatgaagaaagcaggcctgtctatgggcagctcttagctgtatgttgatcacgatgcaaatagcggtcatgggaaaattcttttaggatcttttctctaggcttcattctggccagttttctctacactgacttctagttcactaattttctttataatattcactcttttacatatccattgaggtttttagttcactagatctttcaattacagaaattctgtttttctcttttaaatttctctagccttttgaaaataacttgttcctttttcatgtattcagttctttatttctttcataattttacagctacttattttatagtctgtattcagtaattccattacctgaagttcttgggtgatcttattatgctttttgcttgactgctgattctggctggcagtagatgattctctggtgtattttgtaatttttttattatgaagccatatctgacagggctttatttgtgggatcttgttgagagtgcatctctttaaagcacttttgcattggcttttgcctgatgctccaggtctaagccagggccattttccatatttacctcttagcttgggggcttctggaccacagagttagtacatctgaccccaagcctgtctgagagcagactatcaattcttagggcagactcccataccccctgtcccattgccacccaccaaaatctataatctggctgaaactttattaaggttgaaaccttatagaagggaggggatgaaacaaaggctgtgaatatgggtgactcagaatggagcagggaaggcacctttaacctttctctggcccccttgccctgtcccattaagatatccctcccagccgggtgcggtggctcacgcctgtaatcccagcactttgggaggccaaggcaggcggatcacgaggtcaggagatcgagaccatcctggttaacacggtgaaatgccgtctctactaaaaatacaagaaattagccgggtgcgatggcgggcgcctgtagtcccagctactcaggaggctgaggcagaagaatggcatggaccggggatgcagagcttgcagtgagccgagatagcgccactgcactccggcctgggcgaaagagcaagactccgtctcaaaaaaaaaaaaaaaaccatatccctcccttcccattgtaattcttctgtgttgttgtgtatgtattgcagttcacactagttagggccaaggttggtgcacatcccagtaccttttatctgtcctctcatcacagacacagatcaggtgactgagctctttccaaattcccgctagatgtgcaaggatgcactctctcacttattgcctttaaagatgatcattttcccaaaaaaagcttcatccttaataaaatgattcccttaacctttgtgtagaaatgatgatgccatctcactcctcctaaagaacaacaaaaagcaatatgatggtgttgacaggagcagctggctctagtgggagaaatcaatgaggaaattgagagttcgctttcctctccacctgagccttggcgaacctgagggacctcgtctggcctccccctgggtgaatcttctgggtctgcagagcatctccctgactcagcagtgtttcttaggagcttgatgttcctttcctagtaatggaagtctccaggcagcttgctcatctccccacaaattcattcctgagcaagaaactgccagtattgtttgggaaagccttttctcccatttccacatccttttattggtttgttttccctcaaaaatatgcacatggatgagatatggagcaaaataataagcccttattagagaaggcagtgttatacttagaattattaactgttcaaaatgaattttgtacactactgcaaccaaaaatctgtaatacaatagtactcccttatctgtagtttccctttgtgtagtttcagttaccctcagtacaggagaataagatattttgagagagaccacattcatataactttgattacagtatattgttcttttttattattgttgttaatctcttgctgtgcataatttataaattaaacttcatcatacatacctatggataggaaaaaaaatagtctatatcggacttggtaccatccgaggtctcaggcatcccccaggggtcttggaacctatccctcatggataagggggcactcctgtactggaaagagaggtaggagtgtgcagaaaataaagtatgaacacattaccaaagatgcctgagagtacaaaagcttaggagtcttttggtgatataaatatgtagtagtccaaaaaaaaaacctaacagtgttctgtgacactatttttgtctctgccattcgagtagttcatacaggctttgttctggtgatttatactagaagcctataataaaaacgcagcctgaaatcatgcagctgggtaccattcatttttcttccatggacagttcccgaacttaacaaattacggcaggcctggcaaagctcttcctgcaaaggcaatacatgcctggccatggcagctgccctcttgggtttcttctgctttgtggcatcatcggtgatgctgcggggattgctagatggtttttatgagtacatcatgtactgcataatgacattttggtaacaacagactacatatatgatggtggtcccataaaattacagtggagctgaaaaattcctatggcctggtgatgtcatagccatcttgtcatcatggcataatacatgacaatatgtttagatacacaaatacttactgttgtgttacagttgcctacagtattcagtacataacatgctgtacaggttagtagcgtaggagccataggctataccctgtagcctaggtgtgtagagggctgtcccatccaggtttgtatgagtacactcttacgatgttcatgcaacagcaaagtctcctaacaaggcatttctcataacatatctccattggtaagtgatgcacgactgtactaggaaagagtttctaggaagatattgtgtagttttagtgggtcaataaaaataatactcgcttcctgtcttgagtcagaaccaactgagaaatcagcacagaagtcagacagatggaaatgaacataccagctttattacagataatagcttgattgaaaaatgcaacgtgatgtttagccatatgctttttagtacttgctgcctctgttgaactcagctttccaaaactgcaggcttttcacttgtagaggacgaacttgcttctgcagaaagcttatcatgtcgccagagtagagctgactgtcccatcattgtgggcatgttgattaggaagaactcatgcaggctttctcctgataatttatactataagcttctataggaatgctcagccatggggccaacccactcatgtggttccatttcccaaagtcacttgtcacaaaagtcactcttttggggacaagagaatacagagtagaaagcaaagtcctgtcacatggaaacctaggggcaggggaatgaccgttgcccaaattgtgccctcaaaagcatgaagccagtgtcacatcatgtctgggcatagatgtgagaagctgtttttgggtgagtcttgcggaattctttgtttatactgcaagtagatgcacttgtcatctgaggccattggcttggcctctcttggccatttttatgtgtgtttgcggcttcacatgtaacattgtggggagagttggctattttctacgctgcggcatcttggggagtttttttcctcagctcttttaaaaatcttggcaaagttaggaggtcattttgccattggcataccagagatgacaaacgtaggcttggtgattctggcatgggtaggtagtcaggctgggctcctctgaagagcattctgttcctcatggcagaggattcttgctagtgagcctttgtgttccccagcctttcaccactgggtacatcattataataaggactggagctgaggcagggagaataactgggaatcaaaaggcattagtgcttctgggagccttaaaatattctattctaaatttttatgcacgtatctccttttacaattatagaagcaagaagcgtaatcaatcaagggtctttgtcatgctttgcagctttcttaggaaatgcagacaggcaataatatgtgattgtcaatagcattttgaattttcagtgatatttgccaactcataggccatcccaatgagcaaggtcaggggctccaaccccagttgataggagaggaaactgatggtcttactgacttatccaaggacacaaagaggtcatgaacccagctaaaaatagaagtgagaattgcctggtccctattcttagtataagcaccagattacactcgctgctgcaatacttgctaattgttcatttccgacaaaacatagcggggaatttttcctttatagctggttgtaaacatttaagatgcctgtagtcactcataacctctgtttacttatcacagccagctagctatcttatttaccttatctctgattctttttcatttttacatctgtgcagagaagttaatatatgtgaaagcacttcatagactctcaagtagcacataaattttatttggtgttattataatacttgtattagtcatttttacactgctgataaaaacatacctgagactgggcaatttacaaaagaaagaagtttattggacttaccattccacctggctggggaggcctcacaatcatggtggaaggtgaaaggcatgtctcatatggcagcagacaagagaagacagcttgtgcaaggaaattcccatctttaaaaccatcagatctcgtgagacttactcactatcgcgagaatggcacaggaaagacctgcccccatgattcagttacctccaaccaggtcaaatcttaaatctccaaaatgatctcctttgactccacgtctcacatccaggtcacgctggctgatgcaaaagatgggttcccatggtcttgggcagctccaccctgttgttttgcagggtacagtctccttcatgattgctttcacgggctggcattgagtgtctgtggcttttccaggcacacagtgcaaactgtcagtggatctacctttctggggtctggaggaaggtggccctcctctcacagcgtggtaccccagtagggactctgtcttggggctctgggggctctgactccacatttcccttctgcactgcccagcagcagaggttctccattgtgaccccgcccctgcagcaaacttttgcctggacatccaggcatttctatacatcgtctgaaatctaggtggaggttcccaaaccttggttcttgacttctgtgcacccacaggctcaacaccacgtggaagcttccaaggcttggcagcttccaccttctgaagcaacagtccaagctgtacctttgccccttttagtcacgctggagtggctgggatgcagggcaccaagtccctagactgcacacagcaggggcaccctgggcctgatccacaaaaccattttctcctaggcctccaggcctgtgatgagaggggctactgtgaagacctctgatgtgccctggagacattttccccctgtcttggggattaacattctgcttctcattacttacgcagatttatgcagctggcttcaatttctcctcagaaaatgggtttttcttttctaccacattgtcaggctgcaaattttccaaactttatgctctgcttcttttataaaacggagtgcctttaacagcacccaagtcacctcttgaatgctttgctgcttagaaatttcttctgtcagataccctaaatcatctctctcaagttcaaagttccacacatctccagggcaggggcaaagtgccaccagtctctttgctaaaacataacacgagtcatctttgcttcggtttgcaacaagttcctcatctccttttgagaccacctcagcctggaccttattttccatatcgctatcaggcttttggtcagagtcattcaacaagtctctaagaagttccaaactttctcacattttcctgtcttcttctgagccctccaaactgttccagcctctgcctggtacccagatcgaaagtcacttccacattttcaggtatcttttcagtaacaccccactcctggtaccagtttactttattagtccatttttacactgctgataaagacatacctgagactgggcaatttacaaaaggaagaggtttattggacttacagttccacctggctggggaggcctcacaatcatggcagaaggtgaaaggcatgcctcacatggcagcagacaagagaggagagcttgcgcaaggaaattcccagttttaaaaccatcagatctcgtgagacttattctctatcacgagaacagcaccggaaagacctgcccccatgattcaattacctcccaccgggtccctcccacaacatgtgggaattcaagatgagatttgggtggggaacagccaaaccatatcagtactcatgtttttaactttgcatcattaaaatgtgagcacagatacttccacttcatagtggccaatagagttgggctgggagtggcagtggtaaacacttacatcatactatcctgacataacttaggatggcatgtattcacaacagtatgagtaacaattaatgagaagttttcagtcacagatgtctttcagagaagcacaaattgataaatatacatatacatttacatagtgaggcaacagaatggaagcactgatagaaaataagacacacatacagctttgggggaagctaaaagtattttcagctagaaaatatataattggggaaaattattttcctaccagttaaaagaacaaatcttcctttcatactcttgattatgcatgtatatggtgtctatttgcagggtttatatacttttctatagatactgtggaattctcttaacagattttggttgcaccatacttgattacatacacaagggccttaataatatcccatagcttaattgaatctatggcataggaaagtttaggtagatagctttaatatgtaatgttttctttctagagctgattttcagcagcagtgaatggaagtggcaggatgtggggtttacaagtcagcattagtttcttcttttttttcccattagttattggggtacaagtggtatttggttacatgaataagttcttcggtggtggtttgtgagatcctggtgcacccatcacccgagcagtatagactgcaccatgtatgttgtcttttatcccttgcccccttcccactcttcctccgagtccccaaagtccattgtatcattcttacgccttagtctccagtcccatccaggtcattgcaaatgctgttaatttatttctttttatggctgagtagtattccatcatatatatatatatatatatacaccacagtttatttatccacttgttgattgatgggcatttgggttggttccacgattttgcagttgtgaattgtgctgctataaacatgcgtgtgcaagtatctttttttttcaaataatgacttctttacctctgggtagatacccagtagtaggattgctggatcaaatggtagttctacttttagttctttaaggaatctccatactgttttccatagcagttgtactagtttacattcccaccagcggtgtagaagtgttccctgattgctgcatccaggccaacatctactgttttttgattttttgattatggcccttcttgcaagagtaaggtggtatcgcactgtggttttgacttgcatttccctgatcattagtgatgttgagcattttttcataatgtttgttggccatttgtatatcttcttttgagaattgtctattcatgcccttagcccactttctgatgggattgtttgtttttttttttttttcttactgatttgtttgagtttgttgtagactctggttattagtcctttgtcagatgtatagattgtgaagattttctcccactttgtgggttttctgtttattctgctgactgttcttttgctgtgcaaaagctctttagtttaattaggtcccagctatttatctttgcttttactgcttttgcttttgggtttttggtcatgaaatccttgcctaagctaatgtctagaagggtttttcaaatgttatcttctagaatttttatagtttcaggtcttaggtttaagtccttaatccatcttgagttgatttttgtataaggtgagagatgagaatgcagtatgattctgctacatgtggctaaccaattatcacagcaccatttgttgaaaagggtgtcctttccccgctttatgtttttgtttgctttgttgaagatcagttgactgtaaggatgtgggtttatttctgggttctctattctgttccattggtctatgcctatttttatgccagtaccaggctgtgttggtgactgtggccttatagtatagtttaaaatcaggtagtgtgatgcctccagatttgttccttttgcttagtcttgctttggttatgcgggctcttttttggttccatatgaatttttctaactctgtgacgaatgatggtggtattttgatggggattgtgttgactttttagattgcttttggcactatggtcattttcacaatattgattctacccatccgtgaacatgggatgtgtttctatttgtctgtgtcatttgtgatttctttcagcagtgttttgtagttttccttgtagaggtccttcaactcttttgttaggtgtattcctaagtatttttttttttttttggcagctattttaaaaggggttgagttcttgatttggttctccatttggtcactgttgctatatagaagagctactgatttgtgtatgttaattgtatctggaaactttgctgaattcttttatcagttctaggagctttctggagaagtctttagggttttcaaggtaaaagatcatatcgtcagcagacagggacagtttgacttcctcttcaccaatttggatgccttctatttctcttgtctgattgctctggctagggcgtccagtactatattgaagaggagtggtgagagtggcatccttgtcttgttccagttctcagagggaatgctttcaacttttccccattcattattatgttggctgtgggtttgtcatagatggcttttattacgttaagttatgtcccttgtgtgccagttttgctgaggatttaattataaagggatgctggattttgtcgaatgccctttctgcatctattgagatgatcatttgatttttgtttttaattctgtttatgtggtgtatcccatttattgaattgcatatgttaaaccaattctgcatccctggtatgaaacccacttgatcatggtagattatcttttttatatttgttagattcggatagctagtattttgtaaggattttagcatctatcattcatcgaggatatattcttttttgtttgtgtcctttcctgattttggtattagggtgatgctggcttcatagaatgaattagggaagattccttctttatcttgtggaatagtgtcaaaaggattgataccaattctttgaatgtctggtagaattcttcagtgaattgtctggtcctggactttttttggttggcaattgttaaattaccgttttaatctcgctgcttgttattggtctgttcagggtatctaattcttcctgatttaagttaggagagttgtatttttccaggaatctattcatctcttctaggttttctagtttatgtgcctaaaggtgttcatagtagccttgaatgatcttttgtatttcagtggtgtcagttgtaatatctcctgtttcgtttctcagtgagtttatttggattttctctcttcttttcttggttaatcttgttaatggtctatcaattttatttatcttttcaaagaaccagtttttggtttcatttatcttttgtattttttttgtttgtttcaatttcatttagttctgctctgatcttggttatttttcttctgctgggtttgggtttggtttgttcttatttctctagttccttgaggtgtgaccttagattgtctgttggtactctttcagactttttgatgtaggtgtttagggctgtgaactttcctcctaacaccttcttagctgtatcccagaggttttgataggttgtgtcattattgtcattcagttataaaagtgtgtccaaagtttcctgaattttttagtttttttaatatttatctttttatttctacatagtttttaatataattttagcatctttttatttttccatgtttttgaacaaaattataatgatagtattcacagatctttgtttcttaatttttctcattaaaattataaaaattctttttttttttttttttattgatcattcttgggtgtttctcgcagagggggatttggcagggtcataggacaatagtggagggaaggtcagcagataaacaagtgagcaaaggtctctggttttcctaggcagaggaccctgcagccttccgcagtgtttgtgtccctgggtacttgagattagggagtggtgatgactcttaatgagcatgctgccttcaagcatctgtttaacaaagcacatcttgcaccgcccttaatccattcaaccctgagtggacacagcacatgccccagagcacagggttgggggcagggtcacagatcaacagcatcccaaggcagaagaacctctcccagtacagaacaaaatggagtctcctatgtctacttctttctacacagacacagcaacaatctgatttctctatcttttccccacctttcccccttttctattccacaaaaccgccatcgtcatcatggcccattctcaatgagctgttgggtacacctccctgatggggtggtggccaggcagaggggctcctcacttcccagaaggggtggccgggcagaggcgccccccacctcctggacggggcggtggccgggcggaggctccccccacctccctcccggacggggcggctggccgggcgggggctgacccccccacctccctcccggacggggcggctggccgggcgggggctgaccccccacctccctcccggacggggcggctggccgggcaggggctgaccccccacttccctcccggacggggcggctggcccggcgggggctgacccccacctccctcccggatggggcggctgctgggtggctgccgggcggaggggctcctcacttctcagatggggcggctgccgggcagaggggctcctcacttctcagacggggcggccgggcagagacgctcctcacctcccagacggggtcacagccgggcagagacgctcctcacatcccagacggggcagcggggcagaggcgctccccacatctcagacgatgggcggccgggcagagacgctcctcacttcctagacgggatggcagctgggaagaggcactcctcacttcccagactgggcagccgggcagaggcgttcctcacatcccagacgatgggtggccaggcagagatgctcctcacttcccagacggggtggcagccgggcagaggctgcaatctcggcactttgggaggccaaggcaggcggctgggaggtggaggttgtagctagccgagatcacgccactgcactccagcctgggcaacattgagcactgagtgagcgagactccgtctgcaatcccggcatctcaggaggccgaggctggcagatcacttgtgattaggagctggagatcagcccggccaacatggcgaaaccccgtctccaccaaaaaaatacgaaaaccagtcaggcgtggcggcgcgcgcccgcaatggcaggcactcggcaggctgaggcaggagaatcaggcagggaggttgcagtgagcggagatggcagcagtatagtccagcctcggcttggcatcagagggagaccgtggaaagagagagggagaccgtggggagagggggagggggaaggggagggggagggagagggttttttctttaagctatctatttccttgaatatttctcccttcacttcttgtatcatattttggatttccttgcattgggcttcgcctttctctggtccctccctgattagcttaatagctgacctcctgaattctttttcaggtaaatcagggatttcttcttgatttggattcattgctggtaaactagtgtgattttgggggagtgttgaaaagccttgttttgtcatattaccagcgttggttttctcgttccttctcatttgggtaggctctgtcagagggaaggtccagggctgaaagctgctattcaggtctttttgtcccatggggtgttcccttgatgtaataatattctctcccttttcctgtggatgtggcttcctttgagctgaactgtagtgactgttgtctgtcttctgggtctagccacccagtgagtcttcgtggctccaggctggcactgggggctgtctgcacagagtcctgtgatgtgaaccatccattggtctctcagccgtgaataccagcgcctgttctggtgaaggtggcagagggtgcagtggactccgtgggagtccttagctttggtggtttaatgctttatttttgtgctggttggccttctgccaggaggtggtgctttccagagagcattagctgtagtatggagagggaccagtggtgggcggggccctagaactcccaagattgtatgtccttcgtcttctgttaccaggttgagtagggaaggaccatcaggtggcagcagggctaggcatgtctgagctcagactctccttgggcgggtcttgctgcggctgctgtggatgatggggatgagattcccaggtcactggagttgtgtgcctaggaggatttatggctgcctctgctgagtcatgcgggttgtcagggaagaaggggaaagctggcagtcacaggcctcacccagctcccacacaaaccaaagggccagtctcactcccaccacaccccgagtctgtttccaggcagagggcaggtggggcttgaaaacttgcctgaggctttccacttcccagagtatttggggtgtctcccgggtcctgtaggagcagttttctcaggattgctggcctgctcttgcagctgatctggaggtaaaattcacaatgcaagcctccgcatgctgctctgtctggagctgcaatctagtcctgcctcccgtctgccatgatccgaccagcatcagtttcaatagctcctgcctcctttagggactctccttcttctcttcatagttaatagattccttgagttttgtgtgggaggcttgtaccatctcacctagatagaagaattacccaacacttccactctcttcaacattttttgttttgaaaaaattaaaacttacagaaaagttgaaagaatagcacaatgaaatccatcctgcacctagattttttttttcctcctttggatgagccatttgagagtaagttgcagacatcatggcacttcctctctaaatatcttagcagctatctcctaagaataaaaatgttcacttctatgatcacagtatgattatcacactcaggaaagctactgttgatggaatactgttatttaaaacatagttcatattcaggtttgcacagttgtctcagtattgtcctttatttttcccccaataaaagatccagtcaaagagcacccattgcatttagttgtcatgtctctttagtcctttttctttttgtttcttttcctttcctttcctctctttctctctcttccttctttcctttcttcatgacattgacagttttgaaatgcccaggccagctattttatcttactatctactcctaaagcaaacataattaaggaaatagggagtttgccctatgaaagtttgcagttttttctttctttctcttacgaacctccatgattttatgacttactaagaagcctctaagatgatgctatatgcattcctattggatgtgtgaaattaaaggtagctttttcttcctaaaagtctctgtcctgatagactcttccagagactcacttctcaggacatttgtgaggctggtgaatatatagcaggtgcacttttgacaaaatggcacgtatctctaggaatttgtttctgatattcataggcctcgttcatacctgatcctgtattcatatcaatagtgaatacttagctgcatttcttacttagagtttggttggttcaagacagttgttttgtttcttagcaatagtcaaatctttcaacttaatactaatcttatatataaagaagaaagtaaatctcattctgattattagagcttttcagtcatgaaattaatgtttcttgttactatcactgattcctcttgaggtttcagtgatgtgaaatagtttgtcattgcatcagatctctccaggtgtagagtctcttgagtaaattttaggacacatcagaaaagacttgacagtttcagtatggggcaaatctagatgaatgagtttgtgttttagctttttaaatattaatatactttttttaaaaaagttataaacaagagaaagacaaatattcagagttgaagtaggagaaatctttcttcactaaagatcttggccatatcctaaagttgtattcaaaaagaacaatatttttgattgtttgtttggttttgtgtttttacatgattcccatatcctttatacatctcttcttcatcaattctcattgaatttcaaaagtagctactagcttagaagacaggaagttacagatgtgtggcaggcaagaatgagatgggagtaaaaattggctcagttaactggtttgtaacttcagcctgttagaagctcgtttcttttagtgcacatgggagctttttttggccatgggaaggcatacaaggttatccaggaaatttttgcttcattatgaaacaaagaaaatgaagtcctgtaagctccctgagacattaagaaatatggtctccagtccactggagataacacaagtaattatcacaaaaggtgttggttatcatttaagggggaaatattatgttgacataatacataatttcagcatctgttgtgccttattttggattataaatccagactaatagatctgtggagctgtttagcccttttcacatcaaattcccatgcctcctggaaaagttaacatatgaaagattcgattgagataggcactttgcatttaataacattttcattctgaaactaatattactaagtgtctgctatgtgtgaagttattttatttaattcatagaacaatcctgccaaataactattcttccctaaacagataaggaaagtgaggcctagagaggtaaggtaatttgtgcaagataacatggctagtgtgaggagtaagattcagattctgttctttctgactaaattttgccctagttcatcaattagtatatgtcttctcagagatcaggttaatcaccagtgagtaatgccagattagtaactgttgagaatgttgtgggaacaaggaatagagaccagttaatctacacacccagtcttgtcttttactggccaccaaccactgtaacctccctatctaacatggctaactggccaagtatgagatttcacaaatgtatgccgtagcagttgggccattggcctccaatcccaaagtgaaatccaagcaaaccaaactgtatcatgggagagctcttttcatccatattaggggtggacctaggactgatgtaggccaaagacttttctgtcctttttctaaaatccctgaggtaaatctcagatcttagtattccagtggtacatggaaaagcaataaagggccgggcatggtgactcaagcctgaaatctcagcactttgggaggctgaggcgggcacaccgcttgagcccaggagttcaagagcagcctgggcaacatagcaagacctcgtctcttcaaaatataaattaaaaaattaaccaggcatggtggctcacacctgtggtcccagctattcgggaggcgaaagtgggagtatcccctgagcctggaagatctaggctgccttgagctgtgatcgggccactgcactccaacctggacgacagagtaagaccttgtctcaaaaagaagaaaagaaaagagagatagccccagtgccaaaagccatgctgacatcaagtgcctcatggtgaccgtggcctcctgagcttgctaggtaggcaaagacaggaagaggatggaatcccagatgagaaaaatgggacttttgacactctggaccaaggaaaatttcctccccttgctcctgaccacccctggggaatggaattagtataagagagctcagaataggagaaaactgggaactgaggatagttgaacctgccagactacacttctcttctttggaatcagagttgcttcctgtgcgatggctatttgattttctttccccttcgggaaagagggatttaaacaaaagaggaaatgtagccttcacattctccttgtccctaggcaatgcctgtgcttaaggataaagaacatatatatttatgtggttctgttaatataaatacttaatacctgcataaaaggagtacctttggatggtaaaattccactttaaaaaattaactgaccagtttcagcaagcttaattattatagcacaagaggttttgtatttgttttgggtgatgataaaagggctcagtggtgagaagtggtgtaggggtgcggaaacaggggagcaatattctcaactgtaatgaaaatttatccgtgtggtaacttttgctttgaatatgaatcagagggagttcatgctttgagacaaatttatggttagcagtaagataaaggcctgttttactgccttctttttacttaataaatcttaattgctttctctccataaattaaagcatttaccatgctatatcctaattatcagatttgtcatgtatagcatcagtttcacagagtaattgccatgtgggctttttggaaaacatcaccttctactctttgttttgatgcctgagaggaattgccagctggattttcagtaaggactctagtcttgccatgtcacctcaattttttaaggatgtgctgatacttattggactaactttgggtgttacagcatcatgggctcaccaattgagggcaaagtaggaaggggagagaaatggtgtgaattgaggactatttagaaagacattcaatgttattcctttgaagtacataacaagatatttctcagtatagatcctagagactggcttttgtgaatagatttatttgtaattagtggaatttcacataaaagtactaaaatcctagagaatattttatggacttaagtaagttatataatcttctttattctgttaatttgcttagcaaaccctttcctggtatttaatgtagatttacagttgagttcaatccagatgagttatcacaaatgttccttataaattagttggatttcataattcttggctccacgcatgtgaaaagggtgtccacaaaatgttcagttttaagttgattggacagactagagagtggcattgtttttttgaatagctgtttatttatcaaaagaaaaaaggacagaaatgaacatagaactgtatgtatttgctgaggtagtcatggcctgtgtgttctcagctctgtgctacaccactttgctgctccactctgaatggcagggaggctgctcctgcaggctacagatcctagagccccagctcggctggcttctggctgggttaggccagcaggaggctctgatagaagactagaggtaggaggaaaggagcaagagggtatttcgcctttgctctgcctccagcaacatctctgatagaggatgggtcttacccatggctccagcttctagtgtgtttccagcatcctctgatggccccaataccctgtgataggagtggcctcctgctgttgagaatctcttaacttgcccaaatgtgccctctttgacgtttcagctcttctctcatgtgtaataaagcctctgtgttaaaagagtggtttccttttcctgattcatacattttgtagaacaatttgcttttatgtcacagcttatagtcttttgaatgttgataaaggaaatgttaaattattcattatctcatttaatcagcttggtattatatttaggtgatggggcaaagaagaataagacaaaatgacctgattgccctcagggaactcagtctgtttggggaaacagtgtgttccccaagtgccaggggagctaaatggaagaaagacctagactgtagtagtggtgggaaagatgtcacaaaacaggtgacatccgaaagtcttgccagatactaagatcttgctcaagcagatgaggaagaagggcattcccagcagaagcagcagtttgtatgaaagcatgtgtcacgtttggctgcaggagcatggtggtcagggggactggaggaagaggaagctagagaggtggtcggggtagaccacaaagagcattgaagcctctgccaggcaattggactttatcctgttaggactgggaagcagtgaaaaggattttaagcagaggaattacatgaacagatttatccttcaaaaaggtcaccttaggagaggtgtggaagagagactagagggctgaaaatggaggcagagaaacctcctggccaggtggtgagtggcagaagtcctggtgggagtgggtggtgtttaaacaaagacctgaattaaaactgaaggcaagaggaggaggggaaaaatcaagaaatgttaagaaagtagaatgtgtagaacttggtgatttgtttgaaagtgttgggagttgttgttaaatgatggtctcagagatcatggaatatttgtctggtttagctaaataaatgttaaaactagaagcctgtttctcaaattggggtcgctgtgtccccttagaggtctcatgcaaactctgagttgtttatgctgccttatgagctagatgtatcttaggtttcaaacaattatgattgcagcactactcaggtcttacaataagccagacaagcaattctttattaaaaatcatttgctactcccaccacccaccaccccaagatctttttcctggccattatgtgccttatctctctctactagtcataaaatttgttggccacccactgtgtatttatctcatctcctacctctacccatcacagctttctcatcttctgattaaatagaagaattagcctcttatttgataaatcattgtatgggtgcctgtgtctaagggtttctgaagtctagcaatagaacatcctctgctcgttgagaaaacatgtagggtcacccatcaccaagcactccacatgccagagactgcactgaaagaacactcaattctttcatgtagttaaaagaacacaatgcttgccctctgagagttcaacatctggaaacaaatctaaagagggagaaactggcaagaagaaacacattagaaatagcatctgccttaaatgatgtacagtaggatttgggttgaggtgctgctctggagttatggcctgctgttagtagtcttgatagctaaaactaacatgcttttttcttgtaagatttcagattgaatatagtggttgagagcctggattctgggatctgacttcctggctctgccacttccatgtgtcaccctgaccaaactgtgtcatctctatgcttcccttcattgtaagatgaggatcataatagtatttaccctaggaatgagaggattcaatggcatgtgtgtgtgatgtgcagcacacctcctgacacagtgtcagtgcacaataaatactcgctgctgacccttcctgaagccaaaaagaagcctctgaaggctcagctgagaaaggtgtgctgcgtgagtaccaaaaattactgccttctttccaaacgagagctgctatggctaaccctgagatcctttgtagtcatttaattacagagaaattctggaacatactttcttcaagccaagttagtctttttagtttttaaattacatcttgatcgtatcacacacaatcagttgtcacttcagggcacttccagaaacaagtttgcaggccagcatgtggcaggtaacaccttagaggagactggggcatcactgcctctctgaaatcgtccattgatatcatcccctccctcctcctttgagctcagcacacattaatcaaataccacaatttttcaggttctgtattaggctccagggatacaagggtgaacagacaattcccgtcctcatgaaatgtgcaattgtgtggaactacatgtgaacaaattcaatccactgtgatggaagccccaatgggagtgtgtagaaggtcagaagaggtacacagaaaggacaacaaggaaggcttcacagaagtggtgacgtcccactaggattttgaagggaataagaatggggagaatcagaagatcagcacggtttgcacagaggaactacagcagaggtgttgtggggggacatggtggtagatgaaattgaagatgtaggcaggagtttgatcatgtaagagcttggcctttgtcgtgggaacatcaggggccattgagggacttcaggtaacagaatgccacagatccacaattttagcaggatcaccctagtatgaaagacaaacttgaaaagggtttgcagatgctggcaggttcatgtcaccactgcggattcattgagggcagagacagagtcctatttatctatgtacccctaaagtttagtgctttatagacatttaagaattttttttttcagagtgaagacagcccaagttgaattttcccattctgtatcctatcctcagaacatgctgacctggacttccatctgtcacaagcagcttgactaagatcctaggaaattcctttttttcttggcattcttctaactgacactctctgtttactgggccctctgtgcatctgtaacgtgtgatgactgatgcttataattctgaccttgaagtacttcatggcttctaaatcatcaaaaaaagattaaagcatattctcagtatcactgtaatgtttgtgtgttttactgccttcttctctggaaagtggtggtttatgaagtgcccgtgcgcttgtgtgcacacggacacagtgagagtctgtgatggtcctcaactcttctcccacagggaggctatggtgcgtgcttgaaaataaacaaacaaaataacctgggttctcttcatgcctagcaggaggaagcagcttggtcccaggggcaaagaagcttgaaatgagagcgaaagcagtggttaggaaagcagagggaatgatgaggcagaactggtgcagaccaggagtcaggcagtttacgagccagccctggctgactgcattctgaccccaggaagagcaaagcccagggtcgggactgcagcttcatgttctgtgtgcctggacccgaatcatcaggcttggatttggcgggattctccaccagctatgtttgtatctcagtaacaaccgctcagtaaaatgccagacattaggcaagtgaaaacatcaataattagagcctcctgttccccacacatcttttcttgaaaacctttattgctgcagagctgacattattaggcacagaatgaagaactccaaatagaaactgtgaaatggctccatcttataacctgagtcctgaaaaataagggtgtgatgttgtcactaggcgggagatttgtttaggttttctttttttcttttctttttccttttttttgagatggagtctcgctctgtcgcccaggctggagtgcagtggcgagatctcggctcactgcaacctccacctcccgggttcaagtgattctcctgcctcagcctcccaagtaactgggactacaggtgcctgccatcacacctagctaattttttgtatttttagtagagacggggtttcactgtgttagccaggatggtctcgatctcctgacctcgtgatatacccgccttggcttcccaaagtgctgggattacaggcatgagccaccacgcctggcccttgtttgggttttctttggggaccgtatattgcagtaaatagaaatgccccttccattttgttgtagaaatttgtttttaaaatctgtgtttggtctacactcgtcatcccagcctaaagagccagtccctgaaccacagaagttctgtttgccgcctctcagccacggcatgtgtgggctttacaggcagctttaccacttgccagttctgtgaatttgggcaaatgttttagactctttgggtcttagttttgtttttttaatctgaaatattggaataatgcagattccttattttacagcgttgctgtgaggctgaaataaaatggtggatgtggaaatgctcaactagaaggccctatctatatcaataatagtatattaaatatactaaagaacatcataaatatcctaacaaaaatagaaatatatttcatctgcaaacatgacatcctccaaaattgtcccaaagtagagtagggaaatgaactatttattgaatctctaccttaggggaggtgttccagctatcactttatctgttctgcaaagtagatcttaaatcccacttttagacacaaggaaactgagactcctagtcacagcagaagtgggatttgaacctgactcgagaacttaatgctccttctccttggctacattatctcgttgtctagttccagacccccagtgttcttaaaagctttgacattctttggtgctgggaagtgtgccagccatttcttggtcattcactcctgtaagtgggacagggtggcacccagagggaactggagcaccaggtgcccccagagagaccagcagcacggagtcgtccagtgtgtgggacaggccctccgttggcgttccacttttagggagttggcctggcatggacagaaagccaggcaacagctgtgccacatttcctagcccttgagaaaatggctacggccctgtcgttttcagaagttcattctttttctgtcaaagtgaagccacccttcctcaggactcctctcagcaatcagtgcctcttgtgtattctgaccggccccttattctgtttgtagagggagtgagattagatttattctatgtagtaaccactccgctaagcttttctgcgactcttcctgttagctttgatgccgggcactgggggaaagggttcccgatgtggcagttccttaagtgcccggtgggacccactgctgcatacattttcttctttatatccttccctgattcccaggcaaacagactcggcttgtgaactggagctgcccacccagagaaccagagataatgcctgttgaagggccaagttgcatattcagcgaggatgtcagtgtgtgggagaagcatttgttcagcctgcggttctgagaggaactgtgtgttgtgttcccataggttctcaacaggaggtgtgtagaagcggcggtgatgacaggcctggctctgaactgccacataaacaagaagtccttgtttgacaggaagcactacttctatgcagacctccctgtaagtacactttgtgatccaccccactgcaagttctcagagctgggccagccctgctgtggggggtcggagcaagggaaaggggctgtgcctctcatgttttcagccagcactgtgtccatcccagcaggaagttcggcccagccctgatgcaggcaggtgcccctgatggttactagatcggatgcagttgtcctgattgctgacttcttgcttacctcatgcttctggtggctcgctcataattgcacagggagtagaagccagtgtttgcaggctcagcctggccgtggtatttggtgctaattgcctgttagtacaaaagctaaggctctggctgatgcaacagtaaatgcatactgtagttctgtcagcagagcgagagcgaatcgcttttaagttgaagttcccaataatagggctgtctcctttggagacatttctgtcatctcacaaggagcaagtaagtggacaatagtaagcggaaacatgaaccagaaatctggaccaagaacagtaaactgttggtccagttacttggctgagcagtaaactccatattgacccgcttttttctgaaaattaaaaggtttttttctttaagccacaccatgtgagtgagagccaatttttcatactattgaacaggaacaaaactgaaatgttgaatgggtttcccaaaataatgttttgtttggtctgattcagaaaaacaacagtgatgatgttgcttcacctctttctccttgaactgaagattggggcgagctgttttttagtgggtgagggcacgagtagaattaaataaaaaatacaagtaagacctgcgttctccagtggctgctgcttttcccctctggcctccagcctctcagcaagtctactgtttggtagggcggaaagaattaaaccgcctttctttatcttttaagagtgacagacagtttggttgaggtgggagatttagtaataatatgactaaaatgagatgttttggtcatctgtggctttctggtctttctggcccagatagttcaaataatccagagtttcatgggacatactcatataataaagcatttgttgttttttctgaaattcagatttaactgggtgtcctatattttatccaacaaccctacccagagcttagttttacaaattgagacttcccgtctcagcatagaaaacgggttagccttttgcaggattctcaaagtgtggtccccagggcactgacatcatcatctcctgggaactggtaagaaatataaatcttcaggccccaccctcgacctactgaatcggaaacctttgaggtcgggccaagcagtctgtcttttgacaagcacagtagtatttctgatgcagttaaagttcttaaactgggggcctgccaagtggtgaaagacacggattttggagcctgaccatctgaattcagacattgacattgatgctcactagctctgtatgtggctgtgggcaaggtcttaatccctccacgccttgttcctccttcctagggttgttgtggaattaactgagggaacacagtgagagcagcacctgggacctaggaagtgccacagatgcctttgcttttattctctgttcttctccaattctcctcattgacctgctgtctctttagtgcgtattggtgcctctgtgcgtttgcaagtaattcttcctttccacttagaagcaggtgagggatccttgcaggatccatcagtgctttagtaccatgtgccttccattaatggagggggagtgtcacagcattttctgactggaggagctagggaggttgggtcagggagggcagctgccatgattgattcctttaaaaagcagaaacaaaacaagcttaaacacacactagcaactgctgttggccgtgtggagagtagatggcaaaatgcttagccagcattccaaataaggagggtctgccaggagcctggtaatgagatgcagagtttaggctaatgagctggatggaaacaataaattcttttcttaggggtccctgacaatgacattattgttattccccaatacagcactttaatgagggcaatgggatgaattcgtgttgtttattgcatcgttatcaggggtggaggatttggggagggtgaaggggtgatggcaggggcagaagagaccaggctcaatgatggctgcaatgcagcaactaatttttttctccttttcctttttttcttgttgtttttgctttaagtaggcctgtcgttgtgtgacattgtaaaagggatagtaaactggatcccagcttttatgtgtggaccagtgactatgtttaccctatgtttgtgtgcaggcaggctaccaaattacccagcagaggctcccaattgctgtgaatgggagcttgatatatggcgtctgtgcagggaagaagcagagtcaggtgatccccaagacggtgaggatcaagcagatccagttggagcaagacagtggcaaaagcctccacgacaacctgaggtctcagacgctcattgatttgaacagggcaggtaggcttggagtgttttcattatttctccttcctacttcagttcttggatagcagggccctcttttcaccgctagagttttcttgaacaaattgagaaagcagtcacaggagcctgatagatggagactaaaatatcagcattgggattggcatagctgactagcgaacatggcttgaactgtaattattaggcttgctaataactcaccctgaagttagacaaacctatccacctagtcacagacccagcagctggatattttaagcagtcattaaaagaagtgaaacatttaaaaatcaaaacgtggagcctaggtgcctacacgtgtaatgctagtgactcaggaggctgtgggaggatcactgtacgcagagtttgagatcaggctgggcaacatagcgagacctacttgccaaaaaattaacacctaggtgtggtgccatacacctgtatccccagctattcaggaggctgaggtgggaggatcacttgagctcaaaagttcagggctgcagtgagctatgatcatgccactgcattccagcctgggcagcagagcaagatgacgcctctttaaaaaaaaaaaaaaaaaaaaggtgggagggaagagaaatgattgagaggctagaaccactctgagagtccttcagtaaggcagggttttcctgaaacttaggcctaatttttctgttggtgaaattggagagctgcagtgaggctgactctgcccctctttggtaggagtgggccttctggaggtggtcctggagcccgacatgtcctgtggagaagaggcggcaacagctgtcagggagctgcagctgatccttcaagccctggggaccagccaggcgaacatggcaggtagaagccacagaagcagtattcttctttccctctcccttcctgccttctagaacctctctgactttagttttattttctgtctattatattgaggttgtttgcagccattttttccccagccttttgcaaccctgtttttttgttgttgttgtttgtttgtttgtttgtttagaattttccttggattctttgatgagcccccaaccaaatataaatatacgaccaacaacattgcagagacaccaaacccttaatgaaataatggctttgaacagttcagtctttctcaggaagaagacactgtttatcaagaacagttcttagttagtgagtaccgtatagatagcacttcataattagttgcctcttttcctttgggtctgtttctttccttttgtagatttttcatccatatacagcggaagccaaattatattgactataagccaagattatgaaaactttaccctgagataaaatcttaattaagttcagtggaaatacagtgggaaactaaaacaaataaaagaaacacctgcacccttgggaccagaccacacattataagcatttgtaaattacatataaagatcataggttttggtcacactcaatttcctcatggctctaggtatcctttgccctggtctggtactgctttgctctcccataagtccgtaaagggtagcctctgctatcattttctcctgttctctgttcctagggactttttgaaaacttcttccaccctcagagcacaccctgatggagaggagacaaaatataggttctgaatctacaattgtacttttccatagcactgtacaatggtcacagcaggtgcccaggaaatcccgttgatgatgatgttcatctccatgctggttgataatactgtttaccaagcttagcatgtcacataatgtatttgcatgttacagggggacttctggatttgtaatgccacatttgtcacataggatgtgtaataagcaacaaattataacatcagagccctggtacatgttgaatctgaggacagaacttgcttatttgctattttacttaaagactggaaaaacacagccacatgagtttgagtggcataaaggttagctgcctacaagtttctttacagagacaacactctcttttagagtaagagaattctcaattttagatttatcactcatgccagtttttttttaatccacagaacataaatgaaatgtgggcaagttggatggttatccatttatgctccaagtgttgattgctttaagaaagtttttattatcccattcttcttcaaaataactgtgattcctaccaaccctatgggatcataaataggtcacctgttaactgagaaatagtcccatctgggtccttgccaagagataaacgatagtggcaagaactcatcagtcagtgacagctgagagtgttcattaaatctcacttgttgtgacactttttgtttcttttaaatacaaatccaacagcttttaacacagcagccgagtagctttggttgttctaaagttccgtgggagctgaggtctgcctggagtctgcagggagccagctcctttggtgctgtgagcattttatcagccccctctcctttgctcatccttctgtccctcctcccacccctttaggaccactgtgttggccttggagcctgcagcttaggagctgagggccaccctgaagaggtgacactgaagactagtggacacccagggtgctgtggaatgaagcctaattgcttctgggctgtggttctgtgagttcctgatagttttgctgatgagcatagaccagcttagcccaggttccaagtcatttcattctcagtggacagccttttgcccctgttgtggagatgcccaaagtattaatagtttggtaagttgaatgtgtacagaagtagacatgctaagtgtttcaacgataataatatctatcagttggaacatttaatatatgctcctcagttcactaggcattttaaaattaatttgacatctcatttacattttatgacattgctgagaagtaggtggtagtgtttgcctgttgcaggtgaggaaactgaggcttagagaggtgggagttatttgcctaaggcttacaagaagtgacagagctgggacttgagcccaggtgtgtctgggtccaagagccctttctgtaagcacagcttcgtaccacttccctagtggcagccatggcagtgtcatgaccatcacagatgctgacttaagagaggcaggatagcaaggtggggtgccaagggctgccaggtcctggatctggcttggaatcctgtcctgcaacttctagctgtaggttcccaggctttgatttatctgagcctcactttccacacttaaaaaacatgttcccaaataattttgtacagaaggggaaaagaagaaaccaaagaggaaaggaaatcatcaaggccatctgatagagctgatggagttgcagcagctggctgagaggaatgactttgtgggagaaaacatagaattccagtttgggcaggttaagtttgaaaggccttgggaatagctcagtggctttgtcaccaaaaccaagagttcccaaccattttagctccggggaccggtttcgtggaagacaatttttctgtggacttggggggccgaaggcggggtggtttcaggatgattcaagtgcattacattgatcgtctgctttatttctattattacattgtaatatatagtgaaataattatacaactcactgtaatgtagaatcactgggagccctcagctggttttcctgcaactagatggtcccatctgggggtgatgggagacagtgacagattattagatggtagattcttataaggagcacaaagcctagattcctctcatgcacagttcacaatagggttcgtgctcctatgagaatctaatgccatggctgatctgacaggaggcggagctcagatggtaatgcaagggataaggagcagctgtaaatacagatgaagcttgtctctcttgcccatcactcacctcctgctgtgccatctggttcctaacaggccacagaccagtacctgtccatggcccccgggttggggacttctgactaaagctatattacaatgaatgtactaatgtcaagaaatgtactaatgaatgtactaatgtctagaaaacttaggacagggcctcgaaaacagcctgtgctggatacatgttcggtgctcttattaacagtaataagtagtaatacttttatggaattaccactcatctagatgagtgagctttgtaaaatacgttcagtaaaatttgttcgctttttttttggtcaaaccttgttattttcagtgatcagaacgagatagcttaacaaaccttacccactgcatctttgggcccctgctgtttgcagaaacagttttccatcttgatgttatatttctgttgtgtgagtgtgttttagagaaaaatatgaaactgcactttatcactgtgctcagtggtatagttttttttagttttgctgttataaatctctacttctagaagatagaaattgagcctgatgccattctcatgatgtgtgaatgaaggctgtccctcagtggtgcagaatgcattgaagtaaacctaactagtaaagcttttgtgcacttgaggcaatttaacttaatttgtttaaaaggtattttgtcttcactagatagcatgtcttttgttaatgtttgatactgcatttgaatccaggctggtgaactctctttcaacactgcaggatactaaatgattcctctcaggtatttatggagtgtagtcttctctgggagagaccgaaactcatgcttttattcctcttccaaattagaattctaaattgtgaaagatgctttcatttttaaaagcaggcgaggtccaattcatggttccctgagttcaaaaaaagttgtctcccaagtattgcaatttggttcgatggagctcagcacactttggaagttttcctttgagcttaatgggcctttcagaggattccaactgcagattagtcctattcagacggaactgtagaacttaccgggaacctagtgtgagacagaaaccagtctgcttactcattgctcaggaaaatgccagcgttctggcattcgtcgctcaataagatttcatttattgaacagtcaccaagtgccagacccaactctaggtcccacaaaaggcgttgttcctgccacatggatcttatgttcaggagggtgacaaagacattaacaaataaactaattacagcaacaaatgcctcaaggaaataaatggggtgccatgctacagagtaacattggaaagtgacaatgttgttttttaaaggccctcagaggaggtgacatgtatttaaaacctgaagaatgattcaaggcccaggcagcatagagccaggagacgagcattccagaaaacagctaaggccaaggccctgaggtgagaaagagctaggaatgggccacgaggtaagcgaggtagcacaaggccactgtgccagaagcagaaggagcagtggcatcaggtgacactgtaaaggcaggcaaggggtagatcagagagaatggcaagaagtttagctctcaacccaggtgcagtggtaatcactgaaaggcttttaagcaagggaaagacatagtctgatgaatgttttagaaaaccgctctggctgctctgtgggaagtggatttccgatgggtaagagtagaagccaggagaccagttaagaagcttttgcaatagttcagatggaagatgatgctgttttggacagcactggtggcagtgaagatgaaggagagacaagagagacatacaagatggtttttagaaataggctggtgtggaaggtaagagacagggaggaagcacaaatgcctttagggaagttggaggagctagatggtggtgctgtttaccgaaattggaagatgagatcgagaatgtctttgtgcaggggcaaatcaggatttccttttggaaattgagatgcctgtgaaacctccaagtggaggtgtcaaatagataccagagctgtaagtgtggagctcagagaggtctgggctggagagagaaatgtaggcatcctcagcatgaggtggtatttaaaactgtatccgtccacccagagagtctagataaggaaggggatcctgggtttggatgggaaggaagccatcagcaaatgaaatggaaacaaagcatccagaggacgaaaactgggagcaaaaggcagcagaagctgagctaggaagataattcacgaaggaaggattggttggcttgtcaaatgttgctgaggcgtccagtaggtgaagacaagcgtgtcctgtgtccgctggatatggcagccaggagactgttggtgactctgacaagggcatttttagagagatggggagagaagctaggctgacgtgggttaaggaataaatgggaagtgaaacagcggagacagtgtatgcaacaaacaaacaaaacttgtttaagaggctttgctgaaaaggaaaccagagaaacgatagatgagtgactgatagagtgagaactgggttcaagggaataggttttggggttcttgtttgttcatttaataagaaatactattgcatatgtatacgtcagatggaatgctgagaaagagtaatgactggtatgggagagaagggataactgagagtgatgcccttgagaaggcaagtgggagttaaaatctggctcagtcctcaggggcctttcattctggtcttaaagatggaggccagtgcacagaagactatggtcatgtactgaattctgtagtatagattataagtattctgatagtttaggggacccaccagtgcaggccagcttgctgaggagggcttctaggaggaggcggtaacactcaagtgagtccttgagggatgaggagagggacagtagctctgataaagagagcgtgctggtggagcagacagggttgtgtatacagaaggctgccctgattggaggggagctttctcccggaatgagcagtgggaacatacaggttatgtcgactgaatccagatgacagctgtggagcaccaagcagaggagcccagataatccggtaggagctgtctgtgctgttgagtaaacagcaggaatgatgaacccagactatatatagcaggatgaaagttacagccacattgccagtccctggacaaggagggaactgtgttgagtcaggatgtgctcttatcacctaagcctaaagttcggagacctcgggcgaggcaccttgggcaagggtggtagccatggaaatggaaaggccgtgacagacattagtgatatttgacagcttccaaactggtaggggctagttgccagtttggatataaggggcaaagaaaacagagaagtagaagatgacctcagggttcctagaccgagagtctcacggtgtcaggaatagttgggacttcctgagatgcagatacacacaacttgtcaaaaaagggattaaaaatcaggggttacagaattcttgtaaaagtgttgagaagtcagtgctggagagagtaatgtctgagctaagagacatcttttccctgtcagcacgggtggcaattgggcgagcccttccctttctctgagggtgagtggtgaggtgtcagccacgggccgccggcgacctccagcttggtataggccccacagcccagcactgggagaatgacagagaaccagttccaagggtctccttttcttgacatggaattcattttgactactttattattttaatatgcttttgctttggaatcttgggaaatgaatttattcagcccatcaagacactcaggtttggcagattacttttaatttaaaaacgtaactaggaaaataaaatccagcattttgtcttctcactctgttctcttttaaatgttgtaaatgaaacgaggaacagagaatctgagagctttactttgtagggtgccaaatgtgattctttcttacctacatctatttgtcttgggatttttctctctctctcttcctcaagagccttttagtcctccccacacattgcctgcttctttagggcttgttgctcctaatctgaggggcctccagggtcaaagaaggtcctcccagcatggggtcagcacctctctgagtcccaccacagactcctgacttcgtaacagtgctgtctgtctgctgtagcaaatcgttagagcagtcaggaaggattcggagtcatgtttgtggaaggaagagattattacagtacctggaggaaggaggaggggggaaagcccagatttcagttcttgcccttgagctgcaaattctcaaggactctcctctaaatctcctggaatcactgttagaaatccacattccaatggagagcagtgtagggttatcagatatatgaggcctttcctccaactcagctctgacactttgaaaaaaaacttcagtataaaactgcagagtcaatctccattttaatagttttgtttttcttgtttagcacaaaaaaattagatctctccagctggcgaatctaaaacttctcttccatatgtgcataagcacacacatctgtatatgttcacatgtacaggcacacactgtagatgcctcaggactgtaacccctctcgagtggccagaagtaccagccacgacctacttcagaaccaaccgtgccttctctgaagttaggctgctataactaaacagcaggtagagttagatgctgcttcctttgacactccctgcctttaaaagactatgtcacctcaaagaatttctaaggagttgttttcttctctccttccagagggccagttgagagtggatgccaatatatccgtgcatcaccctggggagcctttgggcgttcgaacggaagtgaagaatctcaacagcatcaggttcctggccaaagccataggtgaatgccagctgccgctcctagtgtccttcttcctattgtttctctcttgctgggtaacaaacaacccagaaacttagtggcttacacaagaactactttcgttttcactggtccgttctgttggtcctgtgtcggctcactcatgtggctgtgggaaaccggcaggccagctgaagcagagggtccatggtagtcgctctcataccttggggccttgatgctgatgtctgctgggcttctccatccatgtgatctttcttcatgcacttgcctagccttggctttcttatgaggcagtgggagcatttcgggaggatgaaggcagaagtgagtcctaagctgtagacctcacacagtgtcacttccaatgtgttctattcaaagtagattgaggccaggcacagtgcctcatgcctataatcccagcactttgggaagccaaggtgggtggattgcttgaggccacgagttcaagaccacctgggcaacatagcaagaccccatctctataaaaaattaaaaatttagccaggcatggtggtgagcacctgtagtcccagctactcaagaggctgaggtgggaggatcacttgagtccaggagtttgaggttgtagtgagctgtgatcacgccactgcactctagcctgggcgacagagcaagactctgtctctaagaaaaaaaaagaaaattacattgaattcaaagcagacttgaggggaaattagactccacctctttatcagaggatccacaaaagatcatggctgtgttttaccatttaccaccttctttctgaccagcttgagatttactaggtcatggttgttcattttagattgaccatggcttgacctaaatggtcattatgttttcctgctttttatattctttttaactgctagattatgtgcccatgcagtgaagtagtagtctttctggagcacacactgtgggtatttctttgatgataaatgtataataactaaaatagtttagcaagataaatatctgagcagtcccgtagatataggtaactgtgaattcaaggggaggacctcagaggactaaaaagattttttaaaaccgaagctatctagagaggaagagggagggatggagtttgaagtgcaccccttcaagggtgcacagagaccaagacaactgaatctgttgccaaagttttgctgtagccaaaatgtttaatagagccctggtcttgtcaagaaaagtattagaaacagtacagaaaagatgattctagtcttgtattagaccttattgtcctgaacctgaagtgaatcaaccagcctcaatgaagacagtcttcaggaaaaaggcattaaagtggtcaaacggatagcttatgggagcagagagggaagggataggctcctatatgaaggcagactaaagatggtgaactgttctgcataccggaaagggacatagcccatgttcccaaagccatgaaaggtttgagtcagggaaaacccttataagccaagttggtgaggaggaagcctggaacaaatggaggaagttccacctccccctgtaggtagtgggctgggacccgttattttaagaggtggtgatggtaaccttaaaaaagcagcccaattttaggtagagtcatccatgagttctgaaggagacccctaaccttctcctgtcctatgaagaactctttggaggaccagtctgagggagaaatctccctgtggtctgactcagagtggaagagccaaagctttactatgggttcaattctccaagcctgtgatttttcaccacctttttctccctatgtcaggccatttagccatcatctcgtgtcaaccaaagagatcactggagttggggagagatggggagcaaaaactgacacgttttgctgttgctgcctcttagcaactcagataaaagggtttaggtttgggcaagggaaggtagtacatggtgggagggagagttaaggtggaggctcaagatattttcataaagcagtttagcaggctgggcttagtggctcatgcctgtaatcccagcactttgggaggccaaggcaggaggattgtttgagaccaagagattgagactaggctggaaaacatagtgagacccccatctctcaaaaaaagaaaaaaaaagcagcaacagcttagcaattgtggttgtgttttgattcccacagcctccctcatttgatgctgaggcatgggtccttggatcttaatcatttggggtcgtgggtccctctgaaaagataatgtaaatgctggaccctctctccaaaacctgcacatatgcacacaacccacactttgtgtataattttggggataccagagcctttgaagcccatcccagactcccagggtaagggccctgggtaggcagcaatctcagaccgagatattgggcccagccccacttctgccaagtcatgtcatctgcatggggttgcttaatctctctgaacctgaattgtctcaacacggagtgagcctgccttcctaaggccctttccaacaccaatattctacgatggcagtgagaaggaaatatagtgtgtaagggaaggattattataaacaatcttcttgattttttttttttttaacttagagattgagaaaggttgtttctaattattgcttgactggatgaaaggtataatcaaaatatgatgctaaattagtgtgtttttcctagactatgaaattcagaggcaaatcaatgaacttgagaatggaggtgaaattctgaacgaaacacgctcatttcatcacaagctggggtgagttcgcattgctgagcgtcctgaccacagccgggggtggtgcgagagggctgggctcagccactgaccagccatgtgaccttgaaggaggcacgtagcgtctccacttttaggtttcctcattagtacaattagaaaagtactgtacccttcatgcctgtaatcccagcactttgggaggcaatgggcagatcacgaggtcgggagatcgagaccatcctggctaacatggtgaaatcctgtctctactaaaaaaatacaaaaaattagccgggcatggtgatgggtgcctgtagtcccagctatttgggaggctgaggcaggagaatggcatgaacccgggaggcggcgcttgcagtgagctgagatgttgccaccgcactccagcctgggcgacagagcgagactcctctcaaaaacaaaaaagaaggccaggcgccgtggctcacgcctgtaatcccagcactttgggaggccgaggcgggcggatcacgaggtcaggagatcgagaccatcctggctaacatggtgaaaccccgtctctactaaaaatacaaaaaattagccaggtgtggtggcgggcgcctgtagtgccagctactcgggaggctgaggcaggagaatggcgtaaacccaggaggcggagcttgcagtgagccgagatagtgccactgcactccagcctgggcgacagagcaagactccgtctcaaagaaaaaaaaaaaagaaaagtactgtaccctatagggatataatataccctagggctgccaggaggcttgaagtgacccagactgtgcccaagggcttcgttttaggccctttccttctctgcttccagcttacctgccttgtggcaagaatttttacttccttaatctatcagatctttcccagctgaagctagaggcggaacagagtgaagacctggttgtagagatgccttatttttgtttagataacttgggccttaattttctcactcagaattttgagcattgtatacttaaagcagaatactgaaaaaagctcaaaagccgagtttgagctggctgaaagatggctacattgaagtcatttcctttaaaaaaaaaaaaaaaagatcattctgtacatttcgctttctttatgattgttttttgaatgtattcatttaaggtttccccatggaagtccacagagtttgattttgcctgtgccccttattggtaggggagcccttccccacatataggctggccagtgctgctttcaatgtttaatgttttcttatttaactattgcaggtgcaccatgtcaatgagagacaaagaaggaaaacaggactacaggtggttactccttatggcaaaataccgctatatatcgggggctggggcgtatttcaagttcatttaaagttcaacataatgatcctgaacaatttttagaaaccactttttgtcattgttgtaacatgatgggacatctagacttcctctttgatatgcataccgagagaagtactagtttcttgatttggtagcctcagatctggtgccttgtttgactgattcagcttttggaagaacttgttcatccactgctgtgtcaaagttgtcatagttgagctaggaggatggctgtagaggttggggcctaggctgttcttattctaatgttcagtaactgattcagtaatacgctgaatgaagctccttgagaagaaatgagaaaagagatgttgatagcgtatgttgatggtagttcccttgaacctcatatgatgctatttcatgataaattaagttgaactacttaatatgagacccacaaataaagcaaatgctaagaacaggcataagataattgaaacttttatttttttctcattgagtttagcaggttgaagttttaagcaacaaagttgtgagatcggccacctttcctttgtgaagggcagaaagatgcaaatgtagctattatcaatgaggatcaaaatttgcatgtttatgtgggaaagaagaaactcataaacgcttagcatgaacctcaccccaagaactcccattgtctgtctgctagagtcaaaattattttaattaaccgtgaacttcccgggtgagtctgttctcccaggggcccactttattcctgagtgttgctccctcccctgttggtgcgccttcccctgagtgtggagtccggctttccatccgcccgtggcttcagcatgatgcctcaaatgatagtgagctgcaggaagcttcccctgggtttcctcttgccctcagaagccagactaactcacagaagagatctggcagtgagccgatgggtagcgtgtgcttcgaatccattccctccaaaccaccacttcttctgaataccctgctttttctacataagccctttgacaaaaatgggcagagagtaaccattagtgctggacgagaacagagggagggacatcttgtttcataagattacatgcaatggtgcagctttgacacttaaaaaaattaattcccttcattttttagagcagttttagctttacaataaaattgaatggaacgtccagagttctcacatactcccgctccccactctccccccagagtctcctgttaatgtgccacagtaatgcaagatgctcatttgttacaatgatgaaaccaatcacacttccttattggctagagtccatggtttacactagggttccttgtttgtgtggtacattgcgtgggttttgacatatgcacaatgacatgcatccaccatcgtgtcacactgagaagttccactgcatgccctgtgctccacctcttcatccctccctccctcttctccagctgtcacattttgtttaggcaaaatctattcatttcttctatttctcaagggtaaatttttttcctttcattttttatttatgtaaatgctgctaaaaatagtagaaatgttgaaatggggggaaagtcatctttccttctaataagcaaattgctctcatttggtcctgttttttccagcctgtgtctttatgaagacatagtcctgcatacatatggatgtttctgtcaacagtggattacgtatgctacaggagtcccataagattgtcatatggcatttttaccgtccctttcttgttcagacatgcttagatacaccaatgccattgtgttacagttgcctgcaggatttgggacactcagtagccttggagcagtaggctactccacatggcctatctgtagtaggctgtaccatccaggctcatgtgagtgcactctgtgatggtcccatgacgaaatcacctaacgacacatctctacgaacatatcgccgttgtgaagcaacacacaactgtgggcacaattcctgatgaacagtggaatgaatgatccacagttacaaatcccagtgtgacttcaagcctgtgttgtgcttctttcactcatcttatttataagcatggagaggggtgggtttggaggttttgacacttatgcaatggcttccctgggaaacagaattgacgtaataggacatttgaaaatatttgcaagtaacatggcatctaaacacagaaacattcatattactgggggaggttttgttttctcattaatccaagtactccagattcaggtcccgtctcctctgtctgcccaggttcatgccagaacccaacctgcctcccctggtgctctacgacgccacatctctgcccgcaggtgcagacccacagcaagtgatcaatattgaccagattcgggagacactcccggagctccccagtgtgacccgagagaagcttgtccaacagtatgggatgctgctggaacacagcttcactttgctggtaggtatcgatcggatgccaagaggatcccggctcagcagatggggcagtgcccttcagaggccccgccacacacaggctgccatgggctctgagtggggtgggcgtgtttcttgggttgtactatagatgctactgagaagaataagatgtagtaacctttgctcactaccctttatggtaaatgctcttcatacaaccagaagatgaaacgcaatcttgtgttagtcatttcttctgtgtagaaatgaacgcctgaccacagcagctgtggagacttcttgaagactgtccaaatgttatggatgagtttttcccatgtgtctgaaggacaaaagaaaatcaatgtatagggtttctggatgtctagcggtatcgagccatgacagggctggcaggatgttgcgttctcaaaagccagccagttgttttgccaatttcagaagaaaacatttattccacatgaaacactaaaaactctgactaaaagtatcagtcctttgaggcttgaggctgcgtctgacggggccggtagagaacctgacactgtcaagatctgcttagggattttccatccttttcaaagctgcctggggctttgtggttttctttgtcatggcagcattaaagtgatgcggcatcagtgagggtagtattttgtcaccgttgtcgtcgtctgttaggaaggaagtgggaagttttgttgctgcatcttccagggaatcagtatatgccacacctatcttttggggcagcaggatctgcggaaactggatttttgctttttggatggccagtcataactacattgggatgctggagtatatatatttatatgtctatttatacacttccaataacaacatcctagcatttacagtacaacgtaggcagtcagatgcatgttgaatgagtgattctctcttcatcatccataaatcagctacttggagaagcagagttggtcactgcctcctgtgggctgctgtttgatcttcttcttacctctctggcaattatatcactgtcttttaagtacttattagtgtatgttgttcagcatcttgaaggcaaggactgcttcatcctctgtgctactcagcacagatgagcacaacatcagcagtgcttaatgccacactttgactatgactgagtcagtcagcattccgtacagagcacctcttaacccaaagcctcttacaattcatgtatttttcctaggttgacgtaacaaaactacgttttagtcttatacatcttccccaccatcttgaccacttgagtttccaacctacttgaaataaacactgaattctagccctaccttttattactatttgtgaaattacataggagatgggaggaagggaccaaggctactcagcctcgaagatttaagttacctccctccactcagcaggagcccaagccaaccctttgaggtagtgtatgatgaaccaagaaatggccaaggtttccttgctcaaaatgtgatttcatagagaaattgactatatataacattaatttgtgtgtgtgtgtgtgtgtattagctgtctccataagagagtgaaagaaactttcagaatctcaagaatacagctgtttctgttcaaggcactgtatgagaatctgtgcccccttcagagggcatttccataggattgtcactctcggccgttcatgagcggtgatggggacagtgcctgccttacctcactgagcataagctccatgagggcagggacatttttgtatttgtgtttgtgtccttgtctttattcatgggtcctgcatggtgcccaaacctagtaggccttaaataggtgtttgctaggggctggcagatgagtgagtctatattttaatagtttaaaggcctgtatagggaaacctaccttcagttatttaattcagcacttttttttttttttttttgagacagggtctcaactctcgcccaggctggagtgcagtggcacgatctcagctcactgcaacctctgcctcccagattcaagacatcctcccacctcagcctcccgagtagctgggattccaggcatgcgccaccactcctggctaattttttgtatttttagtagagacagggttttgccatgttggccaggctggttgaactcctggcctcaagtgatccgcctgcctctgcctcccaaagtgctgggattacaggtgtgagccaccacacccggcctggttcagcacttttattagcatcttctgtatagcacgtactgagacagaaacaaaagatttttttaaagattttttttgccttccaagaatttatacatacacatgcacacacacacacaccccactacaataaccagcccacaggacagattacactagatagatggataatgtaggatcagggcccacaagaggtagtggttaacttgattggaaaaaaaaaaagaagggtgaattttttggccatttttgaaaggactttttttgataccttaaaaacgtccttatttttatggcttgcagataatgtattgggtgattagtatttttcctttaaagggctagtacttgaaatttccaagatgagtgagattagaatgagataggaatggaaagagaatgattcagacaaattgttttcctgaaattaggcagcctgagccctttatgactttgtaatcattggaagcggcgttactcataacatacccgaaaatgatatgttcgtgttttttcctgccttcatcagaaacacaacagattgctgagaagggcagatgcacaaatctaatgaaccatctttcaatttaaagagcgcccaggagtattcattaaataaatagcagtggtggaggtgtgctttgcagagctgcaactctgtgctctctgtctttggattgcttattaaattaagcattatgcacatgcccacccccatgcacacctcacccacaaatgacgaaaaacttcagaatttaactctagtctttaatttatcttgtcattttatcgtgcagtgagcaccaaattattcttaatatttacagaactctaatgttatgctttagcgtctaccacacacaatacctgacacggtaggtactccatgactgggtggacagacgggtgagtgaatgggatgttatcacagcacacaggaagatcctgggagaagcagtgttcctgataaaagcatccctgtttccaaaggtcagatacataaaccatgctttgacaacccagagaatcatggggtatcttgccccacctaaaacttcaacctatttagctaaccttgcttctctagcttatgtcaagttgccttcatttcatatatatatatatatatatatatatatatatatatatatacacacacacacacacatatatatgaaatcgatttttgtttgtttgtttgtttttgagacggagtctcgctttgtggcctaggctggagtgcagtggcgccatcttggctcactgcaagctccgcctcccaggttcacgccattctcctgcctcagcctcccaagtagctgggacagaaatcaaggcaacttgattttgtgcatgtgtatgtatataaatatatatatcaaggcaacttgacataagctagagaagcaatgttagcttttctatatatataaatttatatatattataaaacatatacggaaatatttatgattataaaatttattataatataaatgtaggggctacaagtgcaattttgatacatagatatattgcatagtgtaagtctggacttacagtgtaaccgtcacccaaatcatatacatcatacccagtaagtatttgtcatcccttattcccctcccacccttccaagtcttcagtgtctgttattccacactctgtgtccctgggtacacagagtgtacccacttataagtgagaacatgtggtatttgattttctgtttcagtgtcgtttcacttaaaatagtggcctcctgttcatccatgttgcaaaagacatgattccattcttttttatagctgaataatatttcattgtgtagatataccacaacttctttatccagtcatccattgatggacgcttacgctgattccatatctttactattgtgaatagtgctgtgataaacattcgcttgcaggtatcttttttaaatgatgatttattttcctttggctagttgcccagtagtgggattgctggattgaatggtagctctatttgtagttctttagggaacctccatactgttttccatagaggctgtactaatttacattcccagcaacagtatataagcatttccttttctctacatgacctcatttgtaaagattaaagaatagaaatgttgaagctgaaatccaggcattaggattctgaaaaaacgagagattctaatagcataacaagtttttctctgagtcagtatatcagtagtagttattataatacaatgatcagaattatatgcatgtgcatttttcttagcaaaatcctccctggctgatttctgtggggcatctcttcctaaactctgtgctttacttcactcagagaacacaaaagcattgtagccatttgcctaagcagcctagaaaaggctgcctgcttctagcatgctctgcaattcacattgtacgactttttaatctatccttacagcaaccctctgaggcagggactgctgctctccccatttacaggtagggaaatgtaacctctttggttcaataacttccccaagcccgtattggagccacattcagatcatgctgacttcaaggcctacgctcttcattcctaagctctgctgcccgcttgcatatataatgtgctataatgtcaaacagaaatagtgtttttagttaattgatgtttggagtcacttgtgtttcattagtggagaaaacagagtttgtacttttgttaacattcatgccactagcgttttgtacagcacaatcacagaacatagattcatttaaaagtttttaccactcctattgatttttaagatgccagactgccctataaataaacataaagtgccatccactaaatttagtgaaaatcagtcaacgccaatgaaaagcagaaatcatgtctattttccaagtgaaaaaataaagttagaagaaaagtaatataagccgtcctctgcagctttatttattttgtttcttaaaccttctgctggaagcacttgagtcctgtctgaatcgttgggaagttccaggcacggtgactcacacctgtaatcccagcactctgggaggccaaggtgagaggatcacttttggccaggatttcgagaccagtttgggcaacaacgtagtgtagtgagacccctatctctacaaaaaaaaaaaaaaaaaaaaaatttaaattagccgggcatggtggcacacacctgtagtcccagctactcgggaggctgaggtgggagaattgctcgagcccagaaattcaaggctgtagcgagctgtggtcgtgccactgcagtccagcctgggcaacagagagagaccctgtctctaaactttaaaaaaagaaaaaagaatctgaggagtgtctccacgtagggcagagtttgtggcatttgtggtttgattttgcctggtgcctcctgtccttcaagactggcctttaataggaacttggtaggaagcagagatgagcttgcagggccctggctgtgcatgcagtcagtagacgggaagatctgaagctcgtcggtgggagagttcagcggaggaagccagagcatcccgagttgagtgtttcttgagggcctgccaccctgactgcagtgccggatgctagttccaaatgtcagtgcttcagcttttccatgtctctccagagcagccctacagggaattgagttaaaacactgacttggggacagacacccttgattccacatctgacctctgacactttggagctgggagggctctgcagggtaaccagagctgtttccctccccagctgaaagagggggcgatgactcacttaccccaaagatgacagacacagccaaatcttcattgaatctaaagcctaaatatagccaagcagactcccaagaatatgtcgccagggagaagagtgttgacaccaagcaacgcgctaaaacagttcattgagagccacgaaaggcagggctgtagaaacatcccacatggccccagtgagactgtaggaagatgtacttgcgagccctcgaatcagcaccctgggctgccatatgcttgtctttgtctttatagtcagcctcaggatctgtcatcttacttacacaacttcattctctccagctggttcttccacttttaaaatcataatcctttgtttctgacatcatggaaaaggttaaggtgtctccaagggacaaagaaacagaaaagatatcatgactacagctggttgttaagtggattgtttttcaagaattttcctttaagtggctagtaagccagaaatgaccaggtttgctttctggatgaattgcctataaaataatttcccatgataaatatctatatatcccatatgtaatactactttaaagctaatagtatctacaaacatattgactggttttagactggccagacttactgaggtgcaaagtactcaccttctaactactgttgaaggaaaatctatttggtcaacatcatcaggcaccatatttcagctccgtgcaattttcaaaattgattttattcttcattttataaaaattgcatccagtgcttgctagcctaagggtgcttttacagtgactctatacactagaaaaataaccaatgttttgttctggtaaagttgaataaaaagatgtatcatctaactctacttctgtaaaaccagcagttcatttcttttggatgcaagggatgaggagctttcagaggggaagatgctctgggctcagagccgtgtgacacctcaggatcctgcccagtagggagacagtgcagggaggagtaaagtcctgagtgccagccttggggacccacagggattctgtccccaacctatcccaaagcccaatttcctgtggaataatttccttttcaggataaatatatattatttcaggtttcaggcagatcttggaggaaaggagcaaatcctcactgcctctgttgctgtttttaagctgcagccagaaagctcctattgagcaactcaggttccttccatgtggggacgattggacagtggtggtgttaggtgcgttggaacgtgactacaattggaattgatttcttgacaacacactgcctgtgtcccattcgtgcagatagtcttttagcagtgccggtctgctgtcagcttgtagtacctgaattatttggattttgattattcgggggaagttgttattcccaaactggtttccttcagcatctcccctggagttactgcatctcagaggatgtaaagtcattttcacattagtttgaatatcccctaaatggaactggtgcctgagttgaactcaagatctgtctactttccagctttcctgggaacatagcacaagtgaaatggttggggccaaagttttgctcagattttaggggctcccaagccttgctggggaaatgacccaggaataaaaattgtgggcaccaaaacaggaccctggacccctagttctgtgttccttgggagaacacacccgtgatgtttgtgggtccatttcagagcctctgcagatccctgtattcttgccagcagcagtggaggttctgcattgttctagctttctcctgacactcttgaggggggggtcgtgtttcctgtgccagcctcacaccaccagttaacttctgtttgttttctccactgacgaggcctctctcaatgagtaatttttctgttcacaggagcactcgctgaaagattattgcagcggcttcttgtttctgtgaaaagcagaaggggcaccgattcccgtgaacccacccaagccaccgccccactgaacattccagtccttagccttgccctgacgcctgctttctggctgagagccatcactgtcctgggcctctttgcttcattgccatccccagcactagcatttggtgttattttcagggccatttttttttttacatagctgttgtatttgagttttgtttttctcactttataagaatgaccaaatccacaggaataataaagcagcagtgcctgcgttgatacgcaggtgatgagcctcctccagcgtctgcacaaatgctcagcagctgctcaccccagcacccccgccgcaaaggggacggatgcaattccagtgtgcgcctctgcaaaatgacacactgtgacgtgggagagccttgtccagtggaaacccctgtggttccgtctgcagatgtagagcctttgtatagtcagcagctcccatcacaggcatgacctgctcaattaggtaggacttaccctattagaggaattagaatgcaataataaataaaatacaatatgctcaattggtatgagaaataacaagatttgtcttgttcaggactgtgcagtgtccaggtctgggtgtgctcgcaggaccttttctggggcagcagtagcgtggggaggggatgcagaggcaaggcagggggcaggagaggggcagaggagctctggccgccctccatccccggagcccagtatggcctgtgcagtgggcgtgcagctgtcttccttcctggtctgggaacaggtgtgtgtcatgccacagctgaatgccacgtggcctaggtgtacactggcaaaggcagaaagtaaacctgccattttctccttctgatttcaaagttaatttccttgcaacatttttaatatgttaagaacctttgaacagctggcagctctcaaataaaataatggaagtgtgggaaagtgctttcttcagatgagctggctgcctcccattgcgcctggcactcctaggtgctcagtttcggtcccaggcaggcaaagaccatgaccttttcttcctcaaaggcagtgccacacagaggttaaaagcacaaaccgcagaggtttggtcctagttctagtgctctcttgctgtgggacctcaagcaagctagtgcctcgtgtcctcatctgtaaaagtcctgagagcgctgagctcagagagttgttgttgggatgaattgaggtaatgtggagagagtgcgtagacagtgcctggcgcccatcaccgctgctgctgtaactctggttatcactgtcctcagcagcagcagtagcctcacgcagccacccacagggcctggttctgagctctgtgtctagcagatatttagcagatactcttgagcacctttgactagcccagaatggctcatctgggggtcccttgtagctgtcagaacgctccctgtcacataaccagctgttcctcaacttgcattcttctgggctgcttttccttctctgagtctgccactgggcagctggctctatcaggtttccttctcgtaaataaatatagtccacctcgttcctggcctatcgtcagcttcacagggtgtgtgacttagaacaagaaatgcagttgagaaatcagccttcatcctattccaactggagagtcttccagcatttgcatttgatcatctctgaaggtgggatgcagaagaccgcttcgaggcaggttgctcccagggcctagtgcagggtagactgaggttccttccctgagcaggcagtggtggtgagcaggtccctctgctttgcctcacaccagcattgatcacctgacaaatcattagtaatcaagggttcctgttaatgtctgagaggcggagccagcactggttctgggtgtaattcagtgctttgggaaatctgattaaaatgtgaaaaagatgcttcccagtcatagagctgtagagactgtcaggtattatacaaaagacaggaccgctcatgcctgctgctttagccatctctgaaggaacaattagagtcgcagtcagccagggaacttgactctctgtgtcgctgaagttgcagttctattgcatgtagggtagattcatcctgagtcgaatgcttgcttgttgcttttgaggaggacattaaaggttccctaatgctgtagcctttctgcattgctcttcatatgatttttatgtaagggaattaccagctcactgtttttctgagaaaaccagatggctgcactgacatgttcaccagagactctgagattcgtgccaagcttattagcatttgccaatctcatggaaaaactaagaagatgaggaaactagaatgtgtgtgtttcttccctcagaagcagcttctgctatgaagagcagagcgggcagcccatgtgcagcttttattgatccatcatttcctgggtggctgcagctcagcctccttcagccccactcgctatagctcaccccatcaccaccacagattttcctgtctgctttaaattgtggactgaaactatgtatcccctagtgaagtacagttccagctcagagaggcttcatcacagcactgacatgaaaagacaaacagaaatctgacttgccgtgttatccatccaataaaaaaaccacccaagggtagaggaatagatatgcatcacgtcccagcaactcagccaagcctgtgagtttaagtgcaatatttctaggtggatttagaaaaccctttccctggcaaagcaaagagttctcctgacagctcattttaccagtgggccagcctgtctgggttagaacaaagggaattctgcccgtctgatttgggccagatagcagttttctgcttccccagtgatttgtgtactattgtagaagtttgaatacttttccataagttaagcagaacttcctcttcaagttgcctggctctgcctttatctgtagtcaagcttgggctgccgaggtggcctctgccctggtttagcatgagcagaataatagcactggcttgaaaagagattaaagagatgattgcaggattattcagcaggcttgtcaccagagaatttatctgttacaaagaacatgtagggttttttattattatggaatttctgctatgcctgtgtgtgtattccagcagctgcaatagctacacttggagagcacttttgttagtatatcttgcttctttccagtatctcattttttccagaaaattcttttggttaatgaagggtctctgaaaggagcaggggtagaagccttaggtgcagtgtgaacttaaaaggaatatttcaagaaaagtttgtttgatttgaatttccatgggtaaaggaaatctgctacttaaaacgtatatcctctgaatttggaaatttcagccttccctttctgagcagcacagtttttatttttcttattgaaatagtaggggtggacttacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacctttatactgagcagctgccatggcccagcatggacttagctgtagctatatcgtgaacagggagggcacagccctgactcgtggggctgacagttcagagggggagaagtggtacagtcttgatgaaacaagtctccagctgatcatttccccaggaaacgatgagaggcagggcatcttgtacctggcccagctcagaaggctgggacactgctgccctctccacctgttattaagtggcctaagtgggtcacatgtgcccatgttctccctcactttgaaaacatttcagaaccattcctgtctatttcttgtcatgatgtgagaatcagtacaggtatgatccacttttgatttttcagaggtagaatattctgtttgttctttcttgattttgctttgttttttaccctcttttctagcaattactgggacttcagcagaggacaggcctggaaagaacaggggcattaaagtcaggccaaacattttaggcccagttcacagctcagggatggagagtgcaggttacacacagcagacacggagaaagcaagtgggtttgggggatgtggaatttcaccatccctctggtctgcaaagtcagggctctctaaaatgtgtttatccttttgagaaaatgctatgtaaatgcacagtgacagtagtagaatagttgtcattagctgaaagtgatcagaatgttctggtgacatctcagggtttagcaaagaaaaagtggctgtctcagaggaggcagaggggacagtttcagatttgccttcagaatgctgatctttcatttttggggaggctttatgtaattttctttttttttttttaacagaacgaagtcggcctactggagttcttccaaaatgtgataaaagaaactagggcagagccaaaaaaggtgactagttgggtcctcaacacttttctgggctatttaaagcaacagaacctcgctgtcagtgagaggtgagtgaggtctgggatttctttcttcctttgtgatgagctctgtccagaagtgctggaaatagggcaggtccatttttttgctcctgctgttctccctcaggatatcctgacatgacacaaacatcccctgtggactccacattctaaatatgttctctagcccgtgtaaaaatgtatttattccttcaaatctgtgactgtgcactgtgtcctctgcactgtgtcagaggctgggggcacaaagatgaatgagacagacatttacaaacttgtggaggatacagatctgtaaggaaacagccaccccagggtgatcctgtcatgccagaagcatgcacggggtgctgggaatgcacaaaaaggggagttgaacagaggctggggaaccaaccagggctcccctcgggaggggacgtttgagccatgccctgaagcattaggggagagtcgctctgcagtgggagggacagatcacgcagacaaagcagagtgcgaagctcagagagcagcagcacagcaggctcaggaacgccagaagctgcaggggccggaggcaggcaggtgggaatggtggggacagagccgcggagatgaccaagggccacctggagaactgtgtctgcctttatcaccagctcttgacagccatagactacaagctcatgccagtttcacactgcggaaatgcagtgtgtctcactcaactcaggccactatattccatagactgggtggcttcagcaacatgtctttcccatgattttggaggtggggaaggtccaggatccgggtgccagctgatgcattcctgggtgaagccctctgcctggctcacagatgtcctcacatgacaggcaggagttgaggggtgaaacaggaaggggggagggagagaaggccctccaatctcttcttataggatccccattcccactatggggaccacaccctcgtgacctcttctagacctcattactcctccagggccccatcccctaaaaccatcgcgcttcaatataggaatttggggtgggacacaaatattcagcgtctgagagcagactagaagcaggaattccatttgggaacctctttcaggaatgcggatgagaaatgccccaggcctgagccaaggtggcagtggctgggttgaagtgagctaggccaagttgagagcaattatctcaattggcagaacttccagatttcttgcttgggcagaggtgaaacagagggcagactttttcaatgtaggaggagctaaaggaaaaggaataaactttataggccgggggtgagggaagatgccgtattccatttcagacgtgctgacttcgagctgcctgcaggacagacatcacccccacggggctaaccagtaggcaagatctatgagtctgcagctgataagatcttggggaggtttgcagttgagagttatctcgttggttcattattcagctcatgttcacttagcctctgctgtgtgctaaggtctgtgcccagcatgagaagcgcagttcctgggacagacaccagccctgaatcaaagcacaggcagccttgaagctggtggctacagtcagtgacaggggtgctctgagaggggaagaaggtagcagctaagctaagacctgaggagaggatgagcagggacaggccaaggctgacagggaaaagtgttccaggcatggggaaaagcacgtggagaaatctgaggtgagtctgggcatgagagtttggggaatccagggacacagcacaacgtaagtggaacatggactcagcagcatctgtacttgaagctgttggacagatgagaactttcagggagggtgcagcgtgccagggtggctggggaacgaacctgaagctctttagcctttaactgggaagcgtgcacagagaaggaaatgcaggcgcgatggcacagaagtagaaggaaaaccaggaaactggggggtggggggggggcggggcggggactggtgacacagaagccaagggagaggcaagtttcaagaaggaaagaatgggcagtaggtgtcactttggggcatcagaaagagagttctctgggggcacataggcaggtggcagggcccttgcaaggtcccggggcagggggagcccaggctgggtgggtgtgtcattgtctcagcagcatcccggggagtgaagacagacagatattgacaaataactcccaacagttgtttgcccaaataagttaactctagatggtgtcaactccatgttcagccactggatatggatgcacacatccatgtgttagtgtggcccgggtgttagttcccttcccgactcggctgctcagcttgaatgagttccccctctgaccctcagtttcctcactgtaaaatgaaaatggcaggacgtgcctcagagagcttttgagggaaaaagtcacagtgcccggcacgttgtgggcctcggtgtgagccaccttctctttgccagggtggtgtgctgaataccagagcacctgccaccctcctgaactcttgtggcatctgctgcctctttgtcttttttttgttttgttttgttttttagacagagtctcgccctgtcacccaggctagagtgcagtggcacaatctctgcccactgcaacctccacctcccagtttcaagtgattctcaagtctcagcctcctgagtagctgagattacaagcacccgccaccacacccagctaatttttgtattttctttttagtagagacagggtttcaccatgttgggcaggctggtctcgaactcctgatctcaagtgatcagcccgccttggcctcccaaagtgctgggattacaggcgtgagccaccgcgcctcttggtctttcatccctgtcctcccgggtttggcctctccattcagaaattctggtgttggtgctgaaaatgtgtggctgttctgtggaggcaggagccgtgctgaagagtttatggatgggatacagctctaccagagtcttcaaggctcaacaggatttggtgagggagagggcagtgcctacctggagcccaggtgcaggaacagcaaagaactggaatgattgggaaggagaggagcgtagctggcaggagcagagggtggaaagaggccaagaggtgtggctgtgtgcagagccagagctgagccggaatagggagcctctggaacgtcagggggattcagccatgaacccatcaggtgcagagccccactctgcagtgtgtgggggatgaccaggacccggttctaccccacaggtgctgtcagcctcctggggaggactagaacttgtgcatcagaattttaattcaaggcagaatgggatgcttccagtgttagaactagacacagtgcagtgggaacagagaggagggagattcacaccagccagaagagtccaggaaagctccaagaagatgaggtgtttgcgcttctggaggaaatagaaatttcttagctttaaacttagtttttctatgttgttggttaaaatgtacggaattgctgaactttagtcctggaagagaacttagggatcttcagctctttcatttagcagacgaggtgacggaggccctaggagataaggtgacttgcctcagatggcacagccacaaagactggaagccaagtcgcctggcttgtgatcggcttctgtatatgttggtctgtgaagttaggggtttaacagtcattttggtggcctctaaaggagctgagagataaattagcctgttgagtggacctggagcccctggtatttacccaagcagtttataagcagtaaagttttaagaacctgaagggtacccaattctaaataaaggtaggcttggttgttccaaaatcaagtaaagaggaagcaggcaacagttgtgttttacagtttaaatggaacaaggactgagaagccaaaaccaaaccatagcagctcttttcctacacagttcaaagaacgtttagctggactgatatactaggctacccatagagcaaacattaattaatgaacagcctcagctatgagtgctaatgtttccagagcttagaagggcagtagctgcaaaactagctatagtctcacaatgatacccaggcaaggaacactctggagatcaaattggtagagaatgattacgtgaattagcattcatctttaaagacctctcagaagactgatgtttgaagggtccaacctcttgttgaacttggctttttaattgagtatattgcttgaaaggttggtttatttggttgacagcttctgaattatgagtaacagatttggtttagttaagaaagtagacattgtagatttcctgagcaagcattttgtggtaaaattaggcaggtacagctatccagctgtccaagccagttgagtgccccagtgtttcaggtgagctgtgggcaacaatttctgagcactggagcagggaaggatttgaaaccaagaagggactggaggtgagaggaagatgtgtcccacagcatgaaatgtaggatagcatccaaggatgggctgcaggcattggaaacctgttgagctcactgtggccagacccacagcaagtcagaagtggtggtgttgggaatgcaaaaggcaggatggccgtatttcatgtttggaaggatcactaggatctggtaataaggtactagatttttcagggagtaggtgatgaataaagcaaagacaacatgataatttgcactctgatacctagaagcgtggtgttgtcatcatttgagacagaagatgggtggtgggaaatgcagaggagctggtctgtgaggaagacaagtttggcttaggataaggattgggaaactatagcatgtcagcctctggcctgtttctgtagagcctgtgactaagaattgcttttacctttgttaaaacaaagaagcatatgtgacagagggcactcaccaagcctcaaatatgcgcaccctagctctttccagaagtttgccatcctggtttagagcacattgtctaggtgtgaacggggcctctcaggaggtggttgacatcaaccagggagagaaacaggacctgaggcagcagcggcagccctgggcatcctcctcacggctaggggtcaagtcagaggacccagcaagaggacaccggagccacctggcatgaactggcaaggagcagcagagggacaggcaaggaagaggaggacattccggaggcccaagaaggaggtttcacaaggagcttacggtgcagccccaggagtcagggtgcagcgggatggggagaagctgaatgtttggccacaagcaagggggttgatttttaagagaagagcttctatagaggggtaggcacagaatccagatggcatgtgcttacacagggtaggtagtagccactggtgctagatcgttattgttaaagcaagaaactgggcagacgcaagtgactgcaaggtcagccaaaggcattgtcaagacagggaagatcggagcatttgtgaagctgtgagattcaagccacaggacacgggaaaccagcatctttggttcggaggagtggaaagagtggggttctgagcaggggtggaggggttgtttgatggaagaggaggaggagagtgccctagaaagttctcaaccgtggctcagctgatgtccttgtgaaatgggaggtgagggcatgtgcagaggaggggagcagaagggggctgcctggaacaggcgcttggtgggacgccagctaggggcactgcgaaatccgtgagatgaacacagaatcctgtgcgcagcaggtaccacctggaggcccaagtcccaatgtcttccttcttcttgcatcctgttttaacagaagcagagaaggtggactttgggcctgagataagctgggggattgggacagacagcatggttcacggggggtcgggggtggttgtagaagcatcagcgttgtctgctctcatccaagcaggagatggagctgtgatcctgaatgagctctgagggactggacaaattttggagctttgaaagagcccctttcccctcctctgtcgaaccgcggcctcagagaatgggagggaagagagcagcacacagagctgaaggccgcggtgtcagtttcttcttcagcggagacgcattcactatccagaaaccagtattacctgacaacagcaaattagtagcctgtgctgctgctgccattgcgtgtcgagtctgagggtttatttatttaggcgatgagtggggtctttcggggtctgtgtgacaggtactgatctttgtcatcgtctgactcaagtttagccctggcatatgtggaattaacatgtgcagtctgccagacatccctatgggtgtgaggaagcctgtgacacaaatatgatgacctactgtgtgacaggcatcgtagggacagaaaagtgatggagaaatcccaagtgtgattacgtcagtggaaagattttgtagtctaaatttatgacccaactgatgaattaaggtccttagatgaacttctcaaaggcgacgttatttttagttattttgtgttccttttctgtccctctccacccctacgtcttttatgtcattgcggcgatctgaatgttgggatcctcccccaaattcctgtgttgaaatcctgacccctaaggtgatggtgtgaggaaatgggacctttggtgggcgattaggtcatgagggaggggcttttatgaatgggattagcaccctcatcagagaaacttctgagagctccctcgctccttccaccacatgcagacacagcaagaaggtgccaccagtgagaaagtggaccctcactagacatggaatctgccagcgcctttatcttggacttcccagcctccagagcagaaataaagtttccatggtttataagccatgtcgtctttggtactaacctgttagagcagcccaaacagaccaaggcaatcatcgacttgtatgggcctagggaccttatcttttgcacgctcaagaaatccagttccacctcagtgcttcttatgggttctgcacacagtctgcattctaagataatgggccatggtattttctaggattgcagaacatccaggcaacccacgcttttagaaaaatccggcctgccttttacttgttagtaaaggtaggtttttttagtttgtttagccgcccgctgcccctcttccttttgaggtttaatcagggtggttcacagatgttctgaataccaatttagtaacaccagatattctccaaacctaagtttcacttggaattgccttttagtcatactttgggataaacagacacttacaggatgatgggctgcctcagtacatcagctgttttaagtggacagccccaatagggtttcactgcacttgaattagagtacagtaagtcagttggttaacacacactccattggtttagagcccgggaaatcggcatagggactaagctgtagtttcctttgtattttctaagcacatccaaagaaattaattttgcatgatgggaaccaagacttaaatagaagatgttttcaagtggcatgaagcatttcagaagccctcatttacacagtgtaacactaatgtgctattgatgtcattcctacctttttaaaaccagtccccaaatgatctcagataggcagcatctcatgagcctagttgctataaatacaggttgagtatccctaacctggaaatccaaaatgcttcaaaatctaaaactttttgagcattgacgatgatgtgcaaaggaaatgctcactggagcatttcagatttcagactttcggattagggatgctaaactggtaagtataatgcaaatattccaaaatccaaaaatatccaaaattggaaacacttctggtcccaagcatttcagatgaggtaactcaacctgtatttagaagtcagaaaaccgtgcattttaaaagaaatagtttgtaattcactgttgtcttttccataatttaggcactcacccctaccattaattcaccttcaagtgaattaatgacacttcgctgtttcactatgcttggatgcccctgaccttttctttcatgggatattggcaaataagtcacatcctagaaatataggtatagtggattctaggcccttctgtgtccagaaagctgtgtgagcctggagaagagagttatgtatcaggttcctgaggatggatgaaaatgtggctggtagtcattgtgttcccttgcagaaaatctcttgcaatttaaaggaatttatatttgcacagaaacactcagaaacgtgactttgttagctggttttttttttttttaagtaatttttaggctgatctttccgttgaaaatatttaattactggagtttgttttccctttcctgttgtggttcatgaattttgcagccacctccttttcttgactaattacactgagcagttgtctgttgctacaacttctgccaaacagctgttattgttgggtggtgaaagaaagaacactagtcacaaaaatttgttatatcctaagatataaaataaataagtaaaataaaagagagcccagttggcctgctgttttcatccctaggcgtgggtccgatatttacccccactagagcaagtgttctgattccgaacagccattcatggatgccctgacagtgtgcaatgtaaatgtgttttctcttttgggggccaccagtcctgtcacaccctctgcactcgctgagcttcttgacctgctggacagcagaacaatttcttcatcagcagctaaacaggtatgtccacactcccgacagcttctgactgtgctactgtcccaagaaatgttttctgtgacacccaaatgccatcactgagtgactttcatcatggaagtattaaatgccagtagtggtgtttttaatgctgaaaggtagaaacattttatttagcaagcgtatgaagccaatatgtgcaatgcaggcagtttgcttctcgtcatcaccgctaacctggggaaatagttattgtctggtcttgccctgaacatctccgcctgacatgtctcctgtagcccttttacacctgagaactttccctcgtgcccaaggcagcctcagctcagctctcagcctgctggggctcttgtcccgcccccacaccgcctcccagccagtcccagggctcccttgtccctgctgcatggttgccctcagagagtctgtcctcaacaaggagggtgaagtcagactctgcactttgtagataaaatgttacagacatgcccggtgtgtgaaaactcagaaaaatagcatcatcctaagcagccttttgtctgtctatacctctgcctaagtgctaggcagttgacagactcgtggaattcagaagattcttacaaatacatacccagagggccgggcacagtggctcacgcctgtaatcccagcactttggtaggctgaggcgggtggatcacgaggtcaggagtttgagaccagcctggtcaacatggcaaaaccccgtctctactaaaaatacagaaattagctgagtgtggcagcgggcacctgtaatcccagctacttgggaggctgatacaggagaatcacttcaattagggaggtggaggttgcagtgagctgagatcattgtgccactgcactccagcctgagtgacagagcgagactccgtctcaaaaaacaaaaacaaaaacaaaaaaaacacataaccagaaagatcaagaacaccaaggtggctgcctcatctcagcttcagtgatcgcagctgtcaatgcttcagccagaagtttaatgttattttaatggtgccttttgcatgtaacgtttatctgcaccgacagtagtggcaggttacaaagggaggcttggggaaagtggctgctttgggataattatgaggcaccatagtgcacgcaccgggctgggtgctgtggaactggagacgggactaataaaagctctgtttacccacctcgagtgaggctgtcaactacagggacctcaccgcgtttaggaaaggctcttgcttgtctggatgtcaggggaatacaaatgtttatgacaatgctgagcagttgcaggaagtttagatggcctgagggcagaaaaagcactatatatatatgtagagagagagagagagagagaagaacacattgaattattgcacgtgaaatgaaagaagggaaaaaccttccccttttcctactcatcctgccccacaacacaacagaacaaaatacctagtgcggtgaataagatagttccagtaagaagaaatggaaaatgttggaagctgacagctgggttcagatgtagggacgctttcagattttatcagcttccagcatgtttaaaggaggggacttctgtgaggcagtcaagcgaaaatacaagcctggctagaagggtgtctagtgtgtgttgcttaagggggtccccgtgatgtatcattgccttggggttttttttgtttttctaccttttttttctgtttttaggaaattactgattttctgggggaaagtaatatatgttgatcataaaaaaatataagtaatgtagaaaaacaaagattctcaggttctaccaccttgaaataactacctttaatatcagatgaacatcatgaaggaagaaggaggaggagggaggaaggaaagatagcaataaagactttcaaaaactgaagttatggtgtacttttttttagtttatttcttattattaattatatagtgtcaaacattttatctggatattttatgtatttattgactttgtattatttatttatttttattttatctggacattttatgaaaagtacatctgtgttgcggcacgcatcagtccttcacccctttttagggctaaatggggctgctcgtctgccaagccccttcaccattgtacggacacattccattttgtctgtccattcatcagttgatggacatttgagttgtttccacattttggctattaggaataatgcagccttaaacattcatgtacaagtttttgcacacaggctgggtgtatacctataggaatggaatttctgggtcatatggtaatgctgtgtttcattcatataatgaggaagtgccagactgtattctaaaatggccgcaccatcttacagtctcacctgttagtgtgcaagggttccagttgctccatgtcctcaccagcacttgttattgtccatctttttgattctatagccgtcctagtgggtgtgaagtcgtatcagggaggatttgatttgcatttccataatctgttgagaatatttttgtatcttatttttatagtgtacttttttaaaaaagaaaaatgtgttacagatatttttttccaaatttaatagaagagtccaagcatggcttgggttttagaaagctgtgagccagaacagagactctctgatcctactggttattggtgttgcctctggcagaactggaagaggctccaataagtgattagatagatgaccaggggataaggaagaaaggtgactgagtgactgactcctagggatgacagacacacagaaagaagaatcatgtcctgagagcagaattccgaattccaaagaacctcccactttgtgctctaattggttatgaatctgcctttctctgcctgtctctcacccacttccttgtgcattatcttcattccttctgcctttcactgcaccctcctcccaggtgtcctgccagtgctcccgacatttacaaacctcatcccttcagcaccccagagccaggggagttaagaggttgctgccacaaagcagccttgttcttcagaatcagaaatagaagctgggaaattatatatcatcatgagcagttatctcctgggaactgtagacaaaagcaccccgtgtgcccctcacaagacccaggctgtgtattgaagtggcaggtggcaccccgtctcctcccctcactaaagacagggtcagcttggacacatcagactcccaaactgtcagagttacagctaacctgaaaacagcctcccaggattcccaagcctcttgtgactcgccctggatgtcgtccagacagctggttagtcatggttcaagggaaatcgcatgggttgtgtaggtgtacgaaggagatccttcatgcacgtctggaaacagatgcagatgatccaccatcccctgaggattgtccagttaacgtttctggaattgggtgccgcagagatggaaatcgcgtttaacacacaagtgttccataataaccaatctcttgtctactttgtggtctgctttaaagagaaatcgccaaaaaccttttaatgtacaaaatgttatatatcatgcaccaaagctgtattacaaatgactagatgtctttttctctctttagtgcttcagttatctgcacagtttactgggccccgctttattaggggcttgggttgatgtttgtgcctttctagaaaagtaacctttcacaatacttgcctttgaccaaaaagggggctcccttctctgtaactgtgacagctccctccatgccatgtcccttgaacaggtctttccaccatatcctgaccttggaaacccaggacaggcagggagaggctagagtcttgtgtgctttccttcaggatacttcaaaaatagctttagctagaaacagttgggtggcaactaagagggtgtgtaaattcagtcctcagggaaccaaaggccgagtctctgccccatgtgtcagagccggctccagtgtctgtgtgtgatggggagttcccagcttgcattacccagtactcctggtcggccatttattaacacagaggaccagcactgtgctagaaattccttgttacatctgtttgtcttgggtaggcagcagcagggcctgggagctgcgctcctggctggaaacagttgcacttggatatcacttctcagggtgggattaaacacagacaaaagctgaggatttatgctgcagcacagggctcggcagccacagaggccactctgtgagcgtcaagagggccaggagcaggagagtctggcctggagacagggccgctccactaccacccagtggctcccaccctcctggactccagccaggagtgcacaatcctcgtcttaaataggattgagcaaaggatgggacaaccggcgtctgttgtataagcctaggggactggggactgggggcctcgactgtcatggccactgcactaatttgtggagttaactaacattatgtattctaactctgggaggaaaggacatttcagccaccgggctcccatgtgttccaggaggctgctgaatgatgtttctctagcggcactgcttggtaccaccccgcctggccctccttctcggggagcagccagcctcttcgtttgaaggcatctgtcctagaggtgcactgcttctccttctgaatggtgtgattggaagtgatccccaagcactctgccactcttccgcttattttggcccaggcaaatccagccaacattcgagctgtgggtcccgtcagaaagaggctggctcactggccagcctgctcagggtctgccgtgtgcttcccaccgcagcagctaccacaggcgctgagaaatcgctccctggtctgtgtctgcagacgcagacccaggaggggccccgcctacttccaggcacaggctgctcgtccgcctggttttcctggagggaactgctgcgtagatttttcacgagcaagtccttacaggtggtttctgttttgagccaggttttcagctaggagcttttttgggagtctgtgcagatgaacaaaatcaacactggtcaaagtctagatatctacgaggaggggataaattatgataaatacatctgatggatactagctagatctttttattaagaaagtacttctgtgctaaatgaaagaaagcaggacacaaactgaatatacgttatgatcccaagtatgttacaaaacagaaagaaaaagatgggaagaaaaaacaccaaaatattaacattggttttcttgagaaaatgggaattccggtgatctcttttgatctctcctgtatttccttatattttctgcagtgaatgtgtattaacttttattattagaaaatgatttttaaaatttaagtcctagttcaaaaaataaacgtgtcagagaaagggggcagatggactcctccgacttacagggcagctccatggaacgccatccaggtccccagtgcttctgctggcagcactccactgataagcatgttgagagtgaggaagtttcttcccgcttctgtgccccctttctcccaatggtttcctcattgtcaggccacgtacatatctgctgaattgagttggaggcacgtgcattctgtatttttctaagagtagggccaggcttttcctgagcagtcgggcagcggcagaggggtgccctgtagggagcttacccaggacctgccaagcacacctccttggccacagtcacagcgcacgttctgaggcaccaggctgaaggcgcagtgcctgtcccagcagtgataagtatttgtggtttgtttttgaatcagactggggaagactttgagccctgctgagactcagagcatctcccttttatttgctttgctgttcgtgctaattatggaagagctctgtttttccaggaggaatggctcctggttggcccgttctcggccaccaaggtaacagggaaagttgggtgttcagtcatgactgtggactggacggaggtggcaccggtgggagaccaacagaggaagccctcctcccggctcccaattctggctttcgctagaagacaagagaaatgaggaaaacagctaccctaggaaatagccttccttgaaaatggtttcctttttctcaggtttgatgaatttggggatttgttgttgtcattttttaagtaaaaaaaaaatgccccaaacattagcgttcattatcctagtctgatttgggtccggctctacctgtaggagatgaatgtggtaggccagggggcccctgtggattctaatttatgttttcagttgtttgccattttgtatcttcattacggggctactttcctgcctccctaaagtcatctttcccagcatgctgtttctggactttatttagtaccgtggttacctcctgcaggctgtgtggccccatccttcaccaaaatgtcacctcaattaattcggcggccatgagacagatccatcagtggcccgccgactcccgtcagcaggcgcccatgagtgatgggcacctccacgcctcccgcggcccccccccgccatgtggagtcagccgggcaggactcaccatccctctgggcacgagggcatctggctggcccgagtcctctcacaccttatgctgagggagacttcagcctcaggaggagaccccaggtgcattcactccacctagctggccttgttccccagccctgcactcagggatgcctcaggagagccaacgctctggcagggcagccaggtgccctttccctttgggccaggcccaggcagtggggacttaattgaatctgctcattcccaccccagctccacacagcacagcactgcaaatggagctggcagaagagctgacttctcatttctctttcctctcccttctctggtccataggtgtttgaggaactgtggaagagggaaggcaagactccagggcagattgtttcagaaaagcagcttgaactgatgcaggaccagggggcactggagcagctctgccactctgtgatggaggcccatcctcaagtggtgactatctcgggcaggggagagggccagagccagccccaggacatgcccaagagcctcgccatcgctccctgtggcagcccagaggctcttcctaagaatggctgacccagtttcatcaataattccctcactgtcatctttttagttaaggtcagaagagatgaaataggtggatattggaaaaacacaacttcttttcctataagaaggatgccacccctggagtttactctccatggaggtgtagtttaaaagggtgtcagcaagctcacgaaatccaagctgtgacctcccaggtgtgtcgccctctcccagggttggcatttcgaatctgttgtggttagcgctacttcctaaggacctcccagtaaagaaccagcaggtgtgccggcagagcagggagagtacaggaacttcagcttcatgcttctaagaggtgggaagaaaggcagaagggaaaagtattcataaattgtggagaaaatccctgacaggagcatgactgaaaaccaggtcattttgtgttcttagcacagcacaagacataaaagctaaaacgagtggcatccctccctccccaagtctaatcatattgtctagagatattttttcagtggggaaaaaaattgtcggcatctttttcagaataatacccacccacccatcagcttgccggggacactcacagctctgtaaagagctctcgataaggaaaatgagcctgcactgggcctccacagcctcgtcttcctgcctcatctgtggtgactgataaagacgtgccagtagtttcaggcttgttctgtggcacttgagtgcagatcctcatgtcattgcccttggagacgctgcagagcaggaggtcacgtggtggccctaagagtcagtggctatctgataggaattcagcacctcctggcttcctcactccccctgcccacacagcacactccccccgacccagcgctctggaagactcggccagtgtgtagatctgctttctgataaaggaatcttcttggtggggagcagggggagaaggaaagccacacatttcagctgaacatcactgagaatcagagaggtgtcctcactgattagacgcagtgattcatcatctcagagagattatccctccccagactcagtgtcctcggtcattgtggcgtcgcagaggggagggccctggctcccacgtgccagcttctctggctttcggcaatcacttcttgctcattttaatcagaaagcagagtagcaaaaatctcctttgacaggagcctagaaacctactcagaagtgaggcccctcccctttttctgttctacattttatgtctaatactagtggaaataagcggaatttaattttcagtaaacttaagccttagtttgggatttgggggcatgaatcccttcattttctcctcttaagtaagtaatttctgtccttctaggtaatggatgtgaagaacagaaaccccagagctataaataaactgattgggttggtccggaaagcgactcaaagccgagcagatccagtcatgataaaggagatcctggagaagaagctgtcattgtgagatgtttgggatccccttgcccaagggacaacaacaaacagtgcagcctgactgggaacaggatcctgtgaaagctgatgcccatgtgccctgagagctgcctctcaatccctgtcccaagccacagctatggcattaatgtcaccagtgttctcaccctctaggccctgtgcctggaggtgcctccacagccgaccagcagccaccccgcctgcttcatccacatcaggagggtccggtgaggctgcagcagtggttaaggagtaacaccttcttgtattaaggaattttaaactaaataaaatgtatgttggagatactgttacccattctaagaaaacttttcattctgcagttccttcaacaaatatttttgagcaactcctaagggccagccattgtaggtgatgggcattagcagtggtcaagagagactgtaatttggatgtattgttttcagacctaaacacaggttaacaaagatgaaaatacaaccaaataaactggcacagtataaacacatttgtttgtttaaggaggtctcaagagggtggggaaggaggatattattagaattaatcaacctatcgactgagtagaagtgatattgcctgttaaactccctccccatcccagaaggcacagtctgagaataaatgaattaaaaaaataagttttccaataaatttaatcaataaaatatatactgaaatatcacataaaaattaacttacacttcaaagattgtgcagctgacaactcccccaaatcccccaaccctcaggccaaacaagataaaaagaaacaagaaaaaagttgtaacatgaaattgacttgttttgcttggaaataagattataaattagtaaatcaaaatcttgacctctcatgataatcgtggtgtgctgcaggcatcacgatgaaggcggggctgtctgcactcctgtgcttgcgacactaatactgttctctccactgcaccggagcacctttgttcggtatatatatgcctttgttacctctgactcacgtcgcttaaagaccagttttgcaaatgttgttttttaaaagcatacttgtcaaaactgtgatgtaagagaataaaatccttggaggccttgatttgaagctgtgaacctgtagcctaccaaggacagtaaaaacattcccgttgtgaacactgctccagaagcagctgaggaactagaaaaaagtggacacccctccatcaccaattcagcgactcatgcttcctggcttgcacagttcctcaggacttccctgagagtgatgagaaaggtgcccctcttccccagcccaaaaggtaggcagagaaaggtaaccagttgcgtggttcattttggacaggcatgaggaggtggctttttaaaaaaagtcgtttaaaaaaattagtgacagaattttaagagactatgtgaccttacccgggaagccaggtgccccgcatcctgttgcggtcctgaaaactactgggtctaaagtaacatgattttcaccaaatctctctacaagacagtaaggctgaagcagttctctcctcactctgcaagtctgaattacaaatgggcaaaggtggtctgagactggagtctgacaggatctttattttgtaagaaaggagaaggttcagtttcattttataaattctgttttcaccaaaagttctggcttcttggtgactaaaccttacagaaagcatcgaagatctttccagaccatttaaaattaaaggcttacttaaaagggggtgcagccagaaaaagacatttaccaaaactattatgtcaagtgcaaactgtattaaggactgattattcccagaggaagatgcccttgttaaagcacttgatttgtccaggctgattctcattcagctctgacaaactgcctgttgtcttgaatgccagcttctgaaatcctgaaagccaaaccttgtaagttgatatcatcactgctgctaggaaaaacccaaagcatggctctgactgaaacccgatgagatattctaaagatatgtttacattaacaccccaagaaattcgcaaagatggctctgcttataaaggggcctcagtgaaatacaattttacattcttgcatgagtgtgcgtttagtctggtctactggttcacccttcagggagaaatctcattaaaatgtatgagttggcaccacaggtgatgccattgccatctgtctcaggaatccacacacctgtaggctgggtgtataatgctgaggctctgactagaagttagaagtgtgctggaaaactggctctgccccaggctggcttgaaccag

SEQ ID NO: 12389 - DNA, 36274 bp, Human
gacccccgcgaaccccagggcgggaactcgtcccggtggcgcgggcgctcgctgcctgctgtttccctcttcgggtcagcccactcttatttcaggagtggagtgggactctcccctgggcgtttagggtgtcgcctctggcatgtgctcccactgcagaaaacaagtccaaatgcaacgcatcgggtttctgaacagccgccagagcgcggaaaccagaccgtcagcaaagctgtcgcgggaacaggggctctgagagggcggcgcggggggcggggtgccggagtgggggtcgaggcgggagggggagtgggggtcgaggcgtgggggagggtggcggggcacaggccaggtggccgatgttgcgcgttccggggcccctcggcaggcggcgggtcgggaggagtggaggcccgggtggggcgggcgcgcggggcgggagcagccccggtcgccgcctgggcgcgggcgccctccctgtggagcatgcgggacgtgagcgacgtgtggcagcctctgcgcagacttttccgccgcggtgtaggtttcagcgagcgccgccttccctccaatcacagcccagcctcagcgctaagtgtgcacctctctgcaaggcggcgcagcgctcctgtactgaggcttcgtttgcaaaagttacatccgtcccggcgcgggcggcggttccccaccaaaagcaacccagatcttccccgcacgcctctgacctgactgcacgactgtcacaagtcgcgagctggtgcaaactgcgagggccgggaaaggagacggggcacgcatgcaccaaaaagtggggaggcagagctgcagggtgtgcaggataacggagtgaattttaggagtctgcctaataaggggccgcccccaatagttttccctcgacttaggtaatgaattgcagatcgaaatgggtctagttttattcattcttctactcggggcgataaaggtttattgaatggtgtacatggtgagtgtgaaaaccagatgccagctgcccccagccccagtccacttcagtccagctccccggggctttcccgccccctcctcgtacccagcaccgcgggcctctcaaggttcccagtctttgggctaggggaggggagcaaggctcagttcaagtccaggtttctaagggattcaggaaagtggacaaggacgaggtgaggtgggaggatcagggaagcctcctccccgcgggtcgcccgggtcgtggcgggggatgggctcacgggtattatcagggagcagcctggcccatgtccttacctggactgcgcctgccccacagcgcgtgttaggaatgcagagtattggggctccatggccctaaaggagctgcattggtaggatgcactttaagcagcttcccaagggattcggctgcggggtccacggtctacactgggcaggactgcgtctctgctctcctcccggccagcacagttgaggtgaggggccggaattagtcggggaagctgtgccagacgtcccgaggggacaacgggacgaggggataacagcagccaggacccttcagcagggctgggcgcgctccaggcccggggcagggcggcgggagctggtgcaccgccgtcgccggcccgcagggggagctcgcaggctgcttcccggctcgcccaccctcctccccacgtggaagggggctgggacccaaggaatgcggcccgccccgaggctgacgtacgcgtctgcggccagcccggactctttaaaagccggcggtgcgcggggcatcccagccaagccggagaggaggcgagcggcagggcctggtggcgagagcgcggctgtcactgcgcccgagcatcccagagctttccgagcggacgagccggccgtgccgggcatccccagcctcgctaccctcgcagcacacgtcgagccccgcacaggcgagggtccggaacttagcccaaagcacgtttcccctggcagcgcaggaaacgcccggccgcgcgccggcgcacgcccccctctcctcctttgttccgggggtcggcggccgctctcctgccagcgtcgggatctcggccccgggaggcgggccgtcgggcgcagccgcgaagatgccgttggaactgacgcagagccgagtgcagaagatctgggtgcccgtggaccacaggccctcgttgcccagatgtgagtgcagctgcgcggagccgggttgcagggcgggctgcgccgggccgggccattgtgtggggcggctttgtgccgacgcccctctgcggggggcgcgcccgtgcgggtcgcgccggcggggcggggcggaggcgcgggctgcgcgtccttggccgggcggcgggggcgctgtggcccttgtcccggtggctgccccgccggcccggaaacggcgagtgcgcccggccgggctgcgtaccccgagacggagggacgcgcgcgcctgggcaggccagggaggggatccacatcctccgcgatccctgtcctcgacacccgtctcgggcggccgtcgccggagcgcagcccagggacccggccgctcgcgcctccgccccttttcaccgtccggatctcctctctctgcatgtttccatctcctctcccgccttgctatgcattcctatcccctcgcttcacttaataacctatttctctgtcctgttttctctttcgatatatatgtctctgtttttctctgtttctacctccttcctctcccactgtttctttctgcttttatctctttctctctccttctctctcttccgtgcatctccagtgccatgggggcgcccgtgctgggggcgccaggagagccacctggagccacgcctgtgtccccggctttggggagggtcggtgggttggtgagtgcacggttggcgctgctccacgcgccccgggcgcacgcactccccggtgctcggaattggctggcagtaccctgccccgccccgccggtcgccgcccccgccaccagcgatcgcttgggagagggttacctcgagctccacctcagctgcggagcgccgccgcggaaaagggcgggtgggcagcgcagaggggcgacgctgcctctccaggtaatgcgccccggctcccatgggctggacagggagccgcctggtgcggttttgcccaggtcaggtcgtagcctgagtagtgaccgtgggatccaggtgcaaactctcgaggtggcttcgggtcatccgaaggcgcctgagcgcaggcggctggcaggcagggttgcccggctactatgtttcttaggacggcccccgcgggacttggcagctctcctggagccctgctcggtctgaatcaccggcctcgtccagacctgcccctctccccacacccacccccatggtgtgccctgggtggggacgtcagcagatccaccctggtggacttcagggttctggggtagccctcaggagaggtcttgttccccctctttgtgaggtagcccaggactgggggatgtgggtgtgttgcccagcccagtcagatgcgcttgaactggggtggcccatggttctcttgtctttgtgtaaaacctgtaagtggagtggaatgcagctcttaaatccccagggaggtttggccaaggccaaatgcagaaacaacttttgcataaagcaagtattatctctatagcactttgtaaactgcattggaggctagtcccacatatgtaaatacatgtgattgtatacgaatgcccacgggtctgagaggagtgtcccgtgacttccagggctctgagatctgttggcatcagctcagttgtgatcttgagaactccagcgtgcaccaaggcgtcctccctccaggcttggatcctgatccattagaccccatcaacctgcacgtctcacacgcagtgagagatttgcctaagaatccctgtcagaatcattcagagctggagggtgggaatttggctaaagccaatggattaattcttttgtcccgcctactgctggtatcctcctgtgtggctttgaggtatagtctcagacacattccttcttgtaaaaagatccgcagcctgggtatcgcacatccttatttcaagtggtggtgtctttctcagtttatatagtcacatttaactcttactggaatggagggaagaaggtgtttctatttggtatctttcctgacaccctccctcgattctctaatggcatttgggacattgggtgggtttttctttcttccttttttttttttttttttttttttgacatggcgtttcactctgtcaccgaggctggagtgcagtggtgcgatctcggctcactgcaacttctgcctccgggtttcaagcgattctcgtgcctcagtctcccgagaagctgggattacaggcgcacgccgccatgcccagctaattttcatatttttagtaaagacggggtttcaccatgttggccaggctggtcttgaactcctgacctcaagtgatccgcccacctcagcctcccaaagtgctgggattataggcatgagccaccacgcccagctgggtgggttttctttctcctaaacttgttgccacctttataagtggccttctcattggaggtctgcagcagagttccctgaggtttattatttatttatttatttatttatttattcatttttgaggtggagtctcacactgtcacccaggctggagggcagtggtgcgaccatagctcactgtaaccaccaactcttgggctcaagtgatgctcccgcctcagcctgtccagtagccgggactataagtgtgcaccaccacacccggctaattaaaaaaaatttttttttttttttaattgatcattcttgggtgtttctcgcagagggggatttggcagggtcataggacaatagtggagggaaggtcagcagataaacaagtgaacaaaggtctctggttttcctaggcagagtgtttgtgtccctgggtacttgagattagggagtggtgatgactctcaacgagcatgctgccttcaagcatctgttcaacaaagcacatcttgcaccgcccttaatccatccaaccctgagtggacacagcacatgtttcagagagcacagggttgggggtaaggtcatagatcaacaggatcccaaggcataagaatttttcttagtacagaacaaaatgaaaagtctcccatgtctacttctttctacacagacacagcaaccatccgatttctcaatctttccccgcccctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcagggggctgacccccccacctccctcccggacggggtggctgccgggcggagacgctcctcacatcccagatggggcggcggggcagagacgctccccacatctcagacgatgggcggccgggcagagatgctcctcactgcctagatgggatggcggccaggaagaggcgctcctcactttccagactgggcagccaggcagaggggctcctcacatcccagacgatgggcggccaggcagagacactcctcactttccagactgggcagccaggcagaggggctcctcacatcccagacgatgggtggccaggcagagacgctcctcacttcccagacggggtggcggccgggcagaggctgcaatctcggcactttgggaggccaaggcaggcggctgggaggtggaagttgtagcgagccgagatcacgccactgcaccccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgcctcctgcaatcgcaggcactcggcaggctgaggcaggagaatcaggcagggaggttgcagtgagccgagatggcagcagtacagtccagctttggctcggcatcagagggagaccgtggggagagggagagggagagggagctggagcttaaaaaaattttttcatagagatggggtcttgctatgttgctcaggctgatctcgaactcctggcctcaagtgatcctcccaccttggcctcccaaagtgctgaggttacaggcatgtgctaccattcccagcctccctgaggtttattgctgaagagggtgtctaggacgctgctttttatagacaaagaacagtaaaacaacaaaacaaaaattactatatcaataagctgcattatattcttgccttggaggcaccttaacgggatgccctgttgctacatcaacatgatggtaaatgcttcttacaaaacctgtagcttccttcgcatgcatcctgtaactcctgctgacttactgaatttgtgagtcagcataatggtcaagaagtacctttttgactggcaaggtctagctttcctttctgttcatcgtcactaaaattcaagagcctgtgtgttctgagggatcctgggtaccgggctgagtcctaagatggtgcttgggacttggcattacatcagaagttgccatgatcagtggagcaaaggagggggtattagtactggtcaggccagtgcaggtttgtaagcaacaggtaaaagacagccttttaaagcaccaaactttgttttttgagacagggtctcactgtcacccaggctggagtgcaatggtgcaatcacgtctcattgaagccttgaactcctgggctcaagcaatcctgtctcagcctcctgagtagctgggactaggggcatgtgctactgcgcccagctaatttttaaaaatatttttgcacaaacggggtctctctatgttgcccaagctggtctcgaattcctggcctcaagcaatgcccccttggcctcccaaagtgctgggattacaggtgtaagccagggtacctggccttttttttttttttttttttttgcctcttaaaaacagtggaatgagacaaactgccagcttgtctttgctcaggatttagacaccatgggaaattgagtctgaagaaaggttgatgtggcactcaaatacggatagaaagactttcatctcagtagcgagttacgccggctgctggtgttctagcttaaggaagctgggtgggtgatgtcctagagaaatccctgccttatccctgggtagcccctacagtttatttactggggatgcattctgtgttagggtttgagtcagtgggggatacaggctgtgcgggctgctgcctgtctgtctgtgcattgcacaccatcagagaggttagtaacttaatctatccgggagagcaggagtaggaacccgggggtgccagcctctcactgtccaggtgggggattcaccatccatctggctgctgctttccataactggctccttgtgtcactgtatcccacggctgagtgttcaccagccagccttcagttttcttttggcttcctgtgtatgtttgcctgcagggaacgggccccagtaggcagtctccgttgtacactaatggtactgcgggcttgtagacagccagggcttagcccaaaggcactactcagccacattgaccctgtatcccccaagtagcctctgtctcacgggtacccagtgcatgtacctggtgcatgtgcccagtgagcgagcgtgtcatgaacgtagcaaccttgcagaattgaagttccgtgcctgggacttggtgactttctgggaggacttacccacgtggccatggttgtaaccatgacaacactttgagctcgagtcccccagattcaattcgggtgtttagtctgttacccagggtctttacacagttgttccttcccctgtaacccggtgacatctgtgttcccccaggcatgtttcagttgacctctaaagtccacatctaaacacatttaagtttcacaactttcaaaaactttaggtgtgtgaaaaagaagttaaaatattgaacatttacataaaatgaaatgagacacaaatactctttggaaaatcttgtgttaaactcaataattttttttttgtttttttgagacagagttttgctctgtttcccaggctggagtgcattggtacaatctcggctcactgcaacctctgcctcccaggttcaagcgattctcctacctcagcagatgggattacaggtgcctgctaccacgcctggctaatttttgtatttttagtatagacggggttttgccatgttgaccaggctggtttcgaactcctgacctcaggtggtctgccctcctctgctgcccaaagtgctgggagaccatgcccagccaatacttaccttttctttttttttttttttttttgagacggtgtctcactctgtcacccagactggagtgcagtggcgtgaccttggctcactgcaagctgcgcctcccaggttcacgccattctcctggcttagcctcctgagtagctgggactacaggcgcctgccatcacgcctggctaatgttttgtatttttaatagagatggggtttcgctgtggtctcgatctcctgacctcgtgatccgcccgcctcggcctcccaaagtgctgggattacaggcgtgagccaccgtgcccggcctaatacttatcttttctaatcactgtgccttgccagggagggtgatgaggcgggtggggggtgtctcttttttggtggtaaaaaggcccattgagaagagaagaagaaactgagggtcacagaattagaaacatgagatgtgctgtgagtttttaaaaggggctgaggttggagaataagacaaaaagatttagtaaggatttgtgattaccccatctgtccaagacagtggtgggtgtctgaagggagggacaggtgcaaacacctcaggcgcccctctctttgtttttttttgtttttttttgtttttttgttttttttttttttgagacgaagtttcgctctgtcacccaggctggagtgcagtggcgctatctcggctcactgcaagctccgcctcccgggttcacgccattctcctgcctcagcctcccgagtagctgggactacaggcgcccgccaacatggccggctaattttttgtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccatgttagccaggatagtcttgatagtgtttttaatagacggggtttcgccgtgttagccaggatagtcttgatctcctgacctcatgatccacccgcctcggcctcccagagggctgggattacaggcgtgagccaccgtgcccggtgcgcccctctcttgttctgcagtcaaatgctctacccctgagctatatccccagttatagcgcccctctctttgaatcttactatgcgacagagcagtgcatagggagaatggctctgctttgccaagaagggactggcagtttatttgggtttgaaatccagtctgaccttttgccctgtgtatttactctgctgtctttattgttattgttattttccctccctaaatgtctactgccagaggacatttgttcctatgattagtgggtagacataatcccctgttggataaatcaatcagcctctgcttccttggcgtggttccgacagaaatattctgcgtatgtgcacagctgagagtatgtgtgtgcgtctgtctctgcatatctgggtgctcttaggagcagcggtgcggtggggacacctggtaagaccaggagggacccttggcctaggggaagggtcagtggatgggtattgtttccaaggagttgctgctactttcctgatatggcagctacagctgccagaatgaccctgggcacggtggggtgtgcctcactggctttcggggaggccaccatctctccgtgtgcccctggggacacaagaaagcccctgggtgcttggtgctttgtgcttgtttgttccactcatgtgctcaggatgcccggctcaccctgggcagtgaaaagcatctgttttcgaggaactgtttgttctaggtcactggacatcaagagcatggcagcccagggcttttagcgtctcctcatctgctgatagcctgtctgtctccttactctgcctgctgagaaggccactaatggtctccaaatagcatggaggggacaaaggcccggcatgccatgcctgcttccctgcccccacctccaggcctagcggcagatcctggacattgacttcagtttggagccctgctgggggctccggcttacagaggggcttctttcctgagctgcggcccgtctgaggggtggtggctcccgcagcataagcctgctcagctcggacatcagggcctctgtccagtctgacatctgcctggttctgtgtgcggctttcagaggttttcctgcaggccatgtgggctgtgtctgggaatgatgaggacagccaggctaaccacgtggcagtgagtgctgggccgtgccgcccaggcgggagctggcgggtatcatctggccctggagcttgcatgtcggcaggatgcgggagttgcctgagactcccagggccaggcgacagccggggagatactgggccctcggctcccagaacagggggcttctggctgctttctgaaaaacccagcaaaaccccccttcctgctgttttgtcttactgagatgccaagaccgtcatgtagcagcggaagccaggagggagctggcaggcaagagcatctccaggtttcctggagacagtggtggagccggcccctggctgaggcttcgtgaccggcccttccctcggcagggccccagcattcatccgagcctggcaccagaagagggggtcagacagggcgtgagaggctcgggtggaggatttacctgtccactggggtaattttagcattctgcctccctgacctactttcatttgataaactcttttcttctaattattttttaatttatttgtttgtagaggcagggccttgctatgttgcccaggctggtctcaaactcatggtctcaagtgatcctcttgcctcggcctcccaaagggctgggatcacaggcatgaaccaccgcgcctggctgtaaactcctacttttaaaaattgcctttttaaagattttttttagaaactctgcccatacctctgtgtggaggtttggatattgatggtgggcctctctgtctcttgacccctgggccccagcccctgcccctctgtccccatgttgtattggaatccaccctcttgactcttagccccactctccctcgggagaggaatcctttcctcccacccgcaggagcatttccactttcactgtggtgtcagtcactggttccctgctaggtttagcgccctgggtatcagctcaggaatttggggttgggactgtctttgccaagtagaacctaaaggcaggactgagggacagggtgtggctggggggctgtggccactagggttgcctggtcccactgtggtacaatgccaggggcttcaggatggggagatgaaatgaaaatttcgatgaatgctgggtgtggtagctatgcctgtaatcccagcactctgggaggattgtttgagaccaggactttgagaccagcctgggcaacacagcgagaccccatctctacaaagataaaaaattagccagggatggtggtgtacacacttgtagtcccagctattggggaggctaaggccggaggattgtttaagtctagaggtttgaggctgcagtaatcatggtggccaccgtgctcccgcctgggcaacagagtgagaccctgtctcaaaaacatttttggtgaaattcttcagtgttattgttgggtgtggcctctgctcctcttctccggtcacttggttgatgacacacccttcttgcttgtttttccagcctgtgggccaaagctgaccaactcccccaccgtcatcgtcatggtgggcctccccgcccggggcaagacctacatctccaagaagctgactcgctacctcaactggattggcgtccccacaaaaggtgagactgggtctcgaggccggacccctgctcgtgcaaaaacttgaccttccatctcagttgctggtttcacaggcaggaccacccctgggcgcctctgtcccctggtcggggagtctgatcctgcctcccatgcagctgggtccccttcacactgtgtctacaccctttttcttctgttggggttttctcctcactggccattctctttcccactcctctaagtcctgccccgactcagatttcacctccttcaaagccatctccagccacctcagtcctttacattcctgtcgcactcagtcctagctaacattcctctgctgatagccctaagcactgcctaccgtagatcaagggtcttcaacccccaggctgtggactgctatgttgggtggcctgttaggaacctggctgcaggaggtgagtggcagtgagtgcgcattcctgcctgagctccgcctccagtctgatcagtggtggcattagattcccatgggagtgaaccctattgtgaactgggcatgtgatggatctaggttgtgtgctccttatgataatctaatgcctgatgatctgaggtggaacagtttcatcccaaagccgtacacccacaacctccctgtccgtggcaaaattgtcttccacgaaagtggtccctggtgccaaaaaggatggggactgctgttgtggatgacacatttaagaatctctgcttggtcttcccaactagatggggaacatcttgtggataggcactgggtattttttttttttcaattaattttattttagattcgggtacatgtgcatgtttgttacctgagtatattgcatattgattggggattgggcttctagtgaacctgttacccagacagtgaacattgtacccaactggttattttttaacccttgctcatctcccaccctcccctcttttgaaaggatggtttttatgtttaccatccccgctgtgcccagctcagtgcccaggaaccatgggacacatgtctccggccctggccctggcggctgcaccagcagaagggttgacctagatctggcggtgggcatgaggccccactcgctttctgataccattggtggaaatgtgttgtccctatttttgctagacttggggcctccccccacccatcctcacagtctcagtctctggtttaggatattgtgggactgagattgtagacttggctggaggggacagtgtcgcagagcatgcggcaggggcattgcagctggactggggaagccgggcagcctgtgccctgctgtcctcaggagttgagggtagcgtaggactgggcgccggcattgcttccacaccatctcattcaagtcggtgtggttggcctggtggctcttcctttggtcgatcctatggtcccggtgtgagctggccccttcctcctgctcgatcatccagactgttctctttcccgtccacagtgttcaacgtcggggagtatcgccgggaggctgtgaagcagtacagctcctacaacttcttccgccccgacaatgaggaagccatgaaagtccggaagtaaggctgggccgcgggcgtagggctgggctgtgggaataaggctgggccgcgggcataaggctgggctgcaggagtaaggctgggccgcgggcgtagggctgggctgtgggaataaggctgggctgcggggctgcgggtgtaaggctgggctgcgggcttgggcttgctttgttctgagccaggctctgtaggaggcagagaaagccggcctgcgggtgggtcctgctggtggcttcagggctgtgcagtgtgggaacaaggttgctgctctcatctgtcccctgagggtctcgctgagctgaccctcactgggacagagccgcagaagcaccctcactgagaattagcaagtcctgttcatcgggagtgtctgtttatgtttggaaaggatttcttgttaagtgcgagttgattgtgaaaccctagtgcaagggtgttcagccccggctgtatgctggagtctcctgggggatgctaaaatccctgatgccaggccccaccccagaccagttagtgcaactctgtgggtggctctgggcagccatttcttagcagctccccaggagtggttcccgcgtgcagcccggtgcgagcaccgcctcccgagggttcctgaggccacccgtgtggggccccaggttggaagcctctgggcctgaggggtgctggccagcctgcccagcgctaagcagtgtagaatggaaccaccagttactctgcttgtcggggcgtgtcgggagttgcttgggctgccccagcggatgcaccagcgctgacattcgggcaatgtcttgtgcattccaggcaatgtgccttagctgccttgagagatgtcaaaagctacctggcgaaagaagggggacaaattgcggtaagtccaggcaatgtagccggctcggtgtccagtcccacccatgagggtgtcctcaccggcctggggtgtaccgagacctgtgcctctggccctgagggtggaggaaagcaggtggccagggcagcccaatggctcaggaaggcggatgtggggcggactcagggacccaccccctctgtggccagtcccacacctccagggcgggcaggactcgagttacccacaggaccactggcccttccttgtacactgtcccattgcacattactgttttgcttgtttgcttttggggtatttcccccacgctaccacccctgagtgctgttggtagttgcgggaggcctgcctcctaagcactccctggagaggactgtgggcaggcacaagctcccctgaagcacttttggggcttattcctggagatgatgggtctggcatctttgctgttctggtaaacgttgttaaactcaaacttagagttttcttcctggccctttgctctccatatcaggttttcgatgccaccaatactactagagagaggagacacatgatccttcattttgccaaagaaaatgactttaaggtgagctgagcgtcttgtgttgtgctagagggctcgggagagaggaaaaggcctcaggaagcggcctgagtcctgcttggtccttcccctcctgctgccatgttccttagtcctgctcggtccctcccctcctgctgcccacgttttgtggccttaaatttgggcctttgtgtggtagggctcttgggggccgtggggcgttccagaggctgcagtgaggaggtgggctttcctgtgtttgggagttggtgggtggcgtgcttccgccttgtccgggtgatgacatcgcagtgatggcaaggttgatccttcgtggtgtttgttttctaacatccccacctcacttccaccaggcgtttttcatcgagtcggtgtgcgacgaccctacagttgtggcctccaatatcatggtaagacagccgggagccccgtgcttctgcggcagcgtagaccacaagggcatttgcagtctgaggaagtgggggaccgggtccggctcggaagcgcagctgagcccttaggatgagcagcccccagctggctgttgattgggaggtcagacctacagagcggtttttaacccagaggcctgtcctgtgagggactagctccatccagggcagtgggcaggcttggatgggacgtaggaaataattcagggagataggattagtttctgttggtggcaggagcctgacagctagtggtgatggagctgctggggcagagggccgctcactgcccctaatgggacaggtggcagcaagtggatcacttgctgtgacagctccaggaggtaagaatgcttgggcattggcaaaagtccatagggctcagcagcctcctgagtttgggaggtaagactctcctcctgctgatgcatctcgtgaacctgccacaaaccctcctgtctgtgctgtgcaggggagcttgcccagataaattgagggcacttggcatcataacttgatgaatttctccagtgttaccacttgatagcaatatatataaacaggaatggttactatggagacttactacaagctgccaccctgtgttggagataatttcctcttcagcttaaacatatcagaatatgacaattctataaagaaaagcagttctgaaaacttaacactgggacgctgtggtgctggcatctttgcacctttagaggggatgctaagcatgtgttagccccgttatcttccccaaggtggtggaagtatttctagatatctttaggaaatgaattcctgtttcaggaagggctatttgaattgtgaaaagtcagtttagatttgtccagtgggagcaggaggctcagagtatgagggtttgccacctttctttggctgggcactccttgttccccttggtagacagcagggtgcagctgtgaagtcatttttcccagtgagtggtcaccaatgtgcttagcaaggagtttagcatttgtctggttgtccactagcagatagtcatttgccccaacccaccatgttcagaaatctctttctgatgaaatctcaaagcagcttggtagagccaggcatttgtgaacttagatttttttttttaaattgtggcaaaatatacataatgtaaaatttaccatcttaatcatttttattatttatttatttatttatttatttatttattgaaacggactctccttctgttgcccaggctggaatgcagtgacacggtcttggctcactgcaacctctgcctcccaggttcaagcgattctcctgcctcagcctcccgaatagctgggattacaggtgtgcgccaccacgcccagctaattttttttgtatttttagaggagacgggggtttcactgtgttggccaggctggtctcaaactcctgacctcaagtgatctgcttgccttggcctcccaaagtgctgggattacaggcgtgagccactgcatccggccattttagctattttttaagtgtgcagtacagcagcaaattatattcccattgttgggcaaccgccacactctatccgcaggactttctcatcttccccggctgaaactgtgccaggacacaggcacagctcccgactgactcgatctttgaagagtggctgcctctcagtgacggcagtggttgatgagaaaaagagcccaggcattcagaaatgctgagtttccctaaaatccacctggtttctggggcctgtgccactgtgggtgttggtagacctgtgttgttgcctaggagagcgagccctgcaaaggagccggcacagccctagttggagaagcagttaaccacggactggtcacactggggctgcctcaggcagtggggggtggaggagaaaccacacaaggccagaggcatctctgggaactcctgagcataccttagaaccagcagcctcctcccggcacggggagcattgcggatcctcacgtggagctcggttgagttcagcgccaggctgtctggcggtgactcgggcacgggacagatcctgacttgctggagcattcagaggtgttcattatggaatccctgtgggtttcctgtctctgtccttccggcttcagttctccatctccccagggaatcctccccatgtaacatcaggctgtgactcagcccccagcatctttctccctttctcttacacgctgggccggataatctttatactgagccttctgtgcgctccccttttgaaagccccaaatcctgcttaatctcagcagaaagccttccagcgtgatttatcagccacccctttgtggtgttgcaggaagttaaaatctccagcccggattacaaagactgcaactcggcagaagccatggacgacttcatgaagaggatcagttgctatgaagccagctaccagcccctcgaccccgacaaatgcgacaggtgattcccgtggctggccgtctctgcaagacccacatgagggttctcactgaattcttgatgttcccacaaaggatttgctcctggatacctttaaaaaaatttttttaagacagttttttttgtagagatgaggtctcgctatgttgcccgggctggtcttgagctcctggcctcaggtgatccacatacagccgctggatacctttatcaactctctttgaaaatatcttttaaaaacaatccttgatgacaaatcatattcagtgggaatattttgaacactgtgtagaagtacaggaagtcaacatagagttgagcctgattttgctactgtccctccgatagttcctttcttttttctttcctttctttccatttatttatttatttatttacttacttacttgcttgcctgcttgcttagagacagggtctccctttgtctcccaggctggagtgcagtggcatgatcatagctcactgcaggttcaaacttctgggctcaagtaatcctaccgcctcagcctcatgagtagctgggactacaggtgtgggtgtccacgcccagctaattttttttttctttagtagagatgaggtcttgctatgttgcccaggctggtcttgaacttctagactcaagcaatcctcttgcctcggcctcccaaagtgctgggattacaggcatgagccactgcacaggcccctttctttttttctccattttctttcttttttctcccccttttctgggaggcaggccagcctcacagccagacaccagctgtgggagttgtcttacgcatatgctctgccccttagaaggattcagtctgtgccctggaggggcctacggtcccgccttgctgttctctggggatcacatcttcggagacgggccaggtgcatcctgctgtgggtggtggcctgagctgtggttctcggtggggtctctctgcagggacttgtcgctgatcaaggtgattgacgtgggccggaggttcctggtgaaccgggtgcaggaccacatccagagccgcatcgtgtactacctgatgaacatccacgtgcagccgcgtaccatctacctgtgccggcacggcgagaacgagcacaacctccagggccgcatcgggggcgactcaggcctgtccagccggggcaagaaggtgcggggtgtgctgccgcatgggccgttctggctgtagggcggttgcagggtctatagggtgggtggggagctgtgtgctgctgctgctgctgctgctgctgcttggtgtgcttgctgtgtgtgttatctgtgtgtgcgcctgcacgtctctatgcatatctgtgtgcatctctgtatggctctgtgtgtgtgtgtgtctacgcctatccatgtggctttgtgtgtgtgtgtctttgtgttactttgtatgtgtttgtatgtgtgtctctggtgtgtgtatctctgtgcatgtgtgtgatgtgtgcgcggttgtgcactaggaagggaaggggcaggaagagctgagcctggtctctgggtagggtgtgtgcggctgtggctgtcccagtggcctggggcccccacggtgtaaccaggtagtgcacagccctacgtgggctgcctgctccagccctggctcttggaggagctgcgggcatctggaatcagtggtccccctccaccacctctcagtttgccagtgctctgagcaagttcgtggaggagcagaacctgaaggacctgcgcgtgtggaccagccagctgaagagcaccatccagacggccgaggcgctgcggctgccctacgagcagtggaaggcgctcaatgagatcgacgcggtgagtcctgggaggcgggcaggcagcctcaccctcgggcatggggcggcttcccaagaggccctagacacccctgtggtttgttcccctgagtgaccactgggtccccgcagggcgtctgtgaggagctgacctacgaggagatcagggacacctaccctgaggagtatgcgctgcgggagcaggacaagtactattaccgctaccccaccggggaggtgagcgcaggctggggcgggctgacggtccccagcacacatgaccactgctgtgcagggctgggccacccctccagggagttcacttccgtgtgggttctgggggctcctacaccctccaccttggaactgagtccccccaaactgaaccttctaacagcctggggtgaagtgcattttcccataagcagaagtgagatgtgtttccctagggacatagaactatatgggagaggaggaaggtggtgtgtgaaggtccactgggcagggtggtgggcaggctggcaggaggggtggctctatatcccctgggcagcgtctgtgcttccccgtgcacggtgcccgggtggctgtggctgaggacgctgttgcctcctctgccgatgggatcctcctgggcccggtgtgtcctccctgcccgtgccctgctgagcagtgtcgtgcctcaggcccctgcaggcccactgtcctctggcctcagactgagccttacacaccggggccctggttagcacagcagagagcccacaggagcaggagcttttctggtctttttctaaagtcacagccctcctgcttctttttacatttttaaattgatagaaaatacacataacctaaaattgaccactttcatcacgttaaagttatgatttagtgcatgttagtgtactcacagtgctgtgcagccatcaccacaaattccaggcctttccctcactgcacaaagaaacccagacctgttaggagccgctcccgcctgcccggcccagccccggcaccggcccgtctgcttcctgcatctggatctgcctattctgggcattccatgtcagtggagtcagatgccacacgtgccttttgcgcccagttctttcacacagcattgagttttccaggttcccccgtgtgggagcggagtggggagggcttcactctttttgtggctgagcaatagtccacgttaaaccctgctccttctcaaccactgctgatgatggatgattgattttgcgtggctctctggccggtctgatgcagtctgtggccagcggcagagcccctcccgagtgccctgagctcacgtgggcccggccctctgtgctcagtcctaccaggacctggtccagcgcttggagccagtgatcatggagctggagcggcaggagaatgtgctggtcatctgccaccaggccgtcctgcgctgcctgcttgcctacttcctggataagagtgcaggtacctcgggcaggtcgtggccccgggatggagggaggaggggactggcactcggcggggggtcagccgcagacctgccgtggcctgccctgtgttggctgctgtgccatggggtgttaggagaagggcacaggtgtcggctcccggctgcttcaggtcctctctgtccagcgcttccttgaagcccttgggaaatgctgtggagcccaggttgatgccggggacttcattgcttcataaacagctccctgagacccgcccctggctccacacatcccagggtcttggcttggggtgggggctgcacttctcttcagtgccctctaaggaacaaacagcccggaaaactctgacaatcccattgaaatgttaagtcttagcatgtccagtccagtgcagctgaatccctagacagacctaaattgtttgggagtgactttttcccaactctaagtcaccgtgagggcgagtcttttggtttggtttgatggcactctttgggctaaagtcttcttctggggccagctgctgcccgggacagcttgtggctggggacagatgcccctgcccgacagggcttccgagggtccttgttggggggaccgtaaaggtctttccatgcctcccccaccctcatgtctcatttcttttttttgagacaaagttttgctcttcttgcgcaggctgcagtgcaatgcatgcactcactgcaacctccacctcccaggttcaagcgattctcctgcctcagcctcctgagtagctgggattatacgcatgtgctaccacaccctggctaattttgtatttttagtagagatggggttttgccatgttggtcaggctggtcttgaactcctgacctcaggtgatccacctgcctcggcctcccaaagtgctgggattacaggcgtgagccaccacgcctggccgtgtctcatttctaactgtgggtgtacaatttcaatttcagaggagatgccctacctgaaatgccctcttcacaccgtcctgaaactgacgcctgtcgcttatggtgagtagcaacccctgccaagccctgtccccctgaaggtggccacagtagcttcttgtggccgtgggctgtaagcggtgctgtccctttaacagcagcttcctctgcccccatcccacgccctccaggctgccgtgtggaatccatctacctgaacgtggagtccgtctgcacacaccgggagaggtcagaggtgagtggaggccccaagcctcatcctggccatcatcacacgatagccctagtgggtgatgggcgctcaggaggccccggggccgcttgcctgcaggtgctggcctgtctggggccatgggcctgctggctgccttcctcagcacctctttgttcctgcctgtctgttctgtggcttctggggccttctcattttctttcttcctgtgtcctcttcctcccatttctgctgagctcgagatatgaatattagtgaggaagatacattctctctttttttttatttgagacagggtctcagtctgttccccaggctggagtgcggtggcgcagtcacggctcactgcagcctcaacctcctgggttcaagtgatcctcccgcctcagcctcccgcgtagctgagactacaggtgcgcaccaccatgcccagctaattttaatttattcatttttttagataatggggtctcactgtgttgcccaggctggtcttggaactcctgggctcaagtgatcctcctgccttagtctcccaaagtgctaggataaaggtgtgagccgttgtgcccagcgtctcttctctttaacatcagcatggcacagttcttgttgcctttcctttctggcagctaaaaccagtgctttcagtttccagagttactgtttcaaacaggatcagcaggtcagcgccgccatgtgcttgtgattaggctcagaaccaccaagaacacggtgttgagagacgggaggcgtggagagcagaggcctggggggtggcgggtggggaggcgcttcaggagacctcgaggcctggccgtgcagctgctgtctaccttggggggaggcctgacatttggaggtgggccaggctgcctctgactgagtagagtgggcctctgctcaggtggacgcgtgttgtgaaagtgagtttgaattcaccgtgtacaggctgccaaaagtacaacactgtgctagtactagtcagacctttctcttagaccgagcgtgactttctgtcatggcgttcccgaaacaggtgactgtctagtcccaggaagcttggccttcggattttggcatgaagggatgaggtgtccgccccagtcgctggcagttgcctggctggtgggctgacctgagagaggctggggtcccttggccgccttggtccctgtcaccccctccacttcggaatgtgggtcaccggatgctgtcctgcctttagccatatgacaacagccctggtcagggagccactgcccccgctatgggattgggcctgagccggtcctggagctcttccctgcagggaatgggggcagggccatgatggagacagatcccggttctgaggctggaggcccacaccccatcacgctgtccctctcatgggagggctgtgtctggtcctggccgcagaacctgcttcctgctgcacattttctgcgcctttggtctccaggcttgttttgcagcctccgtgccccatcctaagccagggtgccctttgtgtagtagagatggctcttcagatcctgcctcgggtcagcggaagggagtcagcacagttgccttcccctccccagcctgtgagcctcaggcccagcctctccctcctagatgcccctcctcagctctcaagagaggctggaagcaaagctcttttctccgacctcacgctctgctgtgatcatcattctttccctccttgctttgcaagcaccgtgtttgtctgtgtggggaatcctttggtaccatccgaggaagggggcatgggagggaattgcccccattcttgctgcctggcagtcaccgcacactcagcagcccatggtccctggcccgtggtcccggccactcccctcggtcagtctttttgcctctctaaaatccaggagcagagaaacttttttggggctaattttcctccccttctttgtaactgtcgcctttctctcttttgtctttgtcttgcttaggatgcaaagaagggacctaacccgctcatgagacgcaatagtgtcaccccgctagccagccccgaacccaccaaaaagcctcgcatcaacagctttgaggagcatgtggcctccacctcggccgccctgcccagctgcctgcccccggaggtgcccacgcagctgcctggacaagtcagtgcactcccctttccttcctgcctgggggacgcatgccgggcgtgatgccacagatctgggattgcgtgcgtgtgtgtttgcaagaatacgtgcgtgggtgcgtgtgggtgcgcgtgcgtatgttgtaggtgtctgtgcacgtgtgttgtgggggcatgtgcacacactcacgtgttgagggagaacataggaagcaccctccgaagttaagatcctgggggctttccttgctggtgacaaccgtgactgcgttcgcctcctttctgaggatggggtctttacagggcagaagcaggcagtgcagaaggaagagtgagatgtccaagacccgttcacgttcgtgaatggttatttctaaaacaaagaaagtggctactttctcacataaataacatggttatcccagcaggtagtaaaaaacctaacaaacaaggccaggcgcggtggctcacgcctgtaatcccagcgctttgggaggccgaggtgggcggatcacctgaggacaagagttccagaccagcctggccaacatggcgaaaccctgtctttactaaaaatacagaaattagccaggtgtggaggcgggcgcctgtaatcccagcttctcaggaggctgaggcaggagaattgcttgaacccaggaggcggaggttgcagtgagccgagatggtgccactgcactccagcctgggtgacagagggagactccgtctcaaaaaaaaaaagcaaaaaaccccaacccgatttcacttatttcattaattttgaaggttacaggcctggaagattttggttgtcagacattaagatttgttttcagaaaactgtttgttttcagaaaactggtcttttcctttacagcctggaacccttgcaaatatgtgagatgtaggaatttctgtgcttaaattcaggtaccacccaagggtctgccctacctccaccctccaggcctgcccccacaaatcagcccagtgcagcttccggtcaggtttgttgatgagccggatgctggtgctggctctgagcatccttttcagcctgccacctcttcccgccttttccgagacttccttagacctcatgatgtctggaatgtgacctgggagatgctgcagcctccacaggtcacttaacctctccaggcctcagttttttcatccaggcaatgggggaataatggcagtgcagaagtcagatcagatgaggggattcatgccctgcatcaggcccagtgtcgggcatgtggtggggacgcgtagacacggtgaggtggctgtgattagcggaagcctggaggcctggctttggtggtagctccacactaacatgagtgcagcaatttaattgcccaggttccttcccctcccaggccctcagtctccttagctttgcacatgataggagcaggactgggagagctctcatacatattcccttgcaggtctcagatctgagggtttttatgaaaagccagcagaactgaaatggtgtccctgtggcatccgttctgatggaaatgtgcagttgtatttggaagttcagaggccgctgctttgatgcttggggggaccaggctggggaagggggttgatatcctgagctgcacagacctccgtcgtggaggacgcagtggcaggggctgcatcctcctgtccgcttcagagctgcccctggcgttgggaggacagtccttcagggtggccaggttcttagggacgtctgaagctgctggctgggccggcgtggggtttttcagggcttcgtccctgcagattgcgccctgcctcctgactgacttctctctctgcttctcctccgcagcctttgctagggcaagcctgtctgtaagtatctctccgatcatcgctgctgcttgcactgctttcttcctgcttgctcatttggcctcctgcctgttaaaatattgaggatgagagcagttttgtgatgtgaggtcttccgtgggggaaggaggagatgggcgtaggagtagggaggagagattcctgaatgtttttggaaaagcgtgcaggcggtcatggtggctgcactactgttgggtgtgttccgacaccgccgcacgaccgctggcttctcccctaccctctcagggctgcaggtcgtggtttgtaatggccgtggtttagggctcggcataaatccacatttccttatcagaatcagatcttggtggcgagctgcatctgtgccaggtgccattagccttaaagccccctcctgccccaggagtgtcctttgttttggaaggaaaacttactcagagcctaatctgtaaaccaaacctatggggaatagtgggagtgtggtggggcctgagctctgagcctctccctccccatgaggaccccccacaccccaaaagagctccaagtggagacccttggggatccgtttgtcctgggttggagcctgctcagcgtcatagtcacgcccggggctgggtgcagcctccatctctaacccatgtggtcacttctgctcctcccagagctctctgcagagtttcaggttcagccttagctctggcagccactgggtagctggggctgtgttcccactgctctgggatcccttccccaccaggagcagaggccttcctgccacagaactttaatgacagccacatgaagtgtcatccccttgcccccccaaaaacacacccgcccctttatttcctgtttgctccttaagttaccttaactactttatgcagaaactggaaaggtgtgatgaggaatgcagcctgagatgctgaaaagaatgactggctttggaaatgggagaggtttggcatggcgctcagattttggtggcaaaggggtgaagggccagaggatgtaccagtgtcctccatgtccacgttccttaagaccaccctgggaggtcggcagggcagtcagtcccccgtttaatggttgaggggctgagtgaccggcccgtgcttccagcaggtgagccgcagagccggggcctgaaaggccccttgcttcagaaagccggccgcctcctctctgcggcttctgggagtgggctgggtgcccgttccctgctgctgtcctgaggcccctgccctgtgacccgcaaggcatgggcagctgttggaccctcgtgtacccccacagccacccccttgcagctgcttcccacagccaggctttgcttacctaaggtgggcctgcccttaacttccagcttcttggggcgcaccctccatcctcagggccagtgtctgtgatgcgcggggccagcgtgcagtgcttcaggatctgggcttctccttgtgtgaaactttttggacttggagcctgaaggttttacatctgtgcatgtcctgatcctttagaccagcagtccccgacctttttggtaccagggacccgtttcgtggaagagaattttccccaccatggcagggtaggggatggtttggggataaaactgttctgcctcagatcgtctggcattagattctctgaagggaacgcacagcctagatccctcgtgtgtgctcctccgagtcaggtggtaatgttggcccacccaccacccacctcctgctgtgtggcccgcctctcagtgggctatggactgggtactggtccacagcccaggggttagggacccctgcgttagacacgtggcctcatgttgccaggaaagaaatctttctactgggaggagccattcggggatagtcccccacccgctaaagctgatcttacctatctccaagatgaacataatagtgcgtttgctagaatccctcctgttcagcaaaaatacatccgatggacccatcacacctgactcaggttggaatttcactctggagtcccattgtcccgtccatcctgggtgcgtgaccccacatctaggattgtagccacatctgattctaggagtccacctgggctctgtgaccagaatttatgatgaaagtcagaccaagccaggcctgcatcttggttctactcctcctggcctctatccttggcactctgggcaagttaaagcaattctaggacctcagcttcctcatctgtaatatggagataataacttcataaagttgtcataatgagactatagatacagcacttagcacaatatctggcccctaggaagtgcgtgggggatgacggctgctgttgttatcagggaggaacttggtgccctgggcctgtggagacttctgggcttgctggcattgggtcagcctttggataccctcctgtaacctgagggatttcttctctggggcagcaggaacacccagacttggggaggggaaatccctggggtctcaaggccatggcctgaagtctttttttttttttgagatggaattctgctcttgttgcccaggctggagtgcagtggcgcgatcttggctcactgcaacctccttctcccgggttcaagcgattctcctgcctcaacctcccgagtagctgggattacaggcgcccgccaccatgcccggctaatgtttgtatttttagtagagatggggtttcaccatgttggccaggctcgtctcaaactcctgacctcaggtgatccacccgccttggcctcccaaagtgctgggattacagatgtgagccaccacgcccagcctagagtcttcacccctgtgatcttggtttcccagtaagatggggacgaacaactgtccggacctggtgctctggggtgccttcctgggggctgtgccggctgcttgggatcgagagatcacctggcatttgtgatgcaaccttcatttttaaaatttcaaatgcacactagaaaatcctactaaagattttcttttttttttttccttttccaacctgtttcttcctctcccccactctgcttgaaagacgaactgtctgtcacattttctcaaagttttctccttactaactgtggaaggtaaatgcctgggtgcatgtccctctgtcccgcaccgcgtcacggcatctgggtctgtgtgcagactggccatcgtgcaatgcggggctcatctgtctccatgccgaggttgttaagtgcaacaccattgtcgtgaggtcctttctagtctgtctctcaccccccacgtgtcctgagctggggcccctgggtgaaggacgtggacatcacccggtcttgcaggctctccactgttattgttgcatcgccatcacctgtgggtgccggaagctgtgggctggtggtgttgaggacaggttggagccagcagatgcggagggaaatgtcagccctgctctgtgatcccacagcccggctggggctctccctagatatgaggacccagggctctctgaagagaattgccccctcccagtgggcacccatcacttccatcatccttcggcgggcacccatcaacccccgcaggcagccgtcatcccctggcaggcacctatcacctcctggtgggcactcatcacctcccggtgggcacccatcacctcctggcgggcacccatcacctctcggcgggcacccatcacctcccggtgggcacccatcacctgggttcctgagtctggcccacgcctgggcgatagctctgatgctgcccagccccgtgactttcctccctgtggatggctccagccttggacccccagttctgtgtggggtgggcatgggccacggtggccctgtgtgcctgggctctctcccaccctctttagagcagtccaggtggagacactcaggactggagagaatagttttaaacattgtgtgttttcttgttttttgaggcgtaggtgaagcaggtcacggaaggaggcccgctgtgcagtggctgcagtcagttgtgttcctcgctgattttggagcatgtttttttgcggggggtgggtggcgggggggtttggtactggccagtgccttaggggtggaactccctgcgagggccactgtgatcagaagtggggcagggctttaacaacacccctctgcctggctccccacctgggcctccccaccacgtccagccattccatgtatcacctgtgttctgcctgtcaagctctgttcccagaatctggatgcaggagctgggagtgtggctctgttttgagctgagtcgagaggaggggccctgtgtgtccttggaggccccgggctcatcctctgcctggctgtggtttgtgggatttctatggggtcgtgagcatgaggctcctgtagttactggtgcccagcgccgcgcagctcacggtcctccaggagccacacggcccccaccaggcgggctccaggcctggtgcccagccccttctctgagactctggggttatcttgcgtcatgttctgaggcccacctgggctctctcccgcctgtgaggttggcagcacctttcttggatcatgttctttgtctgggatggagggagggaagaattctccgttgcatggctcgcgtcttctgctttagaattcagccagctacaaatcctaactccctccccacctctcttttctcctgaaaacagaacatgaaaggctcccggagcagcgctgactcctccaggaaacactgaggcagacgtgtcggttccattccatttccatttctgcagcttagcttgtgtcctgccctccgcccgaggcaaaacgtatcctgaggacttcttccggagagggtggggtggagcagcgggggagccttggccgaagagaaccatgcttggcaccgtctgtgtcccctcggccgctggacaccagaaagccacgtgggtccctggcgccctgcctttagccgtggggcccccacctccactctctgggtttcctaggaatgtccagcctcggagaccttcacaaagccttgggagggtgatgagtgctggtcctgacaagaggccgctggggacactgtgctgttttgtttcgtttctgtgatctcccggcacgtttggagctgggaagaccacactggtggcagaatcctaaaattaaaggaggcaggctcctagttgctgaaagttaaggaatgtgtaaaacctccacgtgactgtttggtgcatcttgacctgggaagacgcctcatgggaacgaacttggacaggtgttgggttgaggcctcttctgcaggaagtccctgagctgagacgcaagttggctgggtggtccgcaccctggctctcctgcaggtccacacaccttccaggcctgtggcctgcctccaaagatgtgcaagggcaggctggctgcacggggagagggaagtattttgccgaaatatgagaactggggcctcctgctcccagggagctccagggcccctctctcctcccacctggacttggggggaactgagaaacactttcctggagctgctggcttttgcacttttttgatggcagaagtgtgacctgagagtcccaccttctcttcaggaacgtagatgttggggtgtcttgccctggggggcttggaacctctgaaggtggggagcggaacacctggcatccttccccagcacttgcattaccgtccctgctcttcccaggtggggacagtggcccaagcaaggcctcactcgcagccacttcttcaagagctgcctgcacactgtcttggagcatctgccttgtgcctggcactctgccggtgccttgggaaggtcggaagagtggactttgtcctggccttcccttcatggcgtctatgacacttttgtggtgatggaaagcatgggacctgtcgtctcagcctgttggtttctcctcattgcctcaaaccctggggtaggtgggacggggggtctcgtgcccagatgaaaccatttggaaactcggcagcagagtttgtccaaatgacccttttcaggatgtctcaaagcttgtgccaaaggtcacttttctttcctgccttctgctgtgagccctgagatcctcctcccagctcaagggacaggtcctgggtgagggtgggagatttagacacctgaaactgggcgtggagagaagagccgttgctgtttgttttttgggaagagcttttaaagaatgcatgtttttttcctggttggaattgagtaggaactgaggctgtgcttcaggtatggtacaatcaagtgggggattttcatgctgaaccattcaagccctccccgcccgttgcacccactttggctggcgtctgctggagaggatgtctctgtccgcattcccgtgcagctccaggctcgcgcagttttctctctctccctggatgttgagtctcatcagaatatgtgggtagggggtggacgtgcacgggtgcatgattgtgcttaacttggttgtatttttcgatttgacatggaaggcctgttgctttgctcttgagaatagtttctcgtgtccccctcgcaggcctcattctttgaacatcgactctgaagtttgatacagataggggcttgatagctgtggtcccctctcccctctgactacctaaaatcaatacctaaatacagaagccttggtctaacacgggacttttagtttgcgaagggcctagatagggagagaggtaacatgaatctggacagggagggagatactatagaaaggagaacactgcctactttgcaagccagtgacctgccttttgaggggacattggacgggggccgggggcgggggttgggtttgagctacagtcatgaacttttggcgtctactgattcctccaactctccaccccacaaaataacggggaccaatatttttaactttgcctatttgtttttgggtgagtttcccccctccttattctgtcctgagaccacgggcaaagctcttcattttgagagagaagaaaaactgtttggaaccacaccaatgatatttttctttgtaatacttgaaatttatttttttattattttgatagcagatgtgctatttatttatttaatatgtataaggagcctaaacaatagaaagctgtagagattgggtttcattgttaattggtttgggagcctcctatgtgtgacttatgacttctctgtgttctgtgtatttgtctgaattaatgacctgggatataaagctatgctagctttcaaacaggagatgcctttcagaaatttgtatattttgcagttgccagaccaataaaatacctggttgaaatacatggacgaagtaaacctctggtcttttcgtgggggaaagaagagtctttaattgatgtttacggcagatgcgccacggagctgccaactcaccacttcattatcttcctttcaacaggatgttcaagtacagagtgtctagtgcctgcatttggggagaatgagctgtctcaatttttcttctaattgataggcttcatgttttatttttatttttaatttaatttttttcttttttttctttttttttttttgagactgtttctcactctgtcgcccaggctggagtgcagtggcgcgatctcagctcactgcaacctcctcctaccaggttcaagcaattctcgtgccttagcctccctagtagctgggattacaggtgtgcaccaccatgcccagctaatttttgtatttttattagagacagcatttcaccatgttggccaggctgatcttgaactcctggcctcaggtgatctgcctgcgtcggcttcccaaagtgctgggattacaggcatgagccactgtgcctggccccacgtcggttttactcccttcattctataccccttccccgcgcccttttaaacaccagttcttgcctcattggcactacagaaggtatctttcatgttaggttcctttcacctgcccttccccatctcctggcttcttccatgtttctgcagggaataaaactcaagcttctgtgacttctttgccgctcattggctgccagaggttgagccggttatttcacttccagcctcagcgtctgcatctctgcagatggggcagggttcagggtggagcgtggcaaacaccatgcgtggaggaagccctggagtggttccttctgcagctggtatgcgtgaccagcgtcttgcttggtctgattttttttccggagccccccactgctgcgctccagaaatagccttgactccccagtgagtcttcatcccttaggcgcctgccgcccacgctgtgaagagaacaggcggcagagacttggcacctctgttgcgagatgactcccagggttgcgatctggctgcagcgtgacggggcagagcgttctggggaacctgaggccacctcctcaagctctgagccacgtttgatggcgtgagatgtgtcaggtgcagggatggagcagtggcgttgacggaaatctggcctagcctttcaggctgactacccagaaaattaaaagactgctcccaaagaggatgtctgtgtatcgtaaggtcctgggccggccgggctgtggggatccacaggggctctgaccttttgggccagctctgagattcatctgagagatgggctaggtccacagtcactgactaaatacagaagattcagtaaccgggtggatgctgtcggggagaggagggctggggccggagaggggtggacgttgtacacaccagtcgtttccattcgctgcctgggctcggttccttccacttctcactcccttagctccggccacactggcctcctgcaggtcttcgaacttgccaacgtgcacccaccgcagggccttcgagagtgccgctccctcccctgggaggtctccccagctatccggggttctccccgacacttcctccccatccccattcagttatcaaagcctatgccaaaaaggcctcccgtctcccgagtccctgcacacctttcgcagtgtgtgttgaatgccttgccctctgtctcctgaacctgggcctaagatcccggagagcagggcagctccctgtgccccgtcatcgtccatacggacctggcccgcagtgggctctgtcactaaatggataaccagtgctggggagaagacccagatgatgtgctggtgaagagtgaggcgttcattcagcttgcagaaggaggcttaggaaggctttatagaagaaaggaaatgtgagcaaagatgtcgttgaaagtaactttttttgaattaaaaatattgtattaacaaaaattcaaagccttctgtgagttt

SEQ ID NO: 12390 - DNA, 29614 bp, Human
aaaaagacaacccaatttaaaaacaggagatggattctcccaaaaaataaccaacaggcatatgaaaagatggtcactcaacatcaccaatgattacagaaaggcaaatcaaaaccataatgagacacctcttcatacacactagcatggctataataatttaaaacaagaaaatagcaagtgttgataaggacctggagaaactggaaccctcgggcactgttggtgagaatggaaatcggtgtgaccagtatggaacacagcttgatggttcctcaaaaaataaacatggacgccgggcgcagtggctcacgcctgtcatcccagcactttgggaggctgaggcaggtggatcacctgaggtcaggagttcaagaccagcctggccaacatggtaaaaccctgtctctacaaaaatacaaaaattagccaggcacagtggtgcacacttgtaatcctggctactcgggaggctgaggcaggagaatcgcttgaacccaggaggtggaggttgcagtgagccgagattgtgccattgtactccagcctggcaacagagcaagactccatctcaaaaaaaaaaaaaaaaaaaaattaaacatggagttaccacattaaccagcaatgccactcctgggtacacacccaagaaaagtgaaaagaggtgtccagacatactcggccatgaaggtgcacagcaggttactcacaagggctgaaaagcagaaacaaccaggtgtccatcaccgataaatgaggaaccaaaatgtggtctatccacacaatggcttattattcggccacaaaaagaaaccaagtacacgtgctctgacatgcctgaaaataccatgcaaagtgaaataagttagacacgaggccacaattgtgtgattccatttatatgaaatgtccagaacagggaaaacctattttagacaacagagacacaaagtcgatcagcagttgccaggggaggaggaagacgggaggggaaatgattgcttcacggggtgatgacagaatgttccagaacgtgacagaggtggtgcctacacaactttctggatgtactaaatgccgctgattgttcactttcaagtgattgatttttaggttatttgaatttcatctcaattaaaaaacccaaacacgcaaactgctcccgccagctcagccccgagcagacggcgcagcccgtggaggatgctgagccacccaggcttctccccgccccttcctggactcttctctcttttgcctttaatccactctgcgcagtcattgcctgtgttcatcctacctggccgacttctctctcaatatttccttggtgaaacatcctaagaggaagttacattagagaaaatcacatatttcatctcataggccgtaaacagggccatttaggaagccatgtgttaacgaggggagacggatgctctgtgccgtgtgcagggataacggtgccaggccaggcagttaccaatcacgcgtgtgtttagggctcaggaaagcgaaggagaagtgggcaagggtggcgggcccgctccgcaccgcccagcgctccggacttcacttctggtcccgctcctgggcggccacgaagttcagcaagtcaatggcggtgaccaccccgaacaccatctgccgctgactggacttcccggtgctgtggtctgaggggagaacgaggcagtgggtttgcaggtgccgtgggaggctgggtgggctgctgcggggcaggaggctcctgagggcctggggcacctgtgcaccatgggggcccagggtggctggagcccagcggcgaaggctgtgttcctttttttttttctgagacagggcctcactctgtcccctaggctggagtgcagtggtgcagtcttggctcactgcaacctccacctcctgggttcaagtgattctcgtgcctcagactcccgagtatctgggacttcaggtgcacatcaccacacccagctaatttttgtatttttagtagagatggggttttgccatgttggccaggctggccttgaactcctgacctcaagtgatccacttgcctcggctcccaaagtgctgggattacaggcgtgagccactgtgcctggccaagccagtgttcttctgacatgagccccatgagcccccaggccaggttctacccaccacgtgagtcccctgggccccaggccaggctccacccaccgcaggtcaggacacacccttccctggcccaccggctgagctcctgaggcactcatgacttcagagccggtgtgggcatgaaattcaaacccgcttacagggccgggcacagtggctcacacctgtgatcccagcgctgtgggaggccaaggtgggaggatcatttaagcccggaagtctgggaccagcctgggcaacatattgagaccctgtctctacagaatatttttaaaaataaattagtcgagcatggtggcacacgcttgtggtcccagctacttgggagactgaggcagaaggatcagttgagcacagcaggtcgaggctgcagcgagctatgatggcactactgcactccagtcggcaacagagcaagaccctgtctctaaaaacagacaaaaaccccttgccaccatgggcagcacacagcttccatctctggcctgattctgtcttcacccctcctgctttctcctggcaagcgtagacccggtgttaatgctggccgaggctcccatgccacatacccagacagggctgttgtgatggttaattttaatacagattaacggggccgtgggagcccaggcattggtcacacgtcgttctgggcatgtgtgaggggattccggattagcacaagagtcaagaggcagataacgtgtgctactgtggagggcctcacccaagcagttgaaggcctgaatagaaccaaaggtggaatttcctgccttggggcttgaactgctggctctccagtctccggcctgccgcctcaccctgcagatctcagggtttgtcagcctccgtgatctcatgatccagttccttaacacagatctcgttccctctctctccccgctccccacacatcctcttggtcctgcgtctccacaggaccctacaccagctgtcatgaggcacagaggggtgagcaaggtgcgggtgaggaagagccctcggagcccgtcccaactccgccacggctgtcactcctctctttgtaggcagaggtcccttggggtggcccacttagagccccaggaaaagatagggaacacagatgagatcagctccttgcattttggggaaacggaggcacagcaactgttggagaagggagccctgggagccctgagtgccgcaggcttctgtggccctggcagctcggcccagagtcaatggactagggccagccaggggactttccgacaagggccagctggtggtattttaggtcttgggggccgtgccgtctctgttatgagcacgcagccctgacgtgcttgaaagcagccacagacggtggtgacaagcgtggacatgctccaggaagacttgatttggggaccctgacattggaatttgcatctttttttttttctgagatgttcaaacacaagtaaatgtgagattaagagggggatccctcctacccaagcttgggggtgggtccaggaccctggaaggcctccatttgccatggggaggctgtgaatctgagcctgagagccattctgaggggtgggtgatacctacctgcaggcccccccaccacgcctgcccaggcctggtcctgcgctgcagagccaaggacgggagatggggttagacttggggccctcacggaccagcctcagccaccgagcgctcaccccctgcacacaggcctggtgggtgggcaggctccaggctccagggcccctcccaactcttcctgtgggccccaggcccagggctgccatctatgacccaaaacctgcgagcgactctcctggcctgtggggatgtggtggggacgcccggggatgcgctcaggagttgcaaaacctcatgagcttgctgggagcggggctctgaggacagcccatcagtggctcctgtgagacccacatgaggcttccattcagagcagccctccgaatgccagggtcaggacttgaaacccttctagatgtttctgggcttgtccctgagaatccccaagactgctggcctccccggaggcaaggggcctggactcctgagcctctgcatgctggacaaagggccctacccagtgtggcctgatgaggggtccctgcaggaatcacaggtacagcccaccagcccagggcatgtgggaggcccgggcataaagactgggtgtcactgaaggtcggcaccacccactcccctaacaccccgcaggggatggggggcccagctgctgcccatggcagaggccaggcttggtggcctgaccccagtgagaaccccacgcacagagcagggccccactcacactggatctgctcgtgcaccaccagggcgaagtggtccatctccaggatgtgcgagagcctgcccagcgtgtccgtgaggcggatctgcaagggaagcgtggtcagtggcagggggaacatggccccacgagttttctgtggagtgagaggggatgcgatggtgggtcctgcaaagcccacccgggaggcagtggcagccgaacgtgggaaatacgtggattcgggtgacgtctcgggtgtgtgtgtgagatgggaaagaagtcgaattcactcctaggtttgggcagaaccctcagcctttccagtgtcaagagccacacctgcatgtcccaggggatccgtgtggaaggtcacacaaactttcctgggccaccctcagggcagcagagggtgggtgtctcaggacaaccacggagtctgaccagcccggcaaggagccaccgtgggcttctcccagaatgttctagctcttgttggataaccaagtgcatgcacaggcaaatgaggctgggcaggagaaagaccccggcagacgccgcatggtgcccgggacagcctctgagcgcgaatgacctccttaagtccccaaaacacggctggtgtggatgagcctgcactgatgagagcctcctctccggctgctgcacttgtaaagtgggtgcttctcagcttcatggtttgaggggtgcagccagcttcggcctaagtggtgttgagggtcgaggacccagcacccccacacgggaagcgcggtgtcccgccttcgaggctggagtactctggcaccctctggggtcccgaagtgcctgagtacctgtttgagccgcgtgtaggtgactgcgcacctgtttgaactgcgtgtaggtgaccgcgcacctgtttgagctgcctgtagctgaccgggcacctgtttgagctgcctgtaggtgaccgcgcacctgtttgagctgcctgtaggtgactgggcacccgtttgagctgcctgtaggtgaccgcgcacccgtttgagctgcctgtaggtgaccgggcacccgtttgagctgcctgtaggtgaccgggcacccgtttgagctgcctgtaggtgactgggcacccgtttgagctgcctgtaggtgaccgcgcacccgcttgagctgcctgtagctgaccgcgcacctgtttgagctgcctgtaggtgaccgggtacctgtttgagctgcctgtaggtgaccgctcacctgtttgagctgcctgtaggtgaccgcgcacctgtttgagctgcgtgtaggtgaccgggcacctgtttgagctgcctgtaggtgactgcgcatctgtttgagctgcctgtaggtgactgggtacctgtttgaactgcttgtagatgactttgccaacttggtctgacggctgcaccttcccggcaagcagggacgagagcatgttcccaagcgtcaccattcccaggattaccctgtgggacgggggcaggcaggggtcagcgctcatacctcacccctcccaggacggtggggcacacgctcagctgccccagggaggagcgctctctggccacacatggaagtcctctgccacgagcctacacgcggcaggaaccagtctgggccctggtggggagaaagaaaccaagagtccttggacccgttcagccagggtcaagggtgaccagccgtcaggtttccgcgacgtggggctctcagtggtcactgggcatgtgtgccaaggctttctgctgtcagacatgtcctcggggcatctctcccctgacctccaggtgggcccaggacagcctgcacacaaagggtgggtgggctgaggtctgagggcctggagtgagcacggcagccctgccccaggctgctcagggaccggcaaggggcctccaatgccctgaacgtctgtatgaggcggcccaggcgggcctatcagcccagctgcagggtctgcatggctgccctgtccagtgacactgacggggtggagctgggcagacagaacccaggactgagctctgagcaggggctgagactgaccccgcctcatccaccacgggcgcctggtcgaagcccttctcccggaggatctcgatggtgtgcccacaggtgatggtcgggagcacggtcagcggggctgacaggcccagctcctgaacacggaggtgccaccacctgagggaagagggcaggtcggggggatcaggataaggacaaacgctctcgcacccccgccggcagcacctcagcaggaggccacagggaccgctctcctgcctgtcacactgggcagggccagcacaggccacggggaccgctctcctgcctgtcacactgggcagggccagcacaggccacgggggagtgctctcctgcctgtcacactgggcagggccagcacaggcagcgggtctccggccgagcggtcttaccagggcttcttctccgtgaggtcctcctccttcagaaagcccttctgcagcatccacctgtcgctcaggaacttggtcctgcgggatgggggagtcaccgagtccccgcagggccccaccgggcccccgcccctgctgagtggcacgcactgcctgcccagcccctctcctggacctcactggtgcagcagagacccccaagtgctggctggaagccccagggggaagcctgggggctggacttcccgcccccatggccaacaagcgtgtgtgagcatgcacacagccatcgctcaggcactcagataaacacgtcctctcatgctcgctctctgcccctcacacactcacacgcacaggtacacatggcaggctggccaagtatgtggggagatggtgttcttgcactgacgggggtgggcaggagccctgcacagggcatcttgaccctgggcaccagatgtgaatcaccccacactggggaacccaactgggggcacccaccagccaggcctggccctccaagggcagctgagctctcgggagctgtgtagccgctgcagcttgcaggccatggaggaaaccctgcaggtgcaggggacagggcatgggggtctgtagacacccgccctggtaccgcctccggagaccaggtgcagagcagcgccagtctcagcctggctgcccggtgaccagcgaggtctgtggcgttactgtccgaggggcctctgggcaaaacagtcacagcaagtcctagggggccacctgggcagcactcggtcccaatctggagtttgggggaagcagcagagggagtcagggtggataggaggtggcacagggcccggcccaagaggacgtcagtccatgtggccagggctacccgttggagctcacggaccccagagcagtgagggggacagacaccagagaggaagggacaggagggacagagagggagccaccgtctttcatgcccctcctgtcagggctgtcactgcgagtgtgcattgattttcacagcattaagaggctgggaagccccacagcgtgagggcacgtgggcaggagagtggaggcggtgctcacagggccccgctggcctcctcccctcccagttctggctgccggttctcaggtgaggcgtgagaggcatccagggaagggtggcaggatggagaggagcagggacctgggagggaagccgtgtcttacatgtagttccgcactgagtcgggcagaatgaccacgcagcgctggccctcctgcagctcctgcgcggccttcacggccaccgccaccgtgctgccagcactgccacctgcagagagggccacgagtcagacgcgccagggtgagcgtgcgtgggtgcacacgtatgcatgaattgtgcacgtgcacgcatgggagcatgtcagacacactccgaaggatccgtcaagaggggttgcctcggggagaggggctgggaggaccccacttctccgtgagcatcggcttcttccttgtgcaccatggagtttctgtgtccactcggggcttcataatgagctggggtgggcactggtgccagggaaatgcctgcagtggggctgcggcccctggcaaacctcctggccctgagcctagagccagcgatgctacgaggacggagcccccagcaccacgcctgcaggctgcctgactgcacactgggctctgctttataaacaagagaccaaggctcacagtgacaccagctgtccctaggagccctgaagtcagagtcagaggcgtcttctctgggcttagtttgagggtgcacacagcagtcgggaaggtctaagtctgcagtaggagcccccacaggaagagaggcaccctcctctgtaacggggcccatggacctgctttccagccccaaaggcaggggcttgtttctccaccaacatggggagcagggagactgagacagggagagcccaacgattatgggcaccaagtcacctttcgtgacagattcatctggaaaatgcttttcttttcttttttttttttttgagatggagtttttgctcttatcacccaggctggagtgcaatggcgtgatctcggctcactgcaacctccacctcccaggttcaagcaattctcttgcctcagcctcccgagtagctgggattacaggcatgcaccattacatcggctacttttttttttttttttggtatttttagtagagacggggtttctccctgttggccaggctggtcttgaactcctgacctcaggtgatccacccgcctcgacctcccaaagtgctgggattataggcatgagccaacgcgcctggctgggaaatggtttttcaatcaagactttcttccaatctctagtttggggctcagctaacgggggacttggccatgctgagggctggtttccttccactttccctgtcaccacccccaaagtgacatgacacacggaatgcacatgtagaaacctcacatgtccctgcctgcgttttagaagctggtgtgtgctctccgagtccccagaggtctagatcaactgtggtccctacagggcctctgctgcctgtgtggctagtcagtggcattgccagcggccacctggtctgtccacccccaagcaggtgggcagaggggcacggggtaggaggaaggtgagcggggtcgagctggacagcctcaggctccagtcccctccccagctgctccagggtgctcgcagcacccagtcccggccatgggccccgtcaatgcagagccaccgccccaggggccctggtggacttgattagaaacaataagtgccatgagagcttcagccttgttctagaaacacattctggaaggcagctcgaagccccgccccatggcctcctgccctcacctgagcaggtgaccacactgggcaggcagacaacacctgaggctcgtggccgccgcagtgacactcctcagaactgctgtcttacacatgcaggtcggtggctgactgagggtgcgcccccagccatccccagtgccccctagccatctctgccttccccatacccccgtgcccgccacccactcaccgcacagcagcccctcttgcgcgatcagcatgcgggcaaaggtgaacgcctcctcatcgttgctcttgaaccacttgtccaccacctgagcaggaccccaccacagcccgtcagcgtgggagccgctcccacgtgaccaagagggtgaacagcctcatggtggaccccgtgtctaggcggtaggaccccagaggtctcaccccagcctctccccctgggatcggcacgtctgcagactttccagttccaacacgttttgcagacagcaaaactgcccgccagccccactgagcatccgtgtgacccacaccggcccttcggtctctgctctccctcaggccaaagtcagctttttggctcttaacagacttttccggggccttaattttcacacgttttccctgctccctgcctgtgccacctgggctacatcccttggtgaggtcaggccacgtgtgcggacatcgtcccccagtctactttgtctcgaccttcgagaccagcttctcaccatgcgtgcggggcttgcccttctgtttcagtggagaagctggttggggcccagggtcagccaggctccccagtgtgagggtgagttacaggctgcaccggcactgtggccgggctctggactcgacctaccgtcctgtccagcaccgtggggatgaagtcgtagccgatcccttccacctcgtaggttgtctgctccgtctggttcagctcctccggctctgcgaggatggacccttcgggatccaccccaatgatctgcagagggcgcggcttcagggctcaaggccagcaaaagccccgcctggacatgcctcgatattctattatgggagtggccaataccgccgttaacaactgcctgttaatgatctgcctgtgggtggtggcctgttcccagcctcagaggcaggatgagaaacccaagaacccaggctccaagtattaaagcggtaatgacctaaatgttcagtgcagggcgctcagaagtaaaggcaggtgcctgggaggaactgacctccccggggtgcttctcggagcggggcccccaggacagtccagacagaccaccctgcggcggagcagcagagcctttggggacaaagggcattgctgggcagtgacgtctttttcaagggcaagcaacagggagagaacgcccttgtctcatcagcgggacctttctaggcacccgtcctcagacctgctcttaaccccgagtccaggaaccctctcccaactcccacaagccccagttgaggggcagactcaggaccagaggacttagagctcctggctgatcctcagaggcccccagttggaactccgaccccccactcagcgcaggaaggttctccaagacactggccggtgagcgagcacccagccccagctccttcgggtcacgagctgctggtcccttatgtgtcaagcacccttgtcttcccaaacacctcccaggcagcgcagaaataccgcgggagacagcgtgctgagcagaccgtgaggaatgacagctttcagctcagaagccggggccactccgcactgcccctctccggcccggccacaccactcaccctgcatccaggacacttctccttcagcttcctggcaatgcccgtgatggtgccgcccgtgcccactgaagccaccagcatgtccagcttccctggtggacggataacattcttgggtccctgcctggccagcccatcactcatagtaataatcattgaaaacacactcagcccaaaccacggtgggtaaccaaaaagttcaaaagaaaaacttcttctccagttggagcagccctcgttgctgcccttggtctgtgaaagcctcagaaacaggcagcctggggcaccccagcccagtctttgctcagtgacactcgacccctaaaacccccatttggctggatgcagaaagacaggaccctgtccggggggtgcaggcgctgagggcgggcagagggaggctgtgaattaaccacctccgtgggctgttggatgtttgcgtggtgtgagtgagttaactgaatttacacaggaaatggaatcagtcttttaggcttcagcgcagaaactcgctgggcgctcacactgctggccgccagcgcgggcatctggtggagaagtcacagcagggaaagactcagcgagacggagcagcttgggcacccatgctgagacaggactgtttttgccaaatgagagagttctcacacataaagcccaaacaaccaaatgcctggaccttacagcccggctcctgggcacggactgagggtgtactccagcccatgccaacaccggattcccaataggaagccagggcgccaacctcttggcaacttatctctaaagggatctcttgggaaaacctcagtaccaacccccacaggccttggcaccgagtccctggaaaagggcccaaggagccggcctcatgcttgtaacagagagtgagctcatcgcagatgtcaccagctctgttctgcagatgaatttgatgccgagtcagggcatgatcccaaatgaagtccaagctgtgagcccagcaccagcctgggccctgaacagactcgctgtctgcattatctgcaggaggagcccctgcagacctgcagagattgctgggtaaacaaatacagccatgccctgtgtttgctattacaggtaaaccacaggcggaggccaagagggcacaacggagggaggaaattgttctagagaaatgctctagaaaagcatttcacagagggaacatttgagctgggttctgaagggtgaataggagttcaccaaggagagggcaagagatgtgtacactcccaggcagccagggataaatgcaatcaagatggacagagggacgcaccatcacactgctgcaggatctcatcagcggtggtgtcgtagtgagccagggggttgctggcgttgcggtactgcatagaaagagagcagagcccgtgagctgacccctgacacctcagtcacccccacatccctgaccgagaccctcctagggaatgcctgtctccaggccccaggtgcctcacctggtctaggatgtgagaattggggatttcgttcttcagccgccaggccacccccacgtgtgactccggggagtcgaacctggcattggtgggcgtcctcacaatctcagcccccagtgcccgcagcacgtccacctgcaggagggaaagcggtggcctgcaccttccgcctggcccaggcaccctcatcccctgccctatgaccccgcccctggccacgcccacccaccttctcggagctcatcttctctggcatcacgatgatgcagcgatagcccctcactgccgcagccagggccagcccgatccctgagggcacacagagggtgagaggggcccagtgaccccccaagccctgccccgcccctgcctgggacacaggggcacaccccgatgccggttcccttagggcccagggaagagggttctgtgggattccaaaattgcccaacatggctgcttctgccttcaagtgcagggggagagaggctgccagaggcagaaataaaaggtacacgtcaaggaggaggaggcagcggcgcaggacaggagatctggttcctccaggcccagccgggtacacaggcacaggaagagcagactccgggtgctcgtcttgtgtgccaggcactgccaggtgccatcgccccgagagcatcggcactggccccgaatgctggtcaaaggaagctaggttgggacacaggccggcagcgggtgcaagatgccagggagcaggcggccaggcgggccagcacatgcggctgcagctcagccatcccccccgggtcccggcaggctcggcatgggtaggggacagccagccctggccaccccctctgggcctggcacccaccggtgttcccggatgtcggctcgataatcgtgtccccgggcttcagcgtcccgtcgcgctcagcatcctcaatcatccgcaggctgatgcggtccttcacgctcccgcccgcgttgaagaactcacacttggccactgggaggcagagatgaatcacagaggggaccccctgaccacccccccattgattcctgctcacccccccattacctgatacaccccagggtgggggacgggcttgggggtctgtgggttctgaaaaattgccacctctccactcacctcccctacacctgcacctgggcactagcctatcagagcttctccccctgcagcccatcctaccggtcctgcagggcgctgagcaactctgtgggaaccagagaggcataagcagccctcactggggggcgccgcagaaaaccccgtccccccacccacgagctgggcttgtggcgggcaggcgcctggatttgggtcccctacgcccctatgcccagccatacccagcggcccctgccaaagcagcttgatgtcctgaagccacagcactggcttccccatcggatggggactcgcatactctccctacagcctcccattgtcctcctccccctgtggggcgtcacctgcccggggaagggctccctgcgcggttcccgcacaaggccaaggccttcacttgcacttccttccttactgcaagtcctctctccctctccagctcttaaaaatatttagtttttaagagcgagagactgggctgcatgaaatgtgatttgagggacctgggaccagcctgcagcacctcaaaatttctgaaagcaaccaccagacaggtgttgcccctagaaccaggacgaggcgctgtgtgtggtggggaggactctcggggtctggccctctacaggcctgcattctcggacccctctgggtcccatactgtgaaaccctcagttagatcattctcactagcgcctgggggccagctccgaagcagaaatcagagctggtggcctccggcaagccacgtgaccaacctgaccctcggtgtgtctgtctgtaaaacgggcattccaaaacctacttcaagggcaaccgccaagtttagacgtcatcctgtacggagcacagtgagccagccacgcgtgctgcgtacgagttaagggtccctattgtctgacaaatgagcacagagccggccctgctgccttgggggtctctgtgaagggggctgctctgctgcagctccgagatctccttccctagaggggggcagaggagggccaggctcccacgaggcccctcctgtgaatcggcgatcggttcccaacgcaccgacccctgacttccttcccccagcgcctgccccagctctcacaggtcccccggctgggacattagagcatctcaggatgaaaaagtcccaagccatgttactggttccctctccttcccactcgaactccaccccctccatctggccctgtcgcggggttctccgcggcacccttcctgcctccctccgaactcacttggccttggtcatctgaaatacgaaattccgtccccgccttgtccccaaggcctctgcacccacagctttctctgtgacgatgctgaggtctaccagggctctgcgctcttggtgaagagcgacccttaggaattccctccacgctcttgagcctggaaactgcgtcctgcaaagaaatgcccttccccggaggcctcagaccacacctcaggtgaccccctgcgcacccaggacgaggccagccacagaccctccaaattcccattctctgtctcataaatgatgagctgaactatctgtccccacgaagctggcaagacagaggtaaccgctccctggacagcgggtggctcacagcacgtgctaggacccgtccactgctccttagcaggcatgacgctaaccctccccacctgcttgcttctgcctttgaccctcacccggcccttcacaccctcgctgcttccactccggcctcagttcaaaggtcacctgttcgttccctggtccatctgctggggagtcactttggtcaccctctgacacaatgccctgttgtgtgtttttcccaaacttaagctgatatgttcttggccactcattaaccagcgagttttctgatcccagggccttgcctaagggatccatcccaggaccccccaggaccccccaggcccacggagcccagtgtagatggaggaagcccctctccaaagccagggcactcacagagctcacacttcaggccgaacttcttcccaatcttgttgattctgaccataggggtgtccccgattttcttcagaatatctggcaagatttttggagattttgccctgaaacagaggagtccacaattattcaggaaaaaaaaaaaaaatagtaccagccctggcagacattgtcttacacaaatcaacactcgaagaactggaaaaaaaaaaaaaaaaaaaaaaaagaactggctttatctgggtggtggttacacaaatctgtacacagatacacctaacacacatcccacacacacgcctgaaacacacatacacacacatgcttagacatacaaatctataaaaagcaaatcatgcctgtggtttatttgcaccaatgccagcttcccaggtttgaaaatgaacctacagtcgtggcagatgttgttagtgggaagctgggagaagggtacaaaggatctattatttttgccacttattgtgagtagtaaattatttccaaataaaaaagttaaaataagcaaatactgactccaaaacaaaggtttaggtccaccttttcagaaaggctttactggagatgacatttcctttcatctctcagcatgtgaccataggaagcaaaaaagtgtcagggcagagactccttagaccagggacaatggctgcaaagcgcaggcgggatgtctagccctgcacagaaaatgtcaggcacgtggcagactcagagccccggcagaggcgctgtcggccaggctcgtgatgccctgccctgcagcatctggctgtgtaaaccctcaaaccctggtccaggtggtttcctaaatggccctcatgcccctgccatcctcccccagggagatgctgatgacaccccctatctatctgcaccaagctcaccacatactcatctgggaacacgcatggcttacagcggtctccagacccgcaacccctccctgggccttgcagctccgatgacaccccgtggctaaccctgggccccctcttcagcacagtcacctgctgaacagccagggtccttgggtcctgccccccaggaggcgacccttagacctggggtgaacccagctcccagaggtcctgtgccatggagggagtgccacatttgcagggagagctaccctgaaggccaaaacaggcgccaacaagagcagctggaatccaatcgcacccttcccggggagcagaaggcagtcctgccaggtccccaaactgtacaggggccagggaggttccctcagaagcagttctcggcagaagggaaccaggcttggcaggtgtagagagccagggccaggtggaaagccaagccccagggtgacagcgccggggattagttcattaattcagttcgggcatctggccagccaggcgggaagagtcccgcctccctgcagcaggtgtgctgactcagcactgggcctcggtggctgtgaagttacctgagaagtttgcagaggtgatcagggccaggcccagagcgcttagcaagaaaaaggatgtgacttgcagggatagccctggagccccttatctcaaggactcccacttccacagcccaagaggctcctgggaggacacgccactgtcctagaatgaacctccaactcctgacccacctctgcagcacctccccgcaacgccactattctcaggggccctccgactggagacaagcggcgtcggctctgcgtctcaggatgggggtgtcttcggaggatgaatgaggccagtatgtgaggtgcaggtgcaacgccatttacaacctggagggcatcgtctccttctcatgccctagagttaggagctcacggagccctcaggaatcgggcctgtcttccctgcccactccaccctccagcagccactcccgacctcaccgggcctctcacccactgctctcttgggtttgtcttggcagcaagagcccatcctcctggctgcccacacatctgcttggcctcctgagctcccagcactgagtatgtttgacactcagaccttctgggtttgtccactgtcacttctttctttctattgctgcactgagagtacacccagccacccccacccattctgaactgtaaatcaacaaccataaacgctggtagtggtggacacaaaataggaatcataatcccagcactttgggaggccgaggcgagtggatcaactgaggtcaggagttcaagaccagcctggacaacatggtgaaaccccatctctattaaaagcataaaaatccaccgggcgtgctggcacatgcctgtaatcccagctactagggaggctgaggtaggagaatcgcttcccgggaggcagaagttgcagtgagctgagatcgcgccactgcactccagcctgggtgacagcgagactctgtctcaaaaaaaaaaaaaaaaaaaaaaggaatcaaacatctaagaagcacattctttgatctatttgttctcctccaagattacactaaggaaataaagataatcctaaggcttagtgagcttgatttcagtttcatgctggggtagggatttttgttgatttgtcttttccactgatagatcttctgcgccttgagcagggcacgaaatgcacatggcgctgaggaaagacttgttggctaaatgaatgtgtcgtatcttctattgcagttatgtaaaatgaggtaactgcaaacatctatctaccccgtagagggcttacaaaatgatggcttcttcaccgaacagtctgtgccaccagaaaaacagcccttatggaaaaatatgtaatgcctacgggaagtcttcatgacctagagttaacggaaaagtgcaggctgggccgggcgcggtggctcacacctgtaatcccaacacttgtgggaggccaaggcaggcggatcacttgaacctaggcattcaagaccagcctgggtgaaaccccatctcctaaaaatacaaaaatcagctgggtgtgatggtgggcacccatagtcccagctacttgggaggctgaggtgggaggatcccttaactgggggagattgaggctgcagtaagccatgattgcaccactgcactccagctcgtgtctcaaaaaaataaaaaataaataaataagagagcgcaggcaggatcctggtccctcacctccagtgaatgtgcacacgcagccacagaccgggcaaagcatgtgacctgggcacatttatttatttattctggaactacttgctgagcatccactgtcttgccaggcactggcctaggcgctgggctgcagcgtaaggaggccttggcctctcagagcctcatctacacggcatggccccacccccagctcctcaatccagagtgactacagggggttacacctcatgtcctcctggctgtgtggtgtccaggtaacaaactcctgccctccaggttatggatcagccctcttgtgatcaaaagcaggacttacggggcagtgtggtgatgtggggactcggaggcaggccggcccagctgccaggtgcacctgctcggagcatcgggccggatccacaggggctccttggcttccttatcctctggggaccccttctccaggctccccttcgccgagtgtggccctgagcggtgggggcagcctgtgggccccacttctgcctggggggtctcagaaggcatgctgggacctggcaaagcaaggagagaggcgtcggttcaggctcggatgctgtggggttccagcgaaccctgctgacccggccccctctgggaggcgtgctctgctccctcagagaagcccaggaagaactgcacaaaaacacaggcaccagccctgtgggcagccgcttggccatttctctcctataggcatataccaaaaaaaatggaagcagacagttgcttgggccgggtgcggtggctcacgcctctcatcccagcacttcgggaggctgaggcaggaggaccacttgagtccacgaggtcaagaccagcctgggctccagccccatctctatttaaaaaataaaacaacaacaacaaaacagatgcttgcacacccatgctcactgctgcactattcacaagtcaaaacgtggaggcagcccacgtatccgcagacggatgaacacacacagtaggctcatacacacactagaatattactcagccctaagagaaatgaattctggcacacgctacaacacggacgaaccttcaggacattatgccaagcgaaatgagccagacacaaaaggacaaatactgtgtgattccacttccacgatgaggcacctgggactctcgaacgcccctctatgtctggcaaattcatagagatagaaagtagaatagaagcggccagcggctgaggtgagtggggaagggagggtgattgtttaatgggtgcagaggttgtgctggggatgatgaaaacgttctgggtggagatagtcacggtggttgcctcacacttagaaatggttacagtgatcagtgttacgtgtattttacccaggattaaaaacacacacacgcacctgaaatagatgagacagaaaaaaaaaagaagaaagcaaaaagaaagccaggcgaggtcccatctgctgcccctcctctggggggacaaggaacccacgaccacctcccaccttgccttcttcagagggcccaggactgggctcagccccgcttcaccctcctttgattccccacattcaacaggaagactaagtccacagccgtcactcaccggacagatggtgctgacagttcagcaccgctcaaactctgtaaggagacgtgacaacagaatctgtcatgggatcctggaatagaaaagggcagtgaggagaaaactctgcaaatctgactcaagcgcggactttggttaatgtcaacaatggttatgtgatcgtggaattggctcattaattgtaacaaataggccgggcgcggtggctcacgcctgtaatcccagcactttgggaggccgaggcgggcggatcatgaggtcaagagatcgagaccatcctggccaacatggtgaaaccccgtttctactaaaactacaaaaattagccaagcatggtggcgcacacctgtagtcccagctactcgggaagctgaggcaggagaatcgcttgaacccgggagggggaggtcagtgagccgagatcgcgccactgcactccagcctggcaacagagcgagactccgtctcaaaaaataaaaataaaaataaaaataaaagaaaataaataaagtaacaaatatacgacatcagtttaagatcttaataacaggggaaactgggggaactctatctattttttcaatttttctaaatctaaaactgctcttttttaaattttcgagacggagtctccctcttgttgcccaggctggagcagtggtgcgatctcggctcactgcaacctccacctcccgggttcaagcagttctcctgtctcagcctcctgagtaggattacagacgcccgccaccacatccggctaatttttgtatttttagtagagacgaagtttcaccatgttggccaggctggtctcgaactcctgacctcaggtgattcgcccgcctagcctctcaaagtgctgggattataggagtgagccaccccgcccggcctaaaactgctttttttttaaaaagcctattaaaaaagaaaaagttgcggaagccggctgcctttggaagcccttggagtatgctgttcaggtggtctctgcgcacaggccctacccaggcctcagcttggcctcctggacttcccagcctcccctccacctttgcaattcaccagactgggggccaaagcggcttcaaacgaccctggagggtggtgctttcaaggtcttgggaccacggacttgtctgaaaatccgaaggcgttggatcttctcttccccagaaaaatgcacccgctttcagaggttcgtgtcccacgcttttctttctatcccaaccttgtaagaagccgccgccgtgagcggagcagcaccttcctccgcgggtcgcgggagtcacctacgggaagggactctccgtctggcacaggccctgtctggcctggggcgcgcatgctccgccgccgaatcttccagaaagccgtggacccgaggccccggcagacgcaggcggcccagcgccttgcttttggcccctcgcctcgccctggagccctctctcgcaaggtaagggactgccgggaacgcagatcgcaagccgtcggggctctgtagaactcagaggcgctcggcggaaagctcgccaggcgacccagacccgaacccgcgggctccccaagacaacagcgccgggcggccggatgcacgtgcgtcccgggaaggcgggttcagctggcatcgcctggccggttccgttcgctccttaaaccacaagacccccttggggtcacgacgttcccggggcacccctgcactcgcgcgccagcactcccggaggggcctggggaaggccacgcgcacggagagcgggaaactcctctaggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacgctccaggactcgccgccagtggggtccactccgccggcgcgggggctggggtgggagcccggggccacgtgcacggccagcccccatcttctgggcggtcaagaccgcaggcgtgggcgccggtggggcgggggtcttgggagaccctgtctcgccgcctttcggtgcagatgatgcaactctgggcggaggcgcggagagggaaaccgggacccagttgagatcctctgtccagagaggggagcgagtctcggtggggccggatctcacctggacggatacatggaaaagaggggcgagcggctgccccgactgcggcgaggcggagacggcgaccccggggtggcggcctcgcggggacccacggcgaggggagcaggcgggcggtgattggcggagaggcgggggcggaggccggcgccggccaatgtctcgtggcagagcacccgcccccccagcccctcctccaccccacccagcccgggcccctcccccccaccccttccccaccccgccgcagcctgggaccctccggcctgcccgacccccgccctccccgggaccccggcatgcccccaccccagtccgcccgccccattcccacgccctgttgattcaaccgcagacccgggtcgccgccccctcccccgccttcctcttcgcctgagcccgcccgccccgggttccagccacccccacccgcggaccccggtggtgtcttctacctggtgttccgatgctgttttacttggttaacttcttgcccttcgggaatttaaggaacctttactgatgagcttgaaacgtgcgtcctggtgggtggggggccctgcgcgtcctcgaggaccgaccccgagggcgtgtgtcgcgggcccgggagggggcgccgcgccggggcgggactcgatggccgcgctctgtggccgccggacgccgtgcgcagcgccccgcgtgaccgcgcccagagccgggtccgaaccccgagccgaggcgcagaacagtcgccttgcgcggctccggtgcggcccacggccaggggctgccgggcgctctcggggacggggccgactccgcgcagggtggtagcaggggcgccccgcggggctccttcgccaggtcccggaggccgcgggcggggccgtttcccaaacatcgtgctctggactttcagaggctgaacctgatccccccgccctatggctaaatgggggatcccaggcccccgagtctccccccggacctgcagcgaaagacacggacggtgcccatcagctctgggcagaggaacgtgctgcgcctccgcagcgtccccggctcaggtcagagcgatgctccgcagcctcctccggcccgcgcagctccgccgcggtctctgccacgtggggctcacagtaggggagggagtgagacgtgaattagaattaaatgtccactggcaggaactgacacgaagaacaataaagccggcgatgtggggaggggacagggatggagttacatcatgaaggctctggaaggtggcattggaggccgggatcgcgccactgtcctccagcctgtgcgactgagcgagactgtctccagaaaaaaaaaaaaaaaaaaaaaaaaaatcctgtccagtctttataagaagagagacgtggacacagacacgcggagagaaaaaggccatgtggagatggcggcagagatgagatgtgctgccaccagacgagaaatggcagggatggctggcggcctccacagggctgggaaaggtggccagggcctccctcagagccttcagccagcctgcgggagagaaagatgataaacggtgttgtttttgttgttgttgtttgagacagagtctgtgtcacacaggctggagtgcaatggtgagatcttggctcactgcagcctcagcctcccgggttcaagcgattctcctgcctcagccacccgagtagctgggattacaggcacgcaccaccatgccaggctaatttttgtatttttagtagagacggggtttcatcatgttgaccaagctggtctcgaacccctaacatcaggtgatccatccgcctcggcctcccaaaagtgctaggctcacaggagtgagccaccgcgcccagcccaatgtgtgttgttttaaaccactcaagtttgcagtaatttgttacacagcccaaatactttttaattttttagaaattttaacgtaattttagattagaaaagtggcaagaaccatacagaatgtcatattccctcatccagattttccaaatattaattttttttgcttctattatcagaaactcattgttatttcaaatgttaagtttttactacatttgctccctctctgtctctccacacacacacacacacacacacacacacacacacgtgtgcaggtgtgtatgaatctgtcactcagtctatctggtttctctaacttgttattttgttttgttttgtttctttttgagacagaatcttctctgtcacccacgctggagtgcagtggtgtgatttcagctcactgcaacctccctctcccgggttcaagcgattcttctgcctcagcctcccaagtagctgggattacgggtgcctgccaccacacctggctattttttgtatttttttttaagtagagacggggtttcaccatgttggacaggctggtctcgaactcgtggcctcaggtgatccacctgcctcggcctcccaaagtgctgggattacaggggtaagccactgcagccagcccactctctagttttaacacttactgatgattttgtctgaattgatttttattaaaatggttgctgagctgtggctcacacctgtaatcccagcactttgggaggctgaggcgggcgcatcacgaggtcaagagattgagaccatcctggccaacatggtgaaacctcgcctctactaaaaatacaaaaattagctgggcatggtggtgcgtgcctgtaatcccagctactcgggagactgaggcaggagaatcacttgaaccaaggactcggaggttgcagtgagctgagattgtgtcattgcactccagcctggcgacagagcaagactccgtctcaaaaaaaaaaaaaagtaaataaataagtaaaataaaataaaataaaatggttgctgaatagtggtttttctaagcccatcactcctccatgtaccatttggcattccattattagagttttccttctccctcatttatttattcacttagttatatcaatgtgagccgtaggtcctattttaaaatgaaaaagctacacctgaccactgaaagtgcacgaatggccaagtggggtggctcacacctgtaatcccagcactttgggaggccaaggtgggaggatcacctgaggtccggagtttgagatcagcctggtcaacatagcaaaaccccgtctctagtctctactaaaaatacaaaaactggccagcgcaatggctcacgcctgtaatcccagcactttgggaggccaaggcgggtggatcgcctgaggtcaggagttcgagaccaccctagccaacatggtgaaaccccgtctctactaaaaatacaaaaaaaaaagaaagaaagaaagaaagaaagaaaaaatacagctggttgtggtggcaggcacctgtaatcccagctactcgggaggctggagcaggagaatcgcctgaacttgggaggtggaggttgcagtgagctgagatcgcgccactacactccagcctgggcaacaagagcgaaactccatctcaaaaaaaaaaaaaaagaaaaaaagaaaaaagaaaaacacatctccccggccctcatcattttctagcctctgcctcatttctgtgtctgcctacatgagaggaggcactgcaggagcagagcccccaggagggcctggcccaccacattgtactgggaaggagctcagagccagagatgcaggaatgctggcgtcctgtggacaaggtggaagagcttccttctaatcacctctgtttcttcaaaggaataggcctgacagctggtcagcagcaagtggacagcgaggccgagctgatggagggttttgttgttgttacttttgttcagagtataacacgtatgcagaaagtgcacatgtcatgagtggacagaggataaaccgctaccccactggggggcgagcagaggggagaggcctgggcctgcaccatcccctggtggccggaaggctgggccctcagaactggaggagattggaggaggaggaggaggaagaggaagggaaggaggaggaagaggaagggaaggaggaggaagaggaagggaaggaggagaggtgggcagcactgagggctcctgcgaatttccattcacaagtttcccaggcccctggcagcacggctgtgcttttctctggctgcggtgagtggcccgcgtggcagggcaggggaagagcgctggagatggtcgtgtgtgtttacgagattctctctccctgcccaagtcacggcagtggcggaaacttacccaccctttggatttgggctgagccgtggtttgcttcaccccttgggacacacagcagaagggagtgtgcctgtttgcagctgagacctcagggacagcggccctgacctcaacctgcagcccggggcccagccctgcagagcccggcaggggaagaacaaaatgccctttgctgggagccaccgggactggggctgtttgcaggctgggttacgtgtgagagtgaagttttgtctgagtgtgttggtgggagacggcacagacgggaggctgagctgcgtttgtttgcagggatctgcgctgggtggggcgggaaggatgggcagcaggcggcagggacagtgaaaagctggtgggtccatggacaggcagcgtcactggagagaaagaactgccgatggagagttctagaataaggagctggagcatccgaggggctgaagggctggcactatagcaacaatgccctttgggtatgagaggaggggaggatttgtgtaggtcggtggccaagatcgttctgaggggagggttcctgagcccaggcgtccaggaggagcttggatctttaatttctttcagtggtgttttgggatttggggtatgtaagtctcacacttctttggttacatttattccttttgacttgaggggcgagtctgctggcccaggaatgcaggcggtccgtgtctcaggttggctgcacgtcttccagcaacgctgtgtcattttccgagagtaacgtgtgcactcactcactttcacgccatctctccactctgcatttgggcaagcagagttcctgctccccgttctgcgtgtctgccccacccccacacccccacatcccaccttcagttactaatactgtatcttttctttttctttttctttcttttttttttttttttgagatggagtctcaccctatcacccaggccagagtgctgtggtgtgatattggctcactgcaacctccgcctcccgggttcaagcgattctcctgcttcagcctcccgagtagttgggattacaagcatgcgccaccacgcccagctaattttgtattttttaatggagacagggtttctccatgttggtcaggcttgtctcgaattcccaacctcaggtgatccacccgcctcagcctcccaaagtgctgggattataggcgtgagccaccgcacccagcctgtatctttcatttttctagagacagggtctcgctctgtctcccaggctggagtgcagtggtgcattcatggcgccctgcaggcttgacctcctgggctcaagtgattctcctgcctcagcctcccaagtagctgggagcacaggtgtgagccaccacacccggctacagttactaatgctattgctaccgacaacggcaacaactgactgccatgcactgattgcggatgtgccaggccctgctctgggagcttcacctgtgttacctgacaggatcttcctaacactgaaggaggggcacgacctgaccatccctttacagaagagaaagacgagtgtgcaggaacagggagcagagctgggtgagaccaggcggcgggactcctgggcccactcttacccatgggactttgtggtcctcccacgacgccaatcagccccagtttgaaccacgtgaaattgctgaaatgtgaccttttgacccacaaaaaaatggcaatttcctatgattcaactttttttttttttttttgagacggagtctcactctgtcgcccaggctggagtgcagtggtgcaatcttggctcactgcaacctccgtctcccgggttcaagctattctcctgcctcagcctcctaagtagctgggattacaggtgcgttccaccgtgcctggctaatttttgtatttttagtagagat

SEQ ID NO: 12391 - DNA, 109378 bp, Human
  misc_feature (1)...(109378): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggtgagtggagcccgccgctccccggcgccgccccctgccccacacccggtcacctcctcctatcccgccctcaccccgcgtgctgggagtgcgggaccccgtgttctgcccacctgttgctcgccgtcttcggtatgaccgacttgcttgtggaaagcactcttttccataacctattactcagctttgtcatataggtacctatgtatattaaatattgtacatatctatcaatgttaactaactcacttcaagatttcacccctttctttttctactccgccggtccgcgcccctcactggtgcggacttaatttgaaggttcagggagtctataaacaccttgagatgctatgcagaatttttggtgtgtacgatctttttctgggagaaggagcccttcaattttattagatttgttaaataattaatgacccccataaatatcttggggaaaaaaaccgacagcactggcgctcctacaacctataaattgggattgtgctgtcttatgcaagtacttcggggcgctccaccctgtgtgggaggcgagtggtggatctagggagtgaagaaaagtagttaggaggctttggtccagggaacaaacacgccgaggaggaggtaggggactttggccctgccggcaacagccgtgcccgcctagctgcgcttcctacccccaccagtgcgggcgtgatgcaagtctgatccctccaaaaaattaaacccgaaggtgaaaggggtgtaagcacacacatgcacactatgttcatgattgatagacgggggaggtggaagggaaagaagatggcaagccacttgtgaaaattagagatcatgatgtatccttttctcccctgctgaagtcaggtgatgggatcaactcagtgacccttgttttacttcttgttgctgtgtatgtgagtttgcattataaaagcactatgttggcttatagcaaaaagaagaggaaagaaattgagcaattaagttggaatatctgtttcctgcaacgttcagttgtttctgtatgaagtaacttgggcattggcgaatgtaggctaacccattctagtttctattaggaaaacagaaaaattctaacaggccagaccagagatttcaaacagcagagtctgggaggctgtactgtgtgtgtaaaagaatcctaaaggatgacgtagtcaatattaacatacttgaaaggtaaagagaagatgttcaatgatcgtagttaatataactgagtgcatactatgtgccaagaattgggcgatgtggtttgcattcatttgagatatatatatatatatgtatttaaaaacttgtgagttaggtattttcatcctcattttacagatgaggaaactaagcagttaagtaacactgaagctctaatagatggtaagtggcagaggtggtatttaaactcccaaacctgaattttaaacttatcagttttatcattaagttttaaaatgattaatacaaagtgggatttgttagatgctaagcctctccgtggccccctcccatttttctttaaataaaattgaggaagttctgaaaggctggggaggtctagaaaacacagaactgctgcaatacatggagggaaagaccttatatttatttagacttaggggtctgactaaagactgcgggatgagtgaggccagtctttgaaaagtggagccattacacccattcattctctgtgcccataggtccagtgctaaactgaaaccaaatcagcttcccctgcgtaggagacacaggaggcatattagatattctttcttatcctctgagaatggccagctaggaagagagcaagcagatacaactcttccataaatggagggaatggagccatgaacagaagaaaagggaatgttgctgagcatctactatgtgcctattccagaatcttcattatattcttgaaacaattgctgagatagatatgagaatccatctcacatatgaagtatgtgtctgtcagcaatggttggaaatttaatcccaactccacacataatctgttctttctacaaagtaatgcatcacctgtgtgatgaattcagcaagcatcaaatgagtatgttcttcatgccgggcgctgtgcaggtgctgaattaaacacaaagactctgcttgctttaaagcaaaaagtttgaagaaggaagccaaccgctagaaaaatacattaccaaataaaaagtagtaagtgacccaaaagaatggctaatatattatggagtttagaagtgtaaattggctgggcgcagtgactcatgcctgtaattgcagcactttgggaggccgaggcgggaggatcacctgaggtcgggagtttgagaccagcctgaccaacatggtaaaatcccatctctactaaaaatacaaaattagccgggcgtggtggcacatgccggtaatcccagctactcagctactcggaaggctgaggcaggagaatcgcttgaacccgggaggtagaagttgcagtgagcggagatctcgccattgcactccagcctgagcaacaagagcgaaacgccatctcaaaaaaaaaaaaaaaaaaaaaaaagtaagttactcctggtggcaggaaattttgaaaagcttcctggaggtagatctcaaaaattcagtaggactggacatagggaggtgactggagaaagatcattctaggagggaacagaatgaatatttcacagttcacagagttgatatggtagaacaaagggcactatcttggtccttctgctataatgcttgggtcaactacttgactggctgttccaactaaggaacaaagcgtttgaaatattttgattgcaacagcagctttccagtaagctgaaatacactctgcagcctacacagaagtacaaatcagacagagagataaggcagcaaacaacacctacttactttaaagcctcagctttctaagactcaaaaaggaaatcagcttcaaaggaatttaacattagcatgccatgaaacaattaccaggggtggttcgtatgtattgtttaattaaacttctttgaaaaggtctgggggctcgtggtggttctgagtataatttttattatttccatgttactatcctgtctctcaagttgaaacagacaagcaattgttgaaacagtgctggtctggaaaaaatcctgtatcaacacaagaaattccaggaagaaaagaccctgatgttaactgctattagctccagggccctggagaattctgagttgttgacaaacctgtaaggttgagacagcggataacctgctgaaagcagagatgagataaatgtggctgatttgttgataagtatcttgcaagagtctttaaccctttgtcttctttccaatgccttagtatagctgggtggttttcattgtaaatcactcagtgacttttggtgttatttttaactgtgctgaacattttaaagttggctgtaactctttgggaaggggccttcagaggtgtatagcagcattgtgaagtaagtctgtattgtagctaatagttaaaatatttttctaaaatagaagacatttaagaattgcaagtattggcaaagggaaaaattaaaagcatccatatcctatttattacacttgccttaaaagtactacttgttacannnnnnnnnnnnnnnnnnnnnnnnncccccaccccaggtatctgagtggagagaaaattgtgttttaaattgtatttactacttataaaggacagtgaacaatctcctaatgcaattatatttacaacctctttggaaatccaccacaaaacttgaggcacactattatcttaggtgatttccttggtgaagctgcttttcaatatctgtgatcaaagtgaattctgggctgggcgcagtgactcatgcctgtagtctcaccattttaggaggccgagacgggtggattacctgaggtcaggagtttgagatcagcctggccaacatggtgaaaccctgtgtctactaaaaataaaaaacaaattagccaggtgtggtggtgcatacctgtaatcccagctaccagggagcctgaggcaggagaattgcttgaacctgggagtcagaggtttcagtgagccaagatcatgccactgcctccagcctgggcgatggagtgagactccatctcaaaaaaaaaaaaaaaagtgaattctggagagagaattgaaaattggctcagggtagcaaaagaaaggtagttactaggcgctactgttaaaaaaaagttagacattgttcaaattctgcataaattcttcctttgacaaaaaggaatcccaggaatgaagcaattctggggagcaaggtgactaatcgttcagaaagtaggagggatcaggaaagggaaaaaaaagagtgagatggcgggtggcagggtcatggccctctgctctgaatgtgaggtgtcagtagcacactggattaaatgcacctctgtgtctgtgtaatatggcctgtgagccactttttgtccagggccaagcagattgagttcggtaagtccaaaaataattaaagaaatccttctgattatagtaagtgaaatagaatgttaacaaaatggtagttaacaacaacaacaaaaaaaacttcacacccctggaaatgttgagaacacatctcttaggggtgaagttttgtgtgagggtaaagtaaggatgcttcagaatccgtggaactgtaagaaaccacaagtagacccagagtagcagggtttgattatgaaagtacattgttctatatgtgacagataagacgcaggaaattaccttaaaggaaggaagactgttcatttaggcttttaaaagactgttgttatctgtatgccctgtgctaagagttccacagtcatgggaacagagggtagcttttgtattaaatattctaggtatttgtagttcacatttcctcaaagttttagatagcaactttacagttttttctcatttattaaaataagcctatacatagttacattattttatcttcacattttaacattgattttaccctacaattgaattcctagtctgatcaatacaaattattaaaagttttgattttttttctctgagagaacaagcatattattggcaaactatgatagtaatgaaatataataaatatgatgctaaaacctctggagtttataaatcagatgattaatatggcctataagatgatttatttccatctcagatgacattcaacaagtttaaattatacaattctgagacaaatgttggacttcaggtatcttgtgcatgtctacaaatatatgaagataaataccctacttctcctgaggaagtaaattagcagtaaaaggcagcaatgcaagtgggaatagacaataaattaggagaaaactttatttttctattagagtgagccacctggctcccctgactagtagagtaagactactaaacaaactatcaagtgctctcataataaaaacattaaaaacctgttgtgtgtcttttcttttcttttttttttttttttgtttcgctcttgttgcccaggctggagtgcggtggtacgatctcggctcactgcaacctctgcctcccgagttcaagcgattttcctgcctcagcctcccgagtagctgggattacaggcacccgccaccaagcccagctaattttttgtatttttagtagagacagggtttcaccatgttggccaggatggtctcgaactcctgacctcaggtgatccgcccacctctgcctcccaaagtgctgggatctcaggcgtgagccaccgcacccggcctgtgtatcttttctataatgccatttctggtaattggatattggacataaaaacagttgtaatgttcttaaagtgtttaaagacaaaagcttgagagctcaatatgtagatttaaataaaaatggacagttggaaaaaaagaaacttaagcatttgaaaacacaacctgccattactattaaaataattcacatatttatattcttggaataatcagctttagacttaataacattcgttaacctaagcagtcataatcaaagttctgcaattccttgatttccagaatttgtggatgaaaaccttcattagaagcttaatggattattttttctgaatctctcagtaagctatttatggggtgggtgtgggtgagcatcaagcttattggatcttgattactctttttcattgaagaatgaaaacaaatgggaacttttcttgacagataatatgaatttataggccaccaaaatattacagataaatacacaagccatacagataaaagaatgatagtaaacatatattattcaaatatagaaacaaccttgccaaaatgaacaaagtcagcttttctttttttttttttttttttttttgagatggagtctcgctctatgcccaggctggagtgcggtggcacaatctcggctcactgcaacctccgtctcctcgggttcaagcgattctcctgcctcagcctctcaagtaagtgggattacaggtgtgtgccaccacacccggctaatttttgtatttttagtagagatggagtttcaccatgttagccaggatggtctcgatctcctgaccgatccacccgcctcggcctcccaaagtgctgggattacaggcatgagccactgcacctggcccaaagtctgcttttctaataaaagtctgcctacattctggggaagcaactttccttcctctccgtatacccagaatgacagagaacagtcgaaactatttgagcaccttccatctaccccaagacaaaagcatgtatgtgactatcatactcacattttagttccattctggtgagccacagaatacatacctgcctgaatgattaagcgcaaactgaatttgtgtaactaggatatttctaatgtacaggtaatctgactaatcaacaattaacttgtcaagtactgatacaagactgtgctagaagtggtagtgtaagatacagttctttctgtcaaaatctctttggaagagaaaataacctctttgttttaacgtggccccactccaatccattctccacacagctgctagagtgaactttctaaaatctcattgcatcatttcccagtttaaattccttcagtttcttactgttatctgcaagagtaaaattattgaacacagcattccaagttcttcgtgatctaatgcctgcaacttctcaaacttcatccctggggccactacccttgctccccaccaaacccacacaggcagtttatcttgcttggtatttctacccctccttgtctccctcccttccttctcttgcccagttaacttagttcagttgtgtcccttataggcagcctccttcacccctctcctctgatcttgaatgcaagttaaagaatttgataattgtgagtcacagatatttccacagggaagaaacatgaaaagtgcaggagttttgtgaaaatacatttgacagatttggtggatttaaagtaggaacagacctagcatggtggctctttcctgtaatcccagcactttgagaggccgagacaggagaatcgcctgaggccaggagttcaaggctgcagtgagctctgaatgcaccactgcacgccagcctgggcaacagagtgaccctgtctcaaaaaaaaaaaaaaaagaggccgggcgcagtggctcacgcctgtaatcccagcactttgggaggctgaggcgggtggatcatctgaggtcgggagtttgagactagcctgatcaacatggagaaaccctgtctctactaaaagtacagaaaaaaataagctgggcgtggtggcgcatgcctgtaatcccagctacttgggaggctgaggcaggagaatcacttgaacccgggaagtggaggttgcggtgagccgagatcgcgccattgcactccagcctgggcaacaagagtgaaaatctgtctcaaaaaaaaaaaaagaaaaagaaaagttgggttagcagttatgaatcagttgggaggggttaaccctggcacgtgagaggcaggggaaatataatgacttgaaagtcattacaaagaaaacctgtagtaagtattttaaagcaaaaaataatttgtgagttctataaattcacctttttttatattattgggagtataatgtgatatttgccatggaagttataaagtcttacaagtcttaaagtctcatgagatatctcagcaaataattggcaggaatgccaaagtaaagacacagttacagaaatgaacagtgtattcattcattcattcatgagacagcgtctgtctctgttgcccaggctggagtgcatcttggctcactgcaacctctgccccccgggctcaagccattctctcacctcagcctcctgagtagttgggactacaggtgtacgccaccacacccagctaatttttgtattttttttgtacagatggggttttgcctttttgcccaggctggtctcaaattcctggactcaagtgatctgcccaccttgacctcccaaagtgctgggattacaggcatgagccaccgtgcctggctgagaaatgaacagatttagatacttccaggatatttctatttaatacttcaccaggatgctaaattaccagtttataataacaaattctacaattacatattctaatacctcaaacaaaatatgacatgaacacctgtgatataaaagggccatttaatggctcacgcctaaagcgctggcactttgggagcccgaggcgggtagaactcttgaggccaggagtttgaggccagcctggccaacatggcaaaaccccatctctactaaaaatacaaaaattagtcagcatggtggcacacacctgtagtccagctactcggaaggctgaggcacaagaatcgcttgatcctgagaggaagaggtttcagtgagccaagatcgcaccgctgcacttcagcctgggcgacagagcaagactccatctcaataaaaaaagtgggagggggacatttaaaatgtgtttttgtcattacctagagcagtgatttgaggattgccccccaaatgtcataaattggtatatcagaagatagctcttgaattgcttagggggctcctgaaaaataaggactctagtggctggtatatcgtgtgagtgataacagcaatggattagtcagtcgcacactggcatgtggtatgtgtggcccactcttgcaggagagctgttctgtccctggcatattcaacgttttaagaactcatagccagtactttctagcatatacctgatacaccaagttgtttctcatggttgattatgtgagctaactggtcacaaaatatagcactgtacaactattggttaaattttcaatagtataaaactttattagactttcatctgctttgaaacaatttttcaccatagtgttccctttttttttttcctttttgagacagagtcttgctttctgtcacccagcctggagtgcagtggcccaacctcagctaactgcaacttctgtctccagggctcaagcaatccacccacctcagcttcccaagtagctgggactacaggcccatgccaccatgcccagctaatttttaaatttttaaaattttgtagagacgagatctcactatattgcccaggctggtctcaaactcttggactcgagtgatccacccacctcagcctccccaagtgctaggattgctagtgtgagccaccctgcccagccaactatagttttctaaaccaacaaattctacttattttccagcctaagcaaatgcttacttgggctgttgtgatttccatcaatatctggttgttcttcttggaaagtaagaatagaagataaaatatagttttaaaaaatatgtaagtccaaggaaatgaatcgtatgttttatgccaacacagacagacaaaaaacaaaaaaaattccttcaccaactcaggagtgcggacatacgtatggtctttgatgagtctcagtatattttatgctttcttttaagctcctactattgctagtaaatgactttaaggatccattcaaatatgaattgctatacaaattcctctgaataagtggcaagatcccatgtcttacctggaataacatgtcctcaactttactgtaatgggagaagttaaatcttttaagatttgtggagaacgagagctgttgcaagccagagattactgtagaaagaccaaataacagtaagatgataagcttttagactttcaggctctttccttctaaaagaccatcgtgaatccacactgtgaggacaactgctcacggttgttagcccaattacctgcagcatttaaatcaatactaatagcgaacacctgctgatttctgtggttacatttaaccacacctgtttttgtgggcacctctacatgtatcttcatctccagaaatcctccttttagagctcagtgtgaaccaaatcactttttttaaaccacactcagtgctagaagattgaaagaaaagacgcttttctgaatgtgagtgcacctctcttctctctaatagaagcaggctatataaagatcttgcttgtttagcagttctctgtcatttgcttactataaaagaaactgtagttggttttttataaatatgcccagaaacaggtaatggaaccacaatagagacttgtcaatttgatttcataaatacattcaatctaaccaattacataataaaattgttcacaaaactgtgattatgaaaatcaacttagttttttttttgggggggggacggaatcttgctctgttgcccaggctggagtgcagtggcacagtctcacctcaccgcaacctctgcctcctgggttcaagcccggcccccaagtagctggaattacaggtgcccaacagcacacctagctaatttttgtattttagagacagggtttgtattttatgttttagagacaggctttccccgtgttggccaggctggtctcaaactcctgacctcaagtgatctgcccaccttggcctcccaaagtgctgggattacaggcgtgagccactatgcctggccttattgactattttaaccctgacaataattcattatttcgagcaatgtttgtattggtgaccaaacacaaagcttctttttccataacagctgcttaggaatcacatcattccaatgaacactcagattgggaaagggagaaaattacattgtcctgtgacggcttcacctctgcaattttctgaggaatttagaatcctaccaccatccaaacagacctccttcaccattacccgcccccgcaattggtttgacctgaattgcttgttatttgagaagagtggagtttaaagttgctctgcaactacctactttattttccttaaaatgggctccataaaatgtgcatggtatttttagaaaaaagtataggtaatgttgcctgagcccatgttaatttgaaatatttcctagtaaatcatccccttctttaggaaacatcgaaagcacattatgcactgtgcaggtgaaatgaatggctggaaaacacagtaatatcatcgtgctcctcagtggcgggtcaatcagaagtcaccagaaaaagtccaattcaagaccagtggtaaacttagcagaaaaaaaaaaaaaactgctctacaacacagtgtaaaccatgcacactagtttatccctgttattagaatagactaattcatgaaaaaatgtgaaaatcaaatttttatgactcaaattctatttagaaaccttatctcatttttgcatattgcttgtgtagaggagaaaagttttcttttcttacccgtcaccaggtttatgcctgagacccctataacaaaagacagattaaaaagagaaaagcataacaaatttgtttaatataagttttatgtggcatgggagtcttcagaaatgaagacccaaagaaacagggaagactgtatatttattttttttcttgagatggagtctcactctgttgcccaggctggagtgcaatggcgtgatcttgactcactgcaacttctgcctcctgggttcaagtaattctcctgcctcagcttcccaagtacttgggattacaggtgcctgccaccacgcccggctaatttttgtcattttagtagagacgggatttcaccatgctggccaggctggtcttgaactgctgacctcaggcgatctgcccacttggacctcccaaagtgctaggattacaggcgtaagccaccttgcctggcagaagactgtatttttatagacagtcatgcagaagtctgatgagacaaaggtgggcctgatctaatggtaataaactgagggaatttagcaaggcttctttgttcaaattcttccctttatgacattcctttcctccaggtatagggaggatccttctggaatgagtctttgacctaattcaaaggaaggtcagcttgattttatatggtctgcttcaagggagaaggggtgagaggaaggcgtaaggatacacttcctgcgcctgctgcttcctcaaatgccaagtgccatattttgggatgacacgtcctgaaacccatcacttcacaattttgaaagcgtttgagtctatgctttctcaggtaaaccctctctctcagcagtcctattagtagctggaattacgggaaacaggcatctaactgatttgtccagacacatacaaagcggtagaataggggttccagatgaagcctacggatttcttcaatgtagggaagatgcctacttctttttcgaaataaacaaatcctttgaaatagaatcacacctcaattttcagtgtaagaaaatctggattttcatgttggatttgtttaaagctggatgcacctttgtgtatgtttttgtttgctttcttctattttcagaaaaggacatggctgagttattttatatgttcaacggtcatcacgatatcatcttattctctgaacagaaaatgacttattttaaagaaattcatttccatccttattagtatttactttaaaaaaattttactcagtccaaaatttctttaaaatcttagaacacagctattaattcatctttaatccagcatactgatctcaaactcatgactgcctaggcaaattagtctgcagtatttgttgtttgagattggctatttatccagaaaaaccatcgattgtgccaacttgcaggctgaatatctggagtcacatctttcatgtgtattccacagggagagtgtctgtgatttaaaaattcaatcttatttttttccctgtttccaactactttgtagttatttggcgaaccattaaaacagcctcagttcattcatctgaaaactgaagaagcagctttcttctaagaacttatgttggcaaataaagaattaatatttacagagtatttggagttgcgtaagtgaaggttttagaggaaagaaaaataatttttttgtcctcagatcaaaactataataataatccctctaaggccttgataaatgacaatgtcatagtagccaccttgcagtcagacagcagagaccaggggaaaggaggaacccaggttgatttaataatcaaccctgactattaaatctctttgcaatttaaagcaggtaatttaagtttccctatttataaacagagatgatagtagctggctccgcatcacagaatattataaaggaacataaaataatttgagctccttaaaggaaaagtcacattgaaatgtaaggagttcacacaagttgctttaaaaaggcttaaaactcacagcaacaacttgaatgtttaatgtcagttaaacattttagttcaataaacctgattataaatctcactgattaattagctatttgataggagatactgtttcactgggtcctgtccaaagattcttacgcatttagaaaacctttgcagggatctcagcttaaagatggaagaagcacgccattaactgttcctgaatatctacctactcctggaattagggcaagggtatattccaggtgatgatgggctaaaggggctgatttacagagtttttcttgaattcctaaaattgcctgctttcatcacctgccgttttattatagagtaacaggaattaatggttccagctacggtccataaatgaccattagtactttgccattctagattgtccctgactttcctaattcagttttcatgtggtctaaaggtttgaacatggatagccctaaactaatttttataaagacagtaaattggatttcttatgtatcagctaactaataatgttctgcctggctgtgggctttgtacaaaggcttgttttattgggggtggggatagtgtaagcactctccccagccacatccctctaccccgaacccttcccctttctgcatattcccagtgctgagggtactctggcccccggactcttcaggattagaacctttttatgttccctgtacctggcctgctagcctcctttcccacagcagcctggcccttgcaggcctacctccctagtggcctggggaggagagaaggagtgcagagtagaggataaagggttagcctaggcgcgagcctcagccaacataaaataataatatgaggccagacacggtggctcacagaggctgaggcaggagaattccttgaacccaggaggcagaggttgcagtgagccgagatcgtgccattgcactccagcctgggcaacaagagcgaaactccgtctgaaaaaataataataacaataataatatgagttgctttcaacttacttataataataaatgtcagcgtccttaaggatccaactgttaatgtgtccttgatttctctcttaaattggctgtcgggtcatggaaaagattgctttcaagtaagggaggctgaggcagaaggatcacttgagctcagaggttggagttcagcctgggcaacatagcgagactccatctctaataaaatttatagaaaaaaattttttttctttatttaaggtccaagttccagccgttctttgccatagagattaaaaattaagtggctgcctgaccttttgccagcccttgtggagaaatcaagcccctggaaacaggagatgcctggtttatctcaactgctcttgtctctagggtgacagttacaagcctgccactgcctcctcacaagactccttgaggcctgaaaattgtttatcaggcagattgtttggctataggaaataaggacacgtgtacaaacataatttaggatggatttagactttttagctctctggcaaaaataatttcaaattaccattctccctccccttgaatgtatcatcagtattttgaaattttgtctttataacagtttattggaaaagttatgttgatgtgttcccattgtactggaaaggagcaccctgtgttgttgtattctcaacatctttcatgagtctctgaagcctagaagagttaattgagtatattttccctctgatttctaaaaaatgctacatgacagaaaaaaatttcagttaaatgtaagaaagtagatattacttggcttttggagattgttgattattttgattagcctttttttaaggcagtaagagaaaactcaaaacaaaaaaagctgagagaaggataaaggaggcagaagagggacacaacatactgctttccaccactcccccctcctcagacaggagtatgtgaagatatatgagacaggcatcagttgaatccctgtaggcttcacagagctgagcacaaagggctggctgctgtctgtgttttcatgagagtgggctggctattagaccaccaaacaaaagaggggccaggtgattccacaaaagcagccatttggatggagcatagaggttgatttcctttcctgcctaactctcctgttgccaaatatctcaaccccagcattggcctgaagttgatccatgtttcccttgatcatgctgatctaccctgttgtttttcttgcttttgtttttgtttttttgagacaggagtcttgctctgtcgccctggctggagtgcagtggcgctatctcggctcactgcaacctctgcctcccgggttcaagcgattctcctgcctcagcctcccgagtagctgggattacaggcgcccaccaccacccccgactaatttttgtatttttaggagagaccggtttcaccatgttggccaggctggtctcaaactcctgacctcatgatccgcccacctcggcctcccaaagtgctgggattacaggtgtgagccaccacgcccggcctatcctgttgtttatacaagctgtcttatctagtagtgctgagtcaccattatatttattgcctacacctgcttattacaagaagcttccgaattcctgccttgggaacagagttctgtgactcgggaaactgaattttatagtctcgaccagctaaaccagacaatgagtcccaaatttttcagcactataacaaccaaacatttttagatttttgtgaatttcctctcccttctttttctttttttaaattcaactttcattttgaaaactttttttttttttttttgagacagagtttcactcttgttgctcaggctgtagtgcaatggcgcaatctcagcttcactgcaacctccacctcctgggttcaagcgattctcctgccacagcctcccgaatagttgggattacaggtgcctgccaccacgcacagctaattttttgtagttttagtagagaggggctttcaccatgttggccaggctgctcttgaatgcctgacctcgggtgatccacccacctctgcctctcaaagttctgggattacaggtgtaagccaccgtgcccagccaaaactttctttttgagacagagtttcacttttgttgcccaggctggagtgcaattgtgtgatcttggctcactgcaacctctgtctcccgagttcaagtgattctcctgcctcagcctcctgagtagctgggattacagatgcccgccactatgcccagctaatttttgtatgtttagtagagatgggtttcgccatgttggccaggctggtcttgaactcctgacctcaggtgatccacctgcctctgcctcccagagtgctgggataagaggcgtgcgccaccacacccagctgaaaaacttttgtagagaatgttttgataacctttgatcacttgccatatcccagggtggtgtgaaactagcatttaaaaacattaacgtacgtttaatacttgttcttggccttcattacttaaatttaaaagtttaatacatcattgttatacagtctgtaaatattaattagcctacttgtattctgagttattttaatatttgcttgattgcaggaaatcttcaccgaaccagcagtgttcctgagtatgtctacaacctacacttggttgaaaatgattttgttggaggccgttcccctgttcctaaaacctatgacatgctaaaggtaggatatcaaagaatgtaaccctagtgatcagattactaccatgaaaatattttcaaacttcctaagattatttttgagtgtttacttttcccaagtattatcatttcctaaatgagttttgagaaaattgatatttatgaggataccatggaaaactagggatgtgaaacattcttacatcctagtgcaaataaatatgactcaagtcaaccaagtcttattttcaaaaagcctttacccagaaaggggcaaacttctcgtcatctgattcagagaaacggacatgttgggtaatagtcccagagtaattagtcctcagcaaagttgaaatttgatttatgccccctttaaactttatttctctcatgtgcaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggtaagtcccctcctgactctgcagttcagtcattgccagcacattctgttcccacagccctgacagcatgagctggcacttctggggcttgagagaagggcttccagagataagtgattaaaataatgacttttcaggcagctgcctaattgacagatcagcctatttacctcagggacaggggccaagctacctgctcacatggcagctttgtatggaaatgtgacatttagtccatctgttccagattagatgctggctgaagggaccctacccctcagccatatgaaaatctgctctaaactccaaagtaggccaagaattggagaattgcatgcgtattttcttcatcatcccatgaaataaaaggaaaaaatgcttattcttagcacgaatgccatttggataactatgactgtaaaaagagctaaggaaagatggctgacttctagatgtcttttttcttcctttggtacttggtaccttttagatttctagtgtcagtgatttgaaggggtattcttttggcagtattaaattattaaaataactgaatttttaagtcattcctttccattcctatttactttatagcttgactaatttagtgtttggaacttaacccttattcaagtttaatgcctgatcacaaattttataaactgtgcacgttactaagagaaagattgagaaatggatggctgattagatcagtaactcctgcaataatgatctaacatcattaggctaaaacattagatatgttattgtcatttgattgctaaagttgtctaatgatagttgttacctctaaacatcccttcaagtgaaattgtacagcatgctcactgaccaggtagcatcattaataaactacttctcaaaatgatgagggctaatctaatcttaacacaggaaatattttttatgatgtaaaattcaccatgagatttctaacatttcttatagtaagcagaccttaggcaatatgagcatacttacaaagaggaaaaataagccgggagcagtggcccaggcctgtaatcccagcactttgggatgcccaggcgagcgaatcacttgagtttaggagttcaagaccagcctgggcaacatgatgaaaccccatatctacgagcaatacaaatattagctgggtgtggttgtgtgcacgtgtggtcctaactactcgagaggctgaggcgggaggattacttgagcccaggagatggaggttgcagtgagccaagatttgtgccactgcactccagcctggggaacacagtgagaccttgtctcaaaaaaaaaaagagaaagtgtatcaggtcattgtttatggaggaaaaagctgataaaggcttttaaacaggtaattcaaaatttatggaatgcctaccatagcctaggatttgtgatagccacagttttagcaaaatgattttaacagtaacaaaattattatctgacatcctccaacaactggcattctctccctccatctctgtgtcccttgcttcttgaaccaccctgtcacttcccagtctctcgtcaacccactgcaatatgatttcagtcccctccattccacctaaacagtctcctgacaaatgtagcaatgatggccttatctgctacatcctaagcagacactatattgagtaatataagcactgcttatattactcaacctgtgggtggtgtttgagacaccatgaaattctctcatcccttggttttcagggcaccagcttcccctggttttccactcacctctccagccattctttgttagtgttctctgcgtgctccctttctgcctgctcaaagaaggcatcttcagtaacccttctattccaagtcttgatgctcttccagagaggctctgtgtacctcacttttatccttatggttctcaaagttttgtctgcaattccatccttgatgccaaattctggacctatatgaaaatgtaacaacctcctggaaatttcacactcagtatatcctaaactaaactcatcatctccctatcctcaacttccacccatctcctcctgctgtagtctactattttcaaacctggaagtcattcttatcttctccctctgtagtcacctatcaccaagccatatttttccttctatgatgggtcttgaatttttacccttctttccatttccattacacagggctctctgcctctggtcttgctcagtcagaaccgttctctaggactgtcagaattatctttccacatgtgattgtttataacccttccataattccactaagtgttcatgcttttaggcatgacctacaagccccattgtgttttcagctctgcttatcacttcagcctcttctccttctactcttctctgccattcatcaccaccatccccaaacatacccacataccaatacccaaaccacctggaacctctttactttccttaatgcaagatatttatccatattcattctctctctctttccttcttttcccccactccacacctttacatatgcagctctacttttgtctgactacttataattctggatttagctcagataccacctattttctgaccacttccttcccagtctagcttaggtgccccagatagcagccttgtgtgagtgtctctatcagaaaaatatattgtggctattcatttgcttatctgttctccctctggactttgagatttttgtgaatgctcaatcatctttatattctcagcaccctaaaatggaagtaggcctatagtaggcactgtataaatatatgatgaggccagcacagtggctcacatctgtaatcctagcactttgggaggcccaggctggaggatcgcttgagcccaggagtttgagaccagcttgggcaaaatagggagaccccgagaccccacttctattaaagataaacaacttagcctggcgtgatagtgcccacctgtggtcccagctactccggaggctgaagtgggaggattgcttgagccagggaggttgaggctacagtgagctgtgattgtgccactgtaccccagcctgggcaacagaatgagatcttctttcaaaaaataagtatatggtgaaagagtgaaggaattaaaggaaggagaaatgaaatataaattttactttttgccatctaggttcttttgttgctcaaattctagaagtattagtcatactatttttggattattgttttaatagacagggtaaattgtattataatatttaatcatatttccaagagtagaaggaacacttggggtcaagaaatttaaaaataatgagtaagaaatctcttcctgagatttccccaaattctagagagtagaaatcatagaaatcaactttttttctctgattatgaaaggaaaatttggctctctgtgaaaaggagagggagccagacgtattttgtgtaatgaggaagatagatgcccaaggtggtgcctgtgcctgtctgacctccccctttcctctgctgggctccacgcctcatttcagttccccaggctgctccctgggacacctgccctgagaccacacactgtgttctctttggtcccgcattgtcaaactttgtccagcccttttttgggggggatttaagtttttatgcctagtgaaactcccacatgtaaaggagtattctttcatatatgttgaatattaactggacaaaaccataaacctgcataatgacttaaggtattaaacaatggacctggctttccaaaagaagaatggctggttaaacagttactaatgcagctaaaaactgagacttggagtgtgagagagacaaactgatgaaaccgatgttctaaatcaaactgatgaaaaaggtttttaagaatcaccacaaaaaaaattatagatgaatttttctaaaaccatgatttatgaccagttggaggctgatggttctgcaaatgagtagtaggatcttcataggtccttcccagtaagcatcacaaaagatgaaaatgggccggacgcggtggctcacgcctgtaatcccagcactttacgaggccgaggtgggcggatcacttgaggtcaggagtttgagaccagcctggccaacatggtgaaaacccgtctctactaaaaatacaaaagttagccaggcatggtggtggatgcctgttatcccagctactcaggaggctgaggcaggaaaattgcttgaacccaggaggcggaggttgcaatgagctggtatcgtgccattgcattccagcctgggcgaaggagcaagactcagtctccaaaataataattaaataaataaaagatgaaaattgagtgagatgtatgatggtctaggagaggagcagtgaaaaataggatatatcatcaagtgctaggttgtgtgatacatattagtgtctacagaaatttaaagaacacaagagcagggccgggcatggtggctcacacctgtaatcccagcactttgggaggctgaggctggcagattgctggagcccaggaatttgaaaccagcctgggcaacatggcaaaaccccacttctacaaagtacaagaattagctgggcatggtggtgcatgcctgtagccccaactactcaggaggctgaggcaacagaatcacttgagcctgggaggtccaggctgcagtcagccatgatcgtgacactgcactccagcctgggcaacagagtgagaccctgtctcaaagcaaaacaaacaaaacccacaagagcatcgtgctctgggattagttgagggagactaagcagagagggtggatcttctctaggattgacagtcaaatttgtgaccaagagcactgcagagcagaaaacagatcatattgacttccctccacgtcctcttaattactacctgctttagttctttaatttttcatctctttcaactctaccttttttttccatttccatttttaacagcccagttcaaggcttttttgcctcagctgaaccttttatagtgccctcaacgctgtctctctttcaagaaacacatatccattccagagtcatctttccaaagcattgctttcatcctactttaaaatatttgtggggatttgcatttactgagcgtctgacaatacttgtaggagctatccattcatcattttatgtttgctttgccttcagaggtgtagccatattctaatatcaggggaaccagcctgggcagggctgtgttgttagttggcaggaatgctggctacggggagattacacacgcacacaagttactgggttgttttgttttgtttttttttgagacagactttcactcttgttgcccaggctggagtgcaatggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatagagacggggtctcattatattttccagactggtctcaaactcctgggctcaagtgatcctcctgtctcggccttctaaagtgctgggattacagacatgagctaccttgcctggccttaaaaatgattttagcttggccaggcgcggtagctcacgcttctaatcccagcactttgggaggcccaggcgggcggatcacaagatcaggagatcaagatcatcctggctaacaaggtgaaaccccgtctctactaaaaatacaaaaaaattagcccggcgtggtggcgggcacctgtaatcccagctactcgggaggctgaggcaggagaatggcatgaacccgggaggcggagcttgcagagagccgagatcgcgccactgcactccagcctgggtgacagagcaagactctgtttcaaaaaaaaaaaaaaaaaaaaattagccgggtatggtggcgtgcacctgtagtcccagctattcagaaggctgaagtgggaggatcgcttgagcccaggaggttgaggttatggtgagctatgatcacatcactgcactctcacacctgaaacagaataggactgtctctctaaaaaaagaagaacaagaagaaatgaagatacttgaattgagtcttgaagaatgggtgagaattaggtagtatgataagcttcctggaaaagtcaaagaaggtggcttgtgaagaaggtggcagtgtttagagaaggattaaaagcctggtgtgattggaggggtgtagtagatccaaggagggggaggaaaagaggttgaggatgacaggaaatggagtcagacttgggccagaatgtatgccgtgttatggagttggacttgatagatagtcaaacagaaagttgaccccctgacagctgtagtaaaccttgctgaggaagtcttcacttagtttaggaatttttttagtgataaagtgaaatcgcattggattgcctaagtgtgaacacagagcttctatgtgaatcatgttcaggaaaataaaggattagagtagtggaattatttgtgggtgttagagatgggaaattcaaactttcctgagtcatgtatggcttatgaaatggattaatggctcaatctttttttaaaaaaaaagctgcataacagaaggctgttcttatgaatgatctttcatcagttaaaacaaccgtgatggctggcaaagactttgccattgagcttgagactagacttacagagttttgacttctctgtaaaggcctcagtccatgaatgtaaaatattcccatctcctttaaaaggtgtaatatcctctaatattagataaaaatattagataaaagtgactcaaattctagttttagtggtaatagcctgcattttttttttactaattataattgactcatgaggcacattaaaaatatgagatcattatataattctcagtatagatgccagagattttctgcttcacttttaataccctttatacttatgaggtaacccttctgtgtttgaacacgtgtttcagaagcagggggtattagtttttggtcatgaggcgcattactccttatcaccccacctgcaccgcccccacccacacacaggcacacccttcataaggctgtacacactaacacctgtacacatgtgcatgtattcatgggttagcctaatagaaaagagtatttactcactatgcttgctagtagatattggaaaactccttctcaggatgtctccagtgtctggaatgaatgtgtctggaatgttacctggaatgaatcaggtataaccctctttgaagccaaagaacactcctaaattacctttaaagcatgtctttagtcattattttgtttgtttgtttttgaaacagagtctcactctgttgctcagggtggagtgcagtggtgtgaccaaggctcattgcagccttgacctcccaagctcaagcgatcctcccacctcagccttccaagtagctgggtctacaggcacatgccaccacacccagctgattttgtttgtctgtttgttttttgtaaagacagggtctcactatgttgccagggctggtcttgaattcctggactcaggcaatcctcctgccttgccctcgcaaagtgctgggattacagatgtgagccaccgtgcccagcctagaaataatttttaatttctgtaaacagatttcttttggattcttttaaaagtcttattgtgcctttaaagttgcttttataagatgtaagaatcataggatacatatttatcttttttctttcttttttttttttttgagatgcagtctcgtttttcctcctagactggagtgaagtggcactatctctgctcactgaaatctccacctcctgggttcaagtgattctcctgcctcagcctcctgagtattacagtattacacctgagattacaggtgtataccaccacacccagctaattttttttatttttagtagagatagggtttcaccatgttggccaggctggtcttgaactcctgacctcaagtgatccgcccacctcagcctcatatttatttttaaaagttcagcttctttctttggtatatggtataattcaatcgaatgacatcgtccaatgtcttctatctgatcaaagctgaagaatttctatccagtagtccctctgccttgtgatcttgggtgctgatttttcttttggctgaagaaaagccaaggttcagatgttctagtgcttcccagtattcgctgagtcgtctctggaggaccaggttggtaggcaggaggagggaggtttggaatctggctgaatctgtgcctgtttgtctaggaatgcagacatggagatgactctggagcgagcagtgagtatgctcgaggcagaccacatgctgccatccaggatttctgctgcagctactttcatacagcacgagtgcttccagaaatctgaagctcggaagagggtgagtgtcatcttcagtccattgcaaagcgcaacacactttcacttctattatggtgactttgcacactgaaaccaataatttatttaaatttttaaaaattgggaccgtgcgtggtggttcacgcctatattcccagcactttgggaggccgaggcaggtggatcacaaggtcaagaatttgaggccaacctggccaacatggtggaacccctgtctctactaaaaatacaaaaattagttgggtgcagtggcaggtacctgtaatcccagctactcgagaggctgaggcaggagaatcacttgaagccagaaggcggaggttgcggtgaactgagttcgcgccactgcactccagcctgggtgacagaacaagactccatctcagaaaaaaaagaaaagaaaaaatcaaccgggtgcagtggctcacgcctgtaatcccagcactttgggaggccaaggtgggcagatcacttgaggcaaggagttcaagaccagcctggccaaatgatgaaaccccaactctactaaaaaaaaatacaaaaattagccatgtgtggtggcacatgcctgtaaccccagctacttgggaggctgaggcaggagaattgcttgaacccgggaggcagaggctgcagtgagccaagattgcaccactgcactccagcctgggcgacagagcgagactcatcctgaagaagaaaaaacaaacaaaaacttaattgaggtcttttactttaaaagaaaacagccactcattaccaaaaatatttcctgcaattcggaaatgtagaaagtaagtcactacacaaatttccctcttcttttcctgtctccccaacctctccatttagaaccatccccagaggcaagggttttgcaactttttttcattcagtgattccattaacatttgtaacaattgttcaatgaattgctttgtgcatatatgttttgacacttctgttcctgtaggacagatcctcagagatggaatcaatatgttattttatatttgtcttaaaaagtgatacatttgtgagggaggaggaatcacagctcaaaaaggtgttcagtgaaaagtaagtctcttctactccaaactccagcctatatattctctctgttctgtctctttcaatctctctcacacacaaacacatatatcaatttttttatctttccagagatattttatacacgaagaaacaattgttgaaacagttgattgagtttcctttttaaaacatgaaatcataaatgataacttactacttataatactttatttttttataccgtatcttggaaatcttcaatatgtattaatcttactcattcttttaagatgctgcatagatttctgttgtctaaatgtatcagttttgttggttgattttttaactaccttattgaggtacaatctgacatagttttgacaggtttgacactaaaaccatcatcacaatcaagataacaaatatatccattacctccagcgttttcttgtgcccctgtgtaatccatataatccctccagccctcaacctacgaacagcctcccaaaacaaccagtgatctgctttctttctatgttttgagacagggtctcactgtgtcgcttaggctggagagcagtggtgtgatcacagctcactgcagcctcaactttctgggctcaagcaatcctcccaccccagcctcctgggtagctgggaccataggcgcacacaaccatgcccagctaatttttgtattttttgtagagatgggggtctcactatgttacccaggctggtctggaacacctggctcaagcagtcctccttcctcggcctctcaaagttctggggttacaggcgtgagccaccatgctcagccatgatctggtttctgtcactatagattgaattttctcgaattttatataaatggaatcatatagaatataagatttttttggtttgaattattttactcagagtaagtcttttgagattcacccatttcgtgttaatcagaagttttggctattacaaataaagctaccgtgaacatttgtatacaagtcttcatgtagacatgtgcttttatttctcttcagtaaatacctaggagtaaatgcctggatggtatggtaggtgtatgtttgactttttaagaaactgctaaaccattttacaaagtagctgtgccatttcacattcccactcacaatttatgagagttccagttcctcctcatcttaacatttgatatagtgagccttaatgttagcctgtaagtttgtacaggtgttttactgtggttttaatttgcatttccccaatgacaaaggggttgaactttttttttttttttttttttttttttttgagaaaggatctgcctctgttgcccaggctggagtgcagtggcacaattttggctcattgcaacctccacctctcgggctcaagtgatcttcccacctcagcctcccaagtagctgggcctaccggtgcactaccacaccttgctaatttttgtattttttgtagagatggggtttcaccatgttgcccaagctggtctccaactcccaagttcaaaggagccagctaccttggcctcccaaagtgatgggattacaggcatgagccaccacacccagccagaacatctctttatgtgtttatttgccacttacatatcttctttagtgaaatgtgtattcaattcttttgcccattttgttttgttttgttttcttattattgaattttgtaagttttttaatattttctgtatacaagaccttttctagatatataatatgaaaatattttctcccagttgtgctctgttttttcattctcctaataggttttcattttaatgggatttaatttattcagttttttccctttatggtttctgcttttcatgtgtatccaagaaatgtttctctattcaaaagttagaagataatctatattttatcctagaagttttgtaaatgttatatattttagttgttctatggtccatttgtggttaattttttatatattgtaagatgtggactgaagttcctttttttggtatatgtaaatttaattgttcaggtgtcatttgttgcaaagacttttatttcactgctaaattgtctttgtatctttgctgaaaaggaattgatcaaatatgtgagtctatttctggactgtgtattctgttctattgatctatttgtctttttttttttgagacggagtcactctgttccagacaggaatgcagtggcgcaatcttgcctcactgcagcctctgcctcccgggttcaagctattctcctgcctcagcctcccaagtagctgggattataggcatgtgtcaccatacatggctaatttttgtattttttttttagtggagtcgaggtttcatcatgttggccaggctggtcttgaacttcttgcctcaagtgatctgcccaccttggcctcccaaagtgctgggattacaggcataagccactgcacccagccgattttttttttttttttttttctgagatggagtcttgctctgtcactcatgctggagtgcagtggcatgatcttggctcactgcaacctccgccttctggcttcaagtgattctcctgcctcagccttctgaagagctgggattacaggcaactgccaccacacccggctaatttttgtatttttggtagagacaggatttcaccatgttggctaggctggtctccaactcctgacctcaagtgatccactcacctcagcctcccaaagtgctgggattacaggtgtgagccaccacacccagcctgtaagattatttttgaatgtttactattcccaagtattatttcctaaatgaattttgagaaaattgattttttgaggataccatggaaaactggggatgtgaaacattcttacgtcctagtgcaaataaatatgactcaagtcaaccacatcctactttcaaaaagccttcacccagaaaggggccaacttctcatcatctgattcagagaaacagacatgttagataataatcccagagtaattagtcttcagcaaagatgaagactatttgtctgtcttattcaaattccacagtcttgattactatcgttttataagtctcaaaagtaggtaatgttagtccatccattttattctttttcaaagttttgtctattctacaacttcagcagttccatttgaagtttagaatcagcttgtcaatttcttaaaaaataattgctgggattttgttagagattgcactgaatctgtagatcaatatggagagaattgacatcttaacaatattgagtcttgtgacccatgaccatggtacatgttaacatctatttaggtcttcagtttttctcagcagagttttatagtttttactgtagaggtctttcatgtcttttcttagatttatccctaagtttatcatatttccagatgctattataaatggtactttttaatttctatttttggttgttcattgctagtatatagaatagataatatatatataatatatatatttacgtgtgtatgtgtgtgtgtgtgtgtgtgtgtgtgtatgtgtatagtacttgctagaacctctcctacaatcttgaaaagaagtggtgagcgtgggcatattatcctgtttctgatcccagggcaaaagtattcagtctttctttcacccttaaatattatgctacctgtaggttttttataaatgaccatatcaagttgaagaacttcccttctactcctgctttaatggagtttttgaatcacgaatggatgttggatttagtcagatgctttttatgcatttattgaaatatttttatggtttttaattttaattttgccattatggtaaattaccttgattgattttaaaatggtattccattcataaaccccacctggttatgatgtactgtcactttgtaggttttatgactagatttgctaaaatcttgttaagaaattttacgtctgtgtaaaagacatgatctgtacttttagtgtctgtctgattttgagttgtgggtaatactagtctcatagaatgaactgggaagtattcccttcttttcagttttttgaaagagtttggttagaaatggtattatttcttccttaaatgtttggtagacttcagcagtgaagacgtctcagcctgaagatttttatgtgtgagaaggttcttagctgcaaattcagtttcttgaactgctgtggggctgtttagactatcagtggcttttttagtgagctttggtaatttgtgtctttcaagggagtctttcaagggatttgtccatttgatctaagttgctccagtgctctttatttgtttgtgtagatagtgtgatcctttacctttacctgaaaatttttattttgttttgttttttacgaatccacttttatttattattgtttcattagtttaaatccttgaggggtacagcatcactcggactctgtgtccaatagctctagcaggaagattgcttcggaatttggcacaaaccatgccactgtgttcatgcgcccaagttacctttccccagattactctggttttgtttggtttgctgccaggagtcaccgtgttgttctttgctttgtatacataaggacatctcttgcccaagtagaattctgtttcatctcgggcataaacacctttaattttaagaagagatgtgttcccttttgttctggagaccgcacttatagccagcaaaaatggcctcggactacagactgctttccagtcgtatttccatttagaacatttagaagtcccgttcctagccggtctccacaggatccaagatggcgaggcaagaatacttctttatttctttctttatttctttatgagacagagtctcactctgtcacccaggctggaatgcagtggcgcgatcttagctcactgcaacctccacctttcgtgttcatgcaattctcctgactcaacctcccgaatagctggaattacaggtgcccgccactatgcccggctaatttttgtatttttagtagaggtagggttttgccatgttggccagtctggtctttcactcctgacctcaagggatccacccgcctctcaaagtgatccacttgggtcctcctgaagtgatctacctcccaaagtgcagggattagaggtgtgagccaccgtgcccagatgatctgaagaattttcttttcttttcttttctttttgagacggagtttcgctcttgttgcccaggctggagtgcaatggcacgatcttggctcactgcaacctccacctcctgggttcaagcgattctcctgcgtcagcctcccgagtagctgggattacaggcatgcgccaccatgcccggctaatttgtatttttagtagagatggggtttctccatgttggtcaggctggtctcaaactcccgacttcaggtgatccacctgccttggcctcccaaagtgctgggattgcaggtgtgagccaccatgcctggcctacctgaagaattttttttaaatatttattttagttcatcaccagcaaacctgcattatttcagcttctgtatgtctgaaaaagaatttcatctttgcttttgaaaggtattttcactggctttagaattccaggttaacagtttctaaatattagtactgaaagttggccacggcgtggtggctcacgcctgtaatcccagccctttggaggactgaggcgggcagatcacttgaggccaggagttcaagaccggcctgggcaacatggtaaaaccctgtctctactaaaaatacaaaattagccaggtgtggtggcgggtgnnnnnnnnnnnnnnnnnnnnnnnnnnnnnnnnnnnnnnnnnnnnnnnnnnnnnnnnnnnnaggcgaaggttgcagtaagctgagatcacaccactgcactccagcctgggcaacagagtgagactctctctctgtctcaaagaaagaaagaaagttgctccactgtcttctcacttgcatcacttgcattgttttagataagaaatctcctgtcatccttatctttcttcctccatacatgagtcttttcttcccacctctggctgcttttaagattttctctttcttactggtgttgatcagtttggtcacatgtgctttagtgtagtttctcttagttttttgtgcttgggagttcactgagcttcatagatttgtgaatttctactttgcatcaaaattagaaaattttcacagtttttctattcctcctttgggaactacaattacatacacgttaggcttctttagatctttcttttttagtcttctttctctgtgtttttagataagttcaattcctatgctttacatttgctaatctcttaatatgtgtttaatatgccattaatacattaatgtgtttaatatgccattaatcttactcagtgtattttttcttcatacattgtagttttcatctctaaaatttagatttcagtgtttttatgtcttctatgtttctatttaacatgttctatctttgctcaagatttttgaacatatggaagacagataaaattgctaccttaatgtccttgtctgctaattctaatatctgtgtctattctaggtagcttttgattgattggtttttctccatattatgggtcatatttttcttcttctttgcatgcctggcagtttttattggctcctaggcattgtgaattttatcttgttggatgctggatatttttgtaaatattcttgagctttgttctgggtgcagttaaggtgcttggaaacagtttgatcctttcaaattctgctttgtttgtttgtttgtttgtttgttttgagacagagtcttgctctgtcacccaggctggagtgcagtggtacaatctcagctcactgcaacctccacctcccgagttcaagtgattctcttgcctcagcctcccaagtagctgggattacaggcgcatgccaccatgcccggctaatttttgtatttttagtagagatggggtttcaccatgctggccaggctggtctcaaactcctgacctcgtgatctgtccaccttggcctcccaaagtgctgggactacaggcatgcaccaccgcgcccagaccaaattctactttttaaaaaaaattttacttgaagctttgggatacatgtgcagtgtgcatttgttatataggtatacatgtgccatggtggtttgctgcatctatcaacctgtcatctaggttttaagccccgcgtgcattaggtatttgtcctaatgctttccctctccttgccctcaaattctacttttaagatttgttaagtggaaccagagcagcatttattctagagataattaatccctgcttcttaaggcaagacacttctgagaactctatctaatgtagcaggaatttttgagatttttctggctggctgataagaatagtcattgttcctaggcctgtgtgaacatgaggagctgttcccttaaatccttttggatgattatttccctggcctcagacagtttcctcataccacatgtactaattaatactctactgaatactagcaggcaggtcctctgcacatctcaggagttctgtttctgttcagctcttttctctgtggtactcttttctgcaaaaattagctcctttggtcttctcaaactctgagctctgtgccctcaactctgttgagtttcacttaagttttctctcactgccccatagcctgggaactctcccaaggcagtgatatctaagggatcgctatccatcatttactcattttcagttattgaaaccattgtatgttttgtccaatttttgtttcaggcagtaagttgagttgttagttactatcgagtcatttttaattttgataaataactccccaataagtcctcccaaaaattgtacaaatttacactcccatcaacattttatcagagtgttcatttccatgtaccattactaccacaaggtattattcttttgtttgtttttgttaatctgataagcaaaaataggcatttcattatcatagaaattttcttatatttgaaatcaagactaatagttgtccaatcaaacagttattgagggccaggtatagtggctcatacctgtaatcccagaactttgggaggccaaggcaggcagatgacctgaggtcaagagttcaagaccagcctggccaccatggtgaaaccccatctgtgctaaaaatacaagaattaactggcatggtggcatgcacctgtagtcccagctactcagaaggcagaagcaggaggatagcttgaacccagggggcagaggttgcagtgagccaagatcatgccagtgtacttcagcctgggcaacagagagagactctgtcacacacacacacacaaaaaaaaaagttactgagaaaaatattttttaaaatgataaaataaacgcttttatagaatttatcatcatcttgcatgcataaactatgcccattataaatcatctgccatttttagtttaagtttaaagtggaatgagaacttaatggaactaattcatctgagttcaaatcctagtctcttacattaattctatccatcactaattacagagctctcttaagcttttcacctttatctagtctttccaaagcatcaaattaattttcagagaaataagtactctttctatacttatatttcatccatttatagaataggtaagtaaattacataattataacaaatacaattgacataaataccctgggaagcaaacctaaattactgttggtaaacatgtaactcaactggtagaaatagaagtgcaaaggctcaaatagagtaacctaccagctttgatagtactctgagaatcaaggaggtttcacagagggaaaagagaatgttgttggttagccttgcaggtcagtcaagtaaggatcacacaacagagcttctgctgatttttttttcacttgaattcattaattattcatgaagttgagcaccttttggtgtggtttttgactttgtatttcttcagtgaattgtcatttttaatccattgtgtattttttctactaagatatatctctttcttaatgacttacagttctttacctattacacatattaatttgttgttacatatgtggcaaatagtttctcctgctttatttttgttgttgtttttaactttgttttttgtatctttcatcatgcaggattttaaaattcttatgagatcaaactaaatatttttcatctcgatgtctatattttagatattgctttaaaagacctatccctacatctagactttgccgtttcaaaagttgtataattatggagcatttctcactgaccctttgcctatttgttccgtaggaagaatgaataaggattttagaagacatttagctagtgatgaacattctttatacatataggtgaagggaatggggctgaatattgatcctttaatagctagtcagagataaatctttaaatctttttttattcctggttttttggggcgttttgtttgtttgtttgagacagggtgttgttctgttgcccaggctggagtgcagtggtgtgatcatggctcactgcagccttgacctctgggggtcattcctcccaccggagcctcccaagtagctgggaccacaggcatggactcgcctggcttttatatatatttatatatatatatatataaatataaaatatatataaatatatatatatatatatatatatatatatatttttttttttttttttttttgtagagatggggtctccctgtgttcccagggctggtcacaaacccctgggctcaagcagtcttctcacctcagcctctcaaagtgctggcgttataggcgtgagccaccacaccagggcctattcccagtttttaaaaactgggcatcattacgtatgcttcgattttgtagtacaaattactggaatttttattctgtttcccaagttgggctagatttctactatctcttaaattactaatttgattaaaaatatcattttgcttatacataggattgaagttgtttgctggcttgactgtcactcagagataaaggtagaacaaagactggttttgagaatgatgaaacatgaaaattatatgcaaacctaaaaatgtatatgcttcatagaaaatctaagaagtataatatcacaacccaagaacatttgaaaaatccttcttaggttaaacatggtgctatagtttttaaatgtatgtataagagaaaattataatttggacatagagatcaaaattttaaatcataatacttttaaaaccagtagcagcttttcagtcctcattttgtttgattaggattcttggtatttgacgctgttgatctctctctctctctcttttttctttttttttgagacatgttctcactctgttgcccaggctggagtgcagtagcactatcatggctcactgcagcctcaaccttctgagctcaagcagtcctcctctctcagcctcccgagtagctgagactacaggtgcatgccactatgcccagctaatttttaaacattttttgtgcagatgggatctccctgcattgcccaggctggtctcaaactcctgggcttaagcagtcttcccaccttggcctcccaaagtgctaggattacagacatgagctgttgcgcctggcctgaacatattatcttcttttgcttttcttctctactctccaaccctccctctgtcctgttgggctgggaggcaggacattggtggtttaatcatggactctgaagagtcactgctagctgagtttgaatcccagcaccctaattacataggtgcccttgggcaagatattttacttctctgagcttcagctttcttacctataaagtagaaatagttctcctaccaagagttgtcctgagaatgcagtcagataatggtgcactgcctgccacaaggcaataactccgggcaaattgttccctgtcagtgaacggtaggagggtggttcacccaggtaatttcacaccaaaacgtgaacactctttgaatcttcttttttttttttttaattatactttaagttctagggtacatgtgcacaacgtgcaggtttgttacatatgtatacatatgccatgttagtgtgctgcacccattaactcgtcatttacattaggtatatctcctaatgctatccctcccctttcccccttccccatgacaggccccagtgtgtgatgttccccgtcctgtgtccatgtgttctcattgttcagttcccacctatgagtgagaacatggggtgaaccttcttttttccttacctctcatagtcagtcagtcttcaggtcctgttaatgctacttctaaaagtatttggaatctacccacatctttccctccctactcagagatactgtcttggtcccagcaccatcttctgttaatccagctgtctccagattaacatccctgtctccattcttatccattcctaatagtctcatgcttcacagcccccagggagacctttccaataactgcccccattgcctgcaggataaaagacaaatcccttaatttagtctgtaagacccttcttaacgtggtcttattttcatgcctgtttcatatctcatcactgaagtagtcactgccataagtatcttgcaaaaacttactataaaacaaattcaagtttttgataagaaatttgagaaattaaaaaacaaaaaaggaaatgcacccataatctcaccattatcattttggttttgttctctaatttttaatgcatatacttacatatcttcaatcaaattgcatatgtagctttctttgtccccacaaaaaaaaatttttatttcgatttttaaatcgaaataaatacaggctcattatttgaaaacatagaaaatggcagatcctatttatgattcatacatttaccacttctcccaaattccctaatctcatttcctttttgcctgtgtttatgagtagaaattcatagatattttcttccttttttttttttttttttttttgagatggagtctctctgtcgcccaggctggagtgcagaggcttgatctcggctcactgcaacctctgcctcccgggttcaagcaattcttctgcctcagcctccccagtagctgggattacaggcttgcgccaccacacccagctaattttttgtatttttagtagagacggggtttcactatgttggccaggctggtctcgaactcctgacctcaagtgatctgacctgcctcggccttccaaagtgctgggattacaggcgtgagccatcatgcccggccttattccattttttaaatgacatatgaatttttataacattaatattttataaatttcagttaacattgttaaaggtgatggtagttgctaccttgtgttgagtaactactgtgtgcctgacatgtaactgctcatcttacacagtaattcccatttgactaatgagggaactgtatggctaataaagtgtcagctctgcctctcccgtggatacctcaacatgtgggtatgtgacaaccatcaaccagtcttcccccattgctggatgttaatggtttcttattttctgctattacaaaagatgtagtcactatttttgcatgttagtctgtgtcttcatttcacattgtttcccaataaaagttactagaagtgaatattttaaaagttttgacacatattgccacttgccttcctgaaagattatgccagtttacagggagtgattaattctaatgggagggaaagcagagaaaggagtgacatttcatagaggaggtgacatttgagctggatcccacaggatgagtagggctttgccagaagagaggcagagtggactgaaccttccagacaggaggaggaagcaagagcaaaggctccaggtctggagagagcctttgcctcagcagaggctgtgtgttccctatgcttatttgcaaccagaagtcctcgtcatttacttattttataattggcagggaagatagaataaagccacagagagagttaaaattctcatatgtgactctgccctttcatgtatttagaaaccaactcaaatgagaacttctttgaagttctgaaacattcatggtagtctatttcttttttccttttcccaaaggagggaaaaataccccgaggattcagtataattgggaaactcatcaaacctccctggttccagctgcttccctgaacgttaagggacaatagcagcatatttgacattggtcctaatgtggataggattcatcacctaccatcttctagttacatgcaaggagaaggtcattaactttttgcatttagcaggatttatatccatttgcttgataaaatggatgaaagtaactaaaatctatttttaagcttgggataagtgccagacactagggagtcaagttatacagtaagtagagctgtagccggatttcggcctttatctaagcactggtatgtctgtagttctctctttccgggctagagcaagtgctgaaagccaaggtgataaaggtgacagggtaagggagcaggtctgagctggggaggcttccgtatgccacttcttactaattctatcattgcagcttgaaatgcaatatggccagtaagccatttcccatcatattttgaagaaagcaacttataaattatgaattaagttaataaaatatttctaaagctgccaaagtacctcaggacaaataggattttttttgcatctgatatatatactgctactgggaggatttggtatatctggcattcatgaagcttataaagtgtgaatgtatattatgaacttatattttcttaaaaacctaaaaacaggcactgtgccacagtagcagaataacagatcgtacccagaagacacgggtatatatcccacagtgctattttgccagtcaaggcctttctttctgtagtttaacttattaaaaggaggaagccagctgggcgcggtggctcacgcctgtaatcccaacactttgggagcctgaggccggcagatcacctgaggttgggagttcgagaccagcctggccaacatggcaaaaccccatctccactaagaatacaaaaattagctgggcatggtagggcgcgcctgtaatccctgcaattagggaggctgagtgagacaggagaattgcttgaacccagggggcggagattgcagtgagccaagatcgtgtcactgcactccaacctgagcgacagagcgagactccgtctcaaaaaaaaaaaaaaaagtatgaatttaccttaaaaccttaccatgaaataaaaattagggaattagggaaacgtgaattacaggttgttttaacataaattgtgtattttggttttttttttttttttttcgtttaaggaaatgtaatacaggttaagtatcacttatccaaaatgcttgagaccaggagtattttgaatttagggtttttcaaattttggaatattcgcattacattggttgagcattcctaatccaaaaatccaagatctgaattactcccttggagcattatgttagcattcaaaaagtttcagattttgaagtatttcagatttcagattttcagataagggatacttagcctgtaataggaatagatgaagtgatgaaataatctgttggaccagatttacttgacagctaagaaatattttttttgagatggagtctcacactgttgcccgagctagagtgcagtggtgccatttctgctcactgcaagctccacctcctgggttcaagcaaatctcctgcctcagcctcccaagtagctgggattacaggcacccaccaccatgcctggctaatttttttgtatttttagtagaaatggggtttcactatgttggccaggctggtctcgaactcctgacctcatgatccgcccaccttgacctgccaaagtgctgggattacaggcataagccaccgtgcccggccagtaagaaatctttatcatgcatttaaatggctttagacacagtccaacaaaattgctgtggccactctcccatctgtctcttgttctgcaaatgtctcctcagaagggagccagcaagtggaagtatttactccttattacgtccagtgaagccttaaaggaatcaagagtactttcttcttaaggttcttgcaatctattaattagataatgtatgtaaaactcctaacattatactgacgcttcttaatgttagaagtaggagggagaggagttgtaatttttgctttattatgatgactgtggttgttattgttgtggctattatttagattgttttacatttctgatgtttatttccgcctttctagtcttttctccaatcctgtcaaaggaatatgtaatattggagggctgtgtcctaaataccatttacctgtctatgaaagggaggctagaacttggtacatagaaaatatgcaaatctgcccctggccaggcgtgcagctctccgctgagcataaactgctggtagttagggtgtccttcctaagtgacaaacttcgtctgaaaggcaagttcatgcccgttcatgaaaacttatttcctcaaaatttcttcatgaagatagtgaaaatgagatctttaccaacagctcttggcaacttaaaagtttcaaaatcagatgtgaatggaagcctaagagaaggaaagccttcagtctacaacctaatgttttatttcaccaacgctgtgtctgatttctttagatcatattttccgactaaaacagaaaatctccctgcttagattaggattatttggccccttcttagatcaatttgtttcccattcctggttgtgccctttctctaatagcatgcgctttcttacgtatttggatagaaggaatattttttaaataacacatttaaaagtgtaaaattattttatctgcttaaagtgcttgcataagttttataagtcttttaaaatactccatgcaattggttataagaatttagggttagtggccgggcgcagtggctcacgcctgtaatcccagcactttgggaggccgaggcgggtggatcacaaggtcaggagatcgagaccatcccagctaacatggtgaaaccccatctctactaaaaatacaaaaaattagctgggcgtggtggcgggcgcctgtagtcccagctacccaggaggctgaggcgggagaatggtgtgaacctgggaggcggagcttgcagtgagccgacatcccgccactgcattccagcctgggtgacagagccagactgcatctcaaacaaaaaagaatttagggttagtttgcattactactgaggctgacatggtaaatgcatttttatttctgttaatgaaagtgatactattcattttatatggactataaagttttgtcttaggaaaaaacttacgtaattttggattatttaataaaaaaaactctccttactgcctagattcccaattcttttcatttttattatgctccaagcttttatcacttaactttgtttaactagtacctatgcaccctttatcacttaatcttccccttcaattatttcataggtttcagtcttaacttcccaaatgtactataagttccttgatgacagatactgccttatagccggggtatattctacaagagcctcagttgtgctacacatagttgttgatgaagaaaggttatagtcagcatcagtaaacttcatctgtttgtattacattgaatgccttgatgccacatcaaaattaatattagaaatatgcatctgcttcttccccaggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtagtgcttactgaacattgaagaacctaacacatttgcaccccagccagatgccttacatcatctctttttcttaagtttcctggagcaaatgattgatgggctcattgttatgctagagaaggctttaaaggaacattgttacctgctggcttagactccagatttgagccacattcgaattccttttttttttttttgagacagaatcttgctctatcacccaggctgaggtgcagtgactcaatctcagctcactgcaacctccgcctccagggttcaagcaattctgcctcagcttccctagtagctgggattacaggcatgtgctaccacacctggctaatttttgtatttttagtagagacgatgtttctactaaagtttagtttcaccatgttggccaggctggtctcgaactcctgaccttgtgatccgcccgcctcggcctcccaaagtgctgggattacaggcatgagccatgagccactgcgcccagcctgaattccttttttctaaaggggaaaatgttctgcggcttttgcttaatattcttaattagaaactctatgcacctttgactaaatgtctttaaaacaatttgacaagactcactgcaatgaaaattctgcttaaattcactaacagcccactttgtagtttaagaacgtgtaggatttcactgttatcctaggtgtcccaaactaaattttggtttctttctttctaaagaaaactgacaagaaccacacccagttgtttgtattatttactcaacaaccagcttgctggatctatagaaaatgaaatggagtgtcacatagttttccagtgtggaggatcaatgtaatcaaatattagaaactgttttttccaatctttccattatctggactcctctcagtaccacctccttagctcactgaaaccttaaagaagaaaagagtaactggatatgtttgtttttttaattctctacttcacatttttgttcaaatactgattggagcaaatgtctcctttttatgcaatgaattggagagatggactaatcagatagaattaaaacagcagtgttagtaatatgtcctctaagcatgaagagaaggggctactttcatttaaatgaacagtcgtatgataaaagagaagatgatttgttgatgttccagaataagcactctccctgccatcaccatcagctctccgcttgtgttccctgcacacagtacaaagagtacaggaggggctgggtgcagtagctcatgcctgtaatcccagcactttgggaggccaaggcaggaggattgcttgagcccaggagttcgagaccagcctggccaacatagtgggaccctgtctctatgaaaaataaagaattagccaggtgtgttagtggtgtgtgcctgtagtctcagctattcaggaggctgaggtgggaggattgcttgagcctaggaggctgaggctggtgcagtgagccatgattgcaccactgtactccagcctgggcaacagagtgagaccttatctcaaaaaaattaacaaagattgcaggaggcataactgagtgcaatcatcagtaaatttttgttaaatatcttcaatgtctcagcgatatacgtacattttctaatttaattatcacagaaaccttgggtttctaggtattatcaggtgctatatctcaattttacagatgaggaaaccaatgctcaaagaatatacatcatagaagaggtttttttttttttttttttaactgtgtaatagttgacagtgttctggtaaatacttttaacggaaatactccacaaatattgttttaaagtaaattgaatatattttgctcttctacctgcttcatttagttatataataggtttaatttttctataaagattttgtcattatgttatctctactcgctttatgtcttaaaatatcacattttaaaaaattcaacattcattttagatttggggttacgtgttcaagtgtgtcacatggatatattgtgtgatgctgaggtttgggatacgaatggtcctgtcacccaggtactcagcatagtacccaacagatagtttttcaacccttgcccccgtcctttcctccctcttttattcatctttaagtccatgtatacccaatgtttagctcccatttgtaagtgagaatatgtggtatttgattttttgtttttgcattaatttgcttaggataatgacctccagctgtatacatgttgctaaatatcacattttaaattctgatatattttaatgttataaaactatgtgaggtaccatgctactctctctattctctttttctttttgagacagagtcttgctctgttgcccaggctggagtgcagtggcatgatctcagctcactgcaacgtctggttccagggttcaagcaattctccctgcctcagtctcccaagtagctgggattacaggtgcccaccaccacgcccagctaattttttgtatttttagtagagacggggtttcgccacgttgatcaggctggtcttgagctcctgacctcaggcgatccgcctgcctccgcgtctcaaagtgctaggattacaagcgtgagccaccgcgccctaccagtaccatgctacgctcttgccagcattctgtcaggtcccatgagggatttcttttcatatccatgatttgtattcaaatgcctgtagaaattaaaagtgattccattcatttaaccaacatttacagagcagctttcaggggtcaggtactgagaatcacagcctagggacggtgtggatttggggtttttttgtttttgttttttttaaaggatggggatctcgctgtgctgcctgggctgttcttctgggctcatgagatcctcctgcctcagcctcctcagtagctgggactacagggacatgccactgcacccgcgttggattttgtttctccatctactagttttatagtcaggaaatacttcctgaaggggttatgtttcattgtggaccttaaaaaaggaataggctttggattggtgttttgaaagaggatgaaagttattcctggcaaagtgagcatcactagcaaggcaaagaggcagaaagaaactagctgccggtcatttagaggagacatggaaaatagcgtgatttggagttagggtgcctggtagttagaaagcttgggaagtgtgtgtgtgcttgcgtgcgtgtgtgtgtgtgtgtcaagggaacaagccattgaatcacgcttcctcttctcctgcataggcaataggagactaacgtcagagaacattctgtgatgttgatgccatgtgaaaccattcaggcatcattagatcatctatagagttgataaatggaagttgattgtgcagcacccaggatttctagtataagccaaacatccctactggagggtgttcattacatgctaattgaaccaaacagacatttgaacatctgatacaaatccttctaaattactccctttggctctactaatagaagagctaaataagggctttctgggcctcagaaataaattgttaacctaatatagacatgtttatatctttgtttagaaacacaaagaaagtaagtatatatgtgaatcttactggtctatttctttgaccttttttttttctgaacccctattatgtgttggtcactaagctaaggctttctgtttttttatccctatttctcctgacaactccgtaagaggtgaaagcataattggtgacttacatatgatcagtgtgagactcagaggggttaagtaaattgcccaaggttgcctaaatggtaaagaacaaagcccaggtttgaacctagttgtatctgagtgttttgctgtcaccccacctacttttgaggcacgtgatgactcatttgtatagtctttgagaaggggcttgtctttgagactcctctgatcagagagctcttcctcactcctctgacacccttcctctctcttcttttttttttttttttttgagaagaagtttcattcttgttacccaggctggagtgcaatggcgcagtcttggctcactgcaacctctgcctcccagattcaagcgattctcctgccttagcctcccaagtagctgggattacaggcatgcgccactatgcctggctaattttgtatttttagtagagatggaggtttctccatgttggtcaggctggtctcgaactcccgacctcaggtgatctgccggcctcagcctcccaaagtattgggattacaggcgtgagccactgtgctggcccctctgtcttcttgtctctgccttggttcaagctgtcttcatctctcgctctacttctgcagtagtagcctaggatcttctcttctaatgaaagaacttcaggatcaaagacacccccactccccccaccccggtgagattgttctttctcccttactaagtgagcgtggtagtgttcccgtaattgaaatgagaacggcacatcttagtctcagaagttcatcttcaaggtcactgagtagtgagcattggctggagtgagcagggatatgccttggattaaaacggacaagtcatgataagagtgcagcaggggttcttatccctctttcattacatatgaaagagtcagggtaattgtcagtgaaatgtgttaaaactgcatattaatccctgcatattttatagaagtacttaattggattgctgtatttaataaaatactcagaatgttttgctataaaatatttattatgcactttctttaagtaattgtatattattttattccgcattcgtaatgtgtaacaaggtaccctgggtttatatataacttggaatacgtggccgtttcaataatctgatattccagttaagatttgcaaaatttaggtgaaaggaggggtatatctatgcaagggaaattgtaaataaataaaaaaaaattcctcccactctttgaccactttgaaaaacacggttaaaaagaaccagttttctttcttgtccttgtccgagcggtcattgtcctcatctctgcctcctcattctttttcactgaagatagggatttatttaatcataaaacttgtaagttttgctgcctatgtgttaaggcagatttgttaaattactatattttctgtcctagaggtcattaatttttttattattatttttatttatttttttgagacggagtctcgctctgttgccgaggctggagtacagtggcatgatctcggctcactgcaagctccgcctcccgggttcacgccattctcctgcctcagcctcccaagtagatgggactacaggcacccgccaccacgcctggctaattttttttgtatttttagtagagacgagttttaccatgttagccaggatggtctcaatctcctgacctcgtgatccgcccccctcggcctcccagagtgctgggattacaggcatgagccaccgcgcccagccgaggtcattattatttaacatgagttgtaatatctaagctccctttactggttagctattttttacaaacatcacggttggcagtaaatttctggctaatggagttattgtctcttataattggtaattattctaattatatcccttaacagagtccagatccctttctttttggctagaatgagagcctcatggtagaaaattacaggcagacagaccatctgcaacaaagagctatactagtagacattaagacactatgaaaaaattgatcagaagttaaggatgagacacatgaaaacccaaaccgtaaatattatattaggtaatccagaatctgatcattgaagggacatctattcagaatcatctagtctattggtttcctcatgcccaaactggaatctttttttaaaatataagttcctgaactccatcctgagactctggctcagcaaatttggggcatggcccaagactgtgagtctgttttgtcactgggctcatttggaaactgctcatctagtctaacactttaatttcagggtaaaagccctcatctactttctgataagagataagctaatttttattccctctagtgatagagctgggtcttacaagtagttctttctgttttcttcaaagctctcttagaagtttatactttcagtgagccaaaatctccttctttagaatttccactcatcggttctggttttgcctcctctagtcatggaaaatgatatctagttgtttaaatttgtatttctttagttactagagaacatggattcctgtgtacattagctcctaatatcagttggttttgtgttatgtaccttcccaatttttctactggtgtttcgctttttagtgatttataaaaattctatatattaagagtattaaacttttatctcatattgtacatattttcccagtttgtagttggttactcactgattttgtgtgagggtatgtgtgtatgagcatatgtaattctgaatctctattgaacatcttagttctttcacagctttcatgccacccagaaatttgacaggcatgacatttctatgcaaaatcctatattagaaattctaaaattatgctgaaacttccaaaatcatatacttttgtagaaataatggagcatggcaagctctaaaggatattgactgttgaaggaaaattccactccctttgttccaattaatcctctctggtttttattgtaaggtgtactttttctttgagtgtcctgtgtggtcctttttaaaaggaggaaatgtcattatgcttcacattcttaagcttctggcaggcagagactattaatttgtttgcttatttaggactaaagaagcttttgttttttttcttcatttctctcttctttctaacttgcttttgtagcttagtaaccaaaactcagcctcagacttgtctttaaattgttttcaaccaccttctgagttttatctgtccctcttccagggcctcttaaggagaagcaggaggaatgaagtcattgtattgcaaaacctgtggctgagggacactgctccttaaccccaaatgctagtttgatcaggaaaatacctcctcataagccagaaatctagtcctcacaagacaccagacacagtgtcactgtatctaatggaagctctgtgtaggctccagtggaaatctggttacagtttcaaaaagtagctacctgtgcacagcagaagcaaactgtttaagcccaaaagactgcatgaagcctaatgtgttctaattggttggaccaaatataagtatgctgagtaattaccaagctttaactatacaggctcttatttcaggggaggtgatgtttgccacatagttcagccaagtctgccacatttgctgtgttcataaaggagcctgccctgagtacctatgcttcctctttcctttgtacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtgagacccctgtctctactcaaaatacaaaaaaattagccgggtgtcgtggtctgcgcctgtaatcccagctactcaggagactgaggcaggagaatcacttgaacccgggaggcagaagttgcagtgagccaagattgtgccactacactccagcctaggttaccgagtgagactctgtctcaaaaaaaaaaaagtaggaattgctgggccaggcacagtggctcacgcctgtaatctcagcactttgggaggccgaggtgggcggatcaccaggtcaagggttcgagaccagcctggccaacatggtgaaaccccgtctctactgagaatacaaaaattagccaggcatggtggtgtgtgcctgtaatcccagctactcgggaagctgaggcaggagaattgcttgaacctgggaggcagaggttgcaggtagccgagattgcgccaccgcacttcagccttggcaacaaagcagtactccatctcgggggagaaaaaagaagtaggaattgttgcctgggcagtgagaaggatagggtagaaagggaagagtcatcccttctctttctgcccctcttctccttttcctgggcattagtgagttagtgtaacccattacggtatgaaagataatgaggcgggccaggcaatggctcatgcctgtaatcccagcactttgggagatcgaggcagcagatcatttgaggtcaggagtttgagaccagcctggccaacatggtgaaacccgtctctaccgaaaatacaaaaattagtcaggcatggtggcgggcgcctgtaattccagctacttgggaggctgaggcaggagcattgcttgaacctgggaggtggagattgcaatgaaccgagatcaagccaccactgcactccagcatgggcaatagagtgagacgcagtctcaaaaaaaaagaaagaaagatgacgaggcaactttacacctgctgggagtccctggaatagcaagcaatcagtgtacagtcttccttccactgaatcagaaggattcgagctccaaatttcaaaaacaaaaaaaatcctaaacgtatatgccactttctattttctctcagtactcagcctcagtctgtatgtcacagtatataccttataaagtacaacatgctattatctcagtttcttctggattggcctatatggtctttctctttaatatgggggattcaagaggaaagagaaaatttaatgagtaaatagggtactaatctttgagcagtacttaggccatgcaagttggccaatagggaagatgctgttgtctctccttcactgccaaactataaaataaggatacatgaggtagccagaataaattgctggaggacatgattctgtcattgggtaacagtcaataacattaattggtgatgttgatcagcttcctgttgacaggcatggagaaaggctttctgcagaccttccctgctcttactgggaggcacaatgtcaggtgaaagttacagttagtggggaaggaggcagggaagatattttcccatgtgtatctaagggagaaaaaaatatgactctttaaaaatgttgaagttttagttacaataggaccattttaagcctgcctattggtgagcccagactttattatcccggtcaggtcagctttgtggtagggccctttaggagaaacagcaataaatgcttaagcatgtctggcctttatttgtatatctgattagtttaaacctgcacagtttgtagcctaagccatgtatttattgctcatgtgggtcagcctccatcaccatctaatgagttctaattgggttcttctagttgagaaagaggctggccccccaaccccccaaatttttttatgactagtcatagccctggagttgatggccttgactgaacttttcagcggtcattttggtcccaccctgcactgttttcatggtaactctgtgcttttctaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaaggtaatgctacctgtaccctgccctgatagaagatgcaataaaaaattaggtagccccaaggaagtcaggatatattctgcctttggttcttttctagttacacagtttgtttgatggtttgtttattttatttatttatttatcttttttaaaacagagtctcgctctgttgcccaggctggagtacagtgatctacctgccttggcctcccgaagtgctgggattataggcgtgagccaccgtgcccggcctacacagtttattttttgagagactttatttggatggtaactgaaagaatttattatgataagatgtttattttatctccatagttaatcacacagtaatacatatcaaataccaattttgtgtaaagcattatgttagctactgaaggctatacaaagatgaataagaaaacccttggctgggtgcggtggctcacacttgtaataccagcactttgggaggctgaggcagaaggatcagttgaggtcaggagttcgagaccagcctaggcaacatagcaagaccctgtctccacaaaaaaatgaaaaaattagctggacatggtggtgtgcacatgtagtcccacctactcaggaggctgggacagagaatctcttgagcacaggaggttgaggttccagtgagccatgattgcaccactgcactctagcctgagtgacagagcaagaccctgtctcaaaaaatataaaacaagaatatccgtaagaaatgtttagtggagcaggggacacagataagcaagtgaactagaagacagctacaatgaaatgtgttagagcagcagttctcaaagctggccacaggtccagcaccacctggaagttgttagaattctcaggtcccaccccagaccttctgaatcagaaacactcaaggttgggcccagcaatctagttttaacaagcctctaggtgattctgacagtcactgaagtttgcgaactaggatgtcaaaggtgcaagtgaagtgctgcgggaatgcagaacaaaggaccattcatggcatctggtgagatcagaagggcactagaaaagaggtgtcgagtgagctgggccttgctggactattttggtagtcagaaattctctaaagataaaggaccacattcttgaaaggcataagaagtgcctaagtggccttcctcgaatccatcttctgtactgcccattgaatctgcttttctagtgcactttgatccatcgctcacctgcttaaacatatttcacgtcttaaagtttctctccagctcccattgccttaccacataaaacagagttcttagtatggcagatgtattaggactctttccattgaaaatggtgggaaccgaacttaaactcactgaaacaagtcggaattcattggcccatgtggctgagatattgcaggtcacttgaggaagtgaaggaagtataccaggaaccatgaccgtattccctttttgggacagaattcagcattcctaggactcactctttttctgtttgtatgtcatctctgcttgctcttcttttttcatagtgggctcatttcctgcaaatgcaaagaagccttctctactgagcagataacttaatcgtaggcagcccttgcttagccacaaaaaaaaaaaaaaaaaagtgcacatctttcttaaaatgattgtgccaatcacagggaaagttttttcctggccttgattcagaaaggggcacatcatttgagcaactgttggcctggattgtccaagcctggatcagatacctccttttatagcaaggacagcaaaatctgttaccataagaaaaggggtggaagaacttagtgggtgaaccaaacaaaaatggaagacatcttggtccatcacagcatacacagcctttttcagtctatccacaaccttcattaccaccttttttcccacagatatacttcacacccaccaaagtgcttgcttttccttagatgtcatagtactttcatatcaatactttatttaattttatttgcctggtaaacattttctattatctgcctgttgaatacttaatctcctaacgatttaaaaccaaagataaagttcataatgttcataaatgttctatgaaacattttccagcttccccagcaaaagctagtgcttgttcctgagggttcaaacgggagttcatagccaagtcaccactgttactgattttgtcacattgctgttatatgatagttgtttacatacctttgctactattaatagattttgccataaaagctaagcctatgcatttaaaaaacatttttaatgcctgacacttagcaaagttttcagcatatagtaagtaagcaaggtatttgaataaaatgaataaatgaatgagtgaacaaatgaaaattgatggtgaaattggtgaataatcaagtctgataagagtatggagtttgtgatagaaagtaatcaaacagaaattggaaacataggctaaagccagatagtggcgatcttgaggatcacattaaggagttaattttttttttttttaattttcgattcaggaagtacatgtacaggtttgtcacacaggtacattgcgtgatgccgaggtttggccttctaatgtgccgatcactcaaatagtgaacttagtacccaatagatggattttcaaccctttttcctgctctgtccctccctgcttttgaaatccccagtgtttattgttcccatctttgtgtctatttgtacccagtgtttagctcccatttttaagtgagaacatgtgatatttggttttctgttgctgcattaatttgcttagaataatggcctccagctgcatccatgttgctgccaaggacacgatttcattctttttcttggctgtgtagtattccatggtgtatgtataccacattttccttatccagtcccctattgatgggaacctagccatgtctttgttattgcgaacagtcctgcgatgaacatgcgagcgcatgtgcctttttgatagaacaatttattttcctttgtatatacacccagtaatgggattgctggattgaatggtaattctattttcagttctttgagaaacaggagttaatttttttcttctgtaagcaaaattagctagtatggaggacagagatatgataatttttgtgggaagaagaagaataatagtattaacaggaaaggtgtattgtgaaggtaaaaatctaaaggcaacgatgttagttacaaatctcttcctgtagtctccccttatgattgatgagtagaagctatacattggttggttgtagcaatgccctggttggcacacatttttcagaacatatagtagctgaatacactccagtcagaatagcactgttttaaacagtgtttgcaaaacagtccagaccactcatttgaatttcaccttccaaaagcagaatatagccaaaatctgggaagtgagtgccataatgtatatgcttactaaactgtccattccgatttcatctgtatatctaatttataacaataatagctaacatttattgttgttatgttctagaaactgctctaaatgctttatgaggcttttctcagtttactctcagtagcactccctacaagataggttttcctcattttatagatgaggaaacagcctcagagaggttgagtgattttcctaaagtcatatggctagtagtagacagagttgaaactcaaatgccggaagcttgtcttcaaattcgaaggtcttagtcagtatgctagatacattagtatttgtcacatgtccacagattgtgattttgtggataaagcccctgcccttcatagtctcaagacatcacagggtcagatattgccaatttacagacatattcagttgtcattatgggcactgtatcagcatttcagtgttgttctttttgaagttctgtgcatgtagaactctgcactgcatttcatataatcaaagaagatacaaagatgaagcatatgaaatgggacacctttccaaggtaggagatggcattgtagacaacttcagggtaaatgttgtcacaatgaatagaaaggccactaggagaatactcaggatatgagtcagaatgtaagaaaagaactccatggaacctgcagtcacgtagcattgatttccaggacatagaggtatctgctgagtagttgctcatttatgtctacagctcactcttaaaaatcttaagacagatgttgactcgttctagtaagagttaatcttagctatatttttaaaaatcatgaatgttaccgaatatcttaattgccacaaattcattggtgttattttcagagccgagagtgtattcagagccgacagtgaactaaattgagtagtatttcaggcattgtgtttgatttagattactatagtaaattatttccatccattttggagaaaaacttgtgcatacaacagtgaactttctccgtttactagacttgacattgagatcatttctggtctgcatgtggcaatggtgctgagtaaatctgctctgcatataaaatgtttgcttaactaatgaacttgtgttagtgacttcagttctgcccatctgaagcttctatggtgagatcactcatctaagagaacatgcataacttatccttcaaaaaagactagcactgtcaggtccaccaccttgaggatgtatcggatcatttgtctttagaatgagcatgtgcccacaacagcatttaccacaggcatcagtgctgtctttaggtccctttggaattacatacttttcacaattgaagtcactcacttaaaggtgatgcaaattttgcaatagggataaccatgtgcccacgtaagtttccaattttttcttaagtaatactacactagcttaatgagtgggaaaatccaagataggagaggaaaataaattgtacactccagtgtgttggagccagcaagtgagagtgattcttggcatttcagcataattccatgttcagtgacatcatgttggtagcttgaaactagccatgatgggagtattttactaagaaactggcaaacaagccaggcatggtggtgtgtgccagtagtctcaacaacttgggaggctgaggcaggaggattgcttgagcccagaggtccagcctgggctacatggacccatctctaaaaacaaagaaagaaagaaattggtaaactctgtaagtcagacatctccccctcccccagccccagaaagctggttgttaaacatttatcagcacgctgctagcattgaatttccattagttgactactttaacatcacaatctagataactaaggtacaggcatatttctctaaaacattccttttcaaagaagaaacaattcctttgttttcttggacagtataaggaaacttcagcatgttttcttcttcttgcttttttttctttctttttttcctctttttctgtttttcctctttttcttcttcagtggagaaaagctgctaaaatatctttttttttcacagcctcctttatttacttggagtaagaagtataacttagttaaaatatgtattgcagttatcagattgctcttccaaatattttaaattccaaaatatttatataataggcttagaattttaaattacccaaaagtaggccgggcacggtggctcatgcctgtaatcccagcactttgggaggccaaggcaggcggatcacaaagtcaggagttcaagagcagcctgcccaacatggtgaaacctcatctctactaaaaatacaaaaaattagctgggtgtagtggcgggcacctgtaatcccggctactcgggaggctgaggtaggagaatcgcttgaacccgggaggcagagcttgcagtgagccgaagtcgcgccactgcactccagtccgggcaacagagcaagactctacttcaaaaaaaaagaaaaaaaaaaagaaatggctgtcttctttgattccataccctcctagacacacacacacacacacacacacacacacacacacacacgcctattgtgagtcccttttttttttttaatttagtgtgaatttatactgtggctcatagtatcagttcctagggcattggtgtgacctgactattaactctgttttctacatcactgattggaaaacccctggatgtagcatcaataaaaccaatgtttattattcgggagaagtctgaaattgctgccaaagttttatcatcatttctgcatattattcttatagcttctttcctcctctttcttttcttctttcttccctcctcccccccagtcttctttcttctcttaaaggacaagaactggaagcaatttagaggtaataaattaaaatgcctcagagttcaggtaggcacttaagtgggcaggtgtaagaccatgaggaatggtaggggctccatcagactagagaagggaaaaaacacttgccccaagagcagtgagagtcaagttttggaaaacatttaggtcaaaaacaaacacatctagggagcttctgttagtggcctcattcttcaggtgaagaaattaagtccccaagactcttccgcaattgtagaaccagctatcagaaatttgagaatgacagctagctagtccagccttcttggtattctgccactggtctgcctttattctccctcttatccaaccctattgttattccttgagtacttgttgaaggcctgctctatccaaaccactatttaaatttctgagatttcaaaagggaatgggacctatttttgccctggaggaactctgggtttcgtggaggaaactggcacctgaagagatcatgacaatgcatttggtaagagatttaagagagggatgaaagttgcttcactaactttgccttgggagttgggaattttttctggagaaagtcaaacttaaagagctgttaaaggatgagtaggtgtttaaatgtccctctcagtctttagttcatcattctatcattaggtcatcaccaacgttcttaaatactgtagtcatattaaaaatgtgaattcataaagccctaaaaagtcactttcctgagttactatagtttcttgaccgtccacttacgagacaggcttataaaattgccaccttaagataaaggtgcagtctgctttgtgaaggcctccccagaatttgtcattacacattttaaaacatattcttttttctcaatgcattttatgcctgtgtatgctggttaaagaagaaaagcaatttgtaatgcatttctcctacaaatggcataaacttcactttttcccacctgtcatcgtatagtaaatgtgttttgaatgtataatatccttttatatattaaattttattacttaaaattatttaaattcttaaaagaaattttcattgtctcttacactggaaatctagctggagtggggagttgtcagaggaagcaaaccatacctttggaaagaaaggctataactatcagtcttgtttctaattagtcacagagttaagggcaagttgttttggaatatcaatatgagctactctctggaaaatgaatgtctccatgtacatttttaatgcattcagttacaactgtcttctccagcacatacacaccaaaaaaaccacataccaaatataatttttaatgcgtatcttggtaccaaactttagaaatttactgcatctacattttcatgattatgcattttcttttctttctttttgtattatttatttgtttattttttgagacagagtcttgctctgtcaccctggctggagtgcagtggcatgatctcaggtcactgcaacctctgcctgccaggttcaagcaattctcctgtctcagcctcccgagtagctgggactacaggtgcacggcacctcgcccagctggttttcatatttttagtagagacggggtttcaccatattggccaggctggtctcaaactcctgacctcatgatctgcctgcctggcctcccaaagtgctgggactacaggtgtgagccagcgtgcctggcctgtatgcattttcattctagttacctttgctcatccatatcttattctgaatactcatgacttatttgatctagccttgtgcatagtcccagataattaagaagataattaaatcagggtctaattttcttgactatcaaatagctatttttcttttttgtaagatgtagaccccaaaagaggccagaacttactattgaaaatcagaatctaaatgcatttacttctggagaagaatttaccataaaactagaagagtaatgctagatgagatagtgcaaacaaaatggaaacttgatgaaagtatctagatagttcaccccagagattggctttcccaaaaatagaaagacaactgaatcatcaacttcagcctcagttatttggctaattatttaaactctttatgtttcatgtgtaaacataagcaatatgaagttaataaataatggaattggcaatatttctaatgttatactatcataaccagtcataaccatattttctgttggttactttagatatacaaacaagtacatggtttaattaattaaattactttgtaaattttttttttttctttttttgagacagactctcattctgtcaccaggctggagtgcagtggcacaatcttggctcactgcaacctccgcttcccaggttcaagtaattctcctgcctcagcctcctgagtagctgggactacaggtgcgcaccaccacgcccagctaattttttgtatttttagtagagacggggtttcaccatgttggccaggatagtctcaatcttctgatctcgtgatctgcctgccttggcctcccaaggtgctgggattacaggagccaccccgcctggccagctttttctttaagtaaatttaaaaggtggaagtggtatttaaatgggtaaataagatcctgatttttaaaaatgattgttttatgaactaagcttcagggttttaggccattattttgaaatctctcaacagttcttaagttgttaaagcaaacaaataaaatcaaaacaaatatggctatgcttgcctggtcacccatgttcttcctgaacccagtgtttttaagagtacatgtctcactgagatgctgaagcagcccatctacaaccagttgaccaccttacaaaggtccctgttcttcagactatcattttccactgtcctattcatatctttaccagattggtccagattaaaagttgtactttacagaaattatgtaacacttctctttgctaaagagactctttattcttatcaatcagtgcataaatattgactgcctgaaaatacatgaataggaacaatacagaggaataaaaatcaggaaaggaaacaaaagattaatttttactcattatatcaagtggactctttttgctgggctttcttaatcggttagcttatgagttgagtcttgggcagaaaaaagaattcacaagaatgtctttctcagatacttttaataccatcttcatgtttaaagaaaaatatctgtgtatagctcaaattggtgttttatgaactgtattttgtgacacaaggtcttattccaaaaaatttaagactatcatcataatcaaaatgactgctaaaattttttttattcattattataaaaagtgagtgggctgatacatcaggataaagcaactgatgattttgtcactattgtgtggttaaaatctgtgcctatcttggaggtatggattgagcatcatattattctactctaggtcttaaacatctttcttattcctggtctgacattccaaacatctcctttacatgtcaagaatgcttattcaagttgcaatagctcttaggtatatttttaaaattatagtttgctgtttataattaattttaaatggaatttgggattctgtcctacctaacatattctagctaattgagaggaaattaatgtagcctaccagccagatgattactggctgaattaactattcagaatgcttttggaaaacctgaaaatgcaggaaagcagagctaaaggatttttttttttttttagatgcagtctcactctgttgcctaggctggagtgcagtggcactatctcggctcactgcaacctctgcctcccaggttcaagtgattctcctgcctcagcctcccaagtagctgggattacaggcatgcgctactacacccagctaatttttttatttttaatagagacagggtttcaccatgttggccaggcggtcttgaactcctgacctcaggtgatctgcccacctcggtctcccaaagtgctgggattacaggcatgagccaccgtgcctggccagagctaaaggatttttaaggatagattttctcctctaccaccttctagtttcttggtgtggaacagatgacaacatagcttttttccattaatttttcttatccccgtaggaccaagatgtgtaggttgtagggccttgttctacctcccaatgttctctatttgcagaatgaacagctgactttggctgatgtttgctgataccttcaggaaataatgttgacttcagaataacagacaagccttcttttggcatcgagtttttcttcctctgccagttcaaatgaggctccccttttgttgtgtgcaaccacaagctgactgtactgcttctcttagttaatcacagacaaggcccaactgtttgatatgtatcaggtgggagttaaacaaaagcccaagcctaaatctcaaataacaagaggaagaaggatgcttccatgtcagccgatgtctcatcaagtacctacttagtcttggaatagactctaactttgcctaccaagtgtttatctgactggtaccacttagagtcttaccatataatttacattacacagtattaggaagtctatacttgttggtgatgcgtgcataattttttaaaaccattgaggtgatcactatctcagagtgctgattagaacttcaagactggtcccaggccaggtacagtggtttacgcctgtaatcccagcactttgggaggctgaggcaggcggatcacctgaggtcaggagttcgagagtagcctggccaacatggtgaaaccctgtctctactaaaaatacaaaaattagctgggcgcagtggcacacacttgtgatcccagctactcaggaggctgaggaaggagaacccgttgaacttgggcagcggaggttgcagtgagccaagatttcgccactgcactccagcctgggcaacacagtgagactccatctcaaaaaaaataaaataaaataaaagactggtcccacagccaccaggccttgtatacaatacatgcacataaactgtgtgttagttaaaaaaccatacccattatcaagtagcaatagtcccatttaaaaaacaaaattttggctggtcacggtggctcacgtctgtaatcccagcactttgcagaaggattgctagaaaccaggagtttgaaaccagcctgggcaatgccatgagaccctgtctctacaaaaaataaatccactgagcatggtgacatgcgcctgtagtcccagctactcaggaggctgaggtgggaagatcccttgagccgaggaggttaaggctgcagtgagctgtgattgtgccaccacactccagcctgggcaacagagtgagactctatctcaaaaaaaaaaaataagaaaaaataaataaaaaataaagaaatttctgggccaggcacaggggcttacacctgtaatcccagcactttgggggccaggctggaggatcacatgaggcgaagagttcaagaccagcctgggcaacatagactctgtctgtacaaaaaataaattagctgggctcggcagtgcatgcctatagtcgcacctactcagatggctgagataggtgcactgcttgagcctggaaggttgaggctgcagtgaggtatgatcatgccactgcactacagcctggacgatagagtgagactatctcaaaaaaacaaaacaaaacaaaaaaaaatttctgcctcctaaagttatttattttgtatggtggtgaagtgtcttgaaaagatgcactcagacgttattgttcccggccattctcatgtcctggaaactaactgtagccttttactttaaccatctccttcagctcattgtttccccaggccagctgaccacacactgtacactaagcttggatgttctgtgttgtaacaaacttcctttcagcactggtcaattaagcatatttgacagcacccctgcacatagccacagacaaactactttatatcctaccttatgtggaagagcctgtaacaatcctgttagagcagttaattctgattttaaatgagaatcacaggtcagaatttcccagaatgaaattctagggtaccctaatttcaggaattttgtgaaaattacagatcatgctatttataagttgcctaccataatgtctagtgcaaacactaaattgcagctgtttttttccatttgtcactgtccattctttggtttaccatatgaatctaagatttactcacactgtcattaatctcaaccattaacataccattctttcttttaattctatcaaggtccagggtgttgtgttttcttttctctttttcattgtgacactcaggaatgtgtgagataagaggtcctagagggagtgaaaagtcacagatttgctttctgataaaacacctgaatccccctaaatatgtgaagctccgtgaccatttcagagacacacagaggtccagattctatttcttcccccattacaagtcacattgctagagagattcttcccgatatcaagcactggccacaagtcaaactggcgtcttcccatttgggaccagtggaggtgaagaactccaaataattcctgcctttatgtgaagagtaatttgtctccttcctcactctacttctcctaaggccctggccccttgccttcaacccctaaggacctgtttttaaatttcagtatataacagtatgcagttttagttttcttaaaggtctgcagatatttactcagacttaggcttgattataccagaggaaataaacccatcgtttaatcaaatgcaaacgacaggcactaaattacacgtttttaatatattctattggtaactttaataagcactatttattaagtaactaccatgtttgtatgctcattctcttttaattttcgataaggtaattgtttcagtatatttcacttacagttttgagatatttttctattgagccaccattgggtaatgtatgggaaaccaatcaataaatagttcttatgattcaagagatacgttgtaaaaaagatcaattctgcctaaaggtagccatgttaattttctgattcccacaagcttaagtactagctgttaaaaaaaaatattttaagatggatgtatcattttctatagttattggttattttcggaatggtgcaataacaaattactttctgtctaatgacttctattcatggatgcagtggtataaaataatctacccttatcattcatatttctgtgtagttgagtaaggtgggaactatttttgatatgcaggagcaaatactaaagcaatggggttccatgcactttctgtcagcaaaagtatcaactgccagaaacccctgataagtcccatttcaagcaagtagagtctggataataccaaacagcaagacaacagttagtacttgtgaactggcagtactgccaacttgacttaccattctaacccgaaataaacaccccggagttaaacaaagctaagtcatccatctgcaaggtatgtagtgggcttagccaggaagaaagactttttgatttgtcaaagcaattttaaactactgccatttatcctggccagaggttgaaaaggccaaagggaagcttttaaacatatgataacatcatgtagttggggacatatggtatttgcagactgaatgaatgctagctgggatttgctctgttctgggccaccctgggtgtagaataaagaacagccctcttttcctgactttaccactaatttgctgtcaccaggaaaagtaacggaaacttttggcttctagtttttcatgtataaaataaggagactggaaaagatgctttttcagtttctgtcaagcttctgaatccccatgattcttaaagggctcacaaagtagatagaggatcttggttgaaatgatcattctttgaaaaaagctaagtaaaaaattgttttatttccagcttatgaacccattcatttttttttaaatgaacaaactgtccgagtttttcaggtacagtaaaaattaataaggaagtagaagggtcaaatgagaatcagtcacagaagagattttgttaaaaaattcattgtatcaattcagcaaccattaaattgttagtatattcttagttttaggtatgttatctcctcaactgtcacgttgaatcatgaaattgccatttttgagggttaaaacagtcgggttttgtcagtttccagagttcaacctatagatatgatctctgtgaaagcaaggtataatattgtgcatcttcctctcattccctttagttcttttttttttttttttttttgagacggtgtctagctttgtcacccgggctggagtgcagtggcacgatctcggctcactgcaagctccaccttccgagttcacaccattctcctgcctcagcttcccgagtagctgggaatacaggcgcccaccaccatgcctggctaattttgtttggtacttttagtagagacgggttttcaccatgttagccagatggtcttgatctcctgacctcatgatccgcctgcctcggcctcccaaagtgctggaattacaggtgtaagccaccacacccagccacctttagttcttgatgtaatgcttaggcacctttgtttctttgacaaatatgcactgaaagcagtattttgaggcagaaggccttttggaaatcacttatattatattactttattttgttaattttttagacagggtcttactctgtcacccaggctggagtgtagtaatgctcactgcagcctcaacctccaggctcaagcaatcttcttcctcagtctcccaggtagctgggactacaggcacatgccaccatgcctagctaattttttgtattttttcatagagacagggtttagccatgttgcccaggctggtcttaaactcctgggctcaagcagtcctcctgccttagcctcccagaatgctgggattacaggcatgagccacagcttctggcctatattattttaaagatgaagaaagtaaggctcaaaaatgtctcaaagttgcagttctttttgatgttcagaatgacactaacacattataaagaaaaagtcctgaacatattctggatattctacctaccagtaaaagaaactgatctgggccaggcgtggtagctcacgcctgtaatcccagcactttgggaggccaaggcgggcggttcacaaggtcaagagatagagaccatcctggccaaccaacatggtgaaaccccgtctctactaaaaatacaaaaattagctgggcatagtgacgcacgcctgtagtcccagctactcgggaggctgaggcaggagaatcgcttgaacccgggaggtggaggttacagtgagccgagatcgcgccactgcactccagccctggtgacagagtgagactccgtctcaaaaaaaaaaaaaaaaaaaaaaaagaaactgatctgatacattttataggcacagttcttagcaattaaagttgggaatagaggtgattctcaagttcttaaaacctgaaggccctattttttgtcattcttgttgactgaggtattgacatttttggaaaaaaaaatatttttttaagtagttaatgctagtaagaaaaacttaatctaaaggaaggtagtaacaataataccagactatacacatgatctgaatctgcactgtaatccccaaatgcattactttcctgtatttgataagtttcatttctctatcagtaaacaacttccaattataggtttagttactgtttatagaaaggtgtcatgacttagcaatattagaaatagactaagtgtaaagatatttataggtcatacttttgactgaagccttacacactgcaaactctcatgttttctgtaacatctctctgccattttaatgataaaataatcgcattttagagcatctgatttaatatttgtcaataacagtttatactgaaatttagaaaaccacaaagaatgtagtccaacacactgtctttacaagtgaggaaactgaggcccagagcaactttaagttacttaaagttaaaacatggggcaaattgggacttggcatccagtatattataatgtctaatgtgccatttgctcttgttctagttgcaaaaacatttgcctcatatccacactcaaaatggagtgaagattaagtaaataatgttttgatcatggtacttggagtgaagtagaagacttatgacacaattacgtgttgtttggaaatatttagaaagtatgttcatagttgatctattaagcagtcaatgatttgttgactgggcaagtctgccacacttttacaaatttgccagtttccaaacacctggaagaagcatcaagtaaaacttcaaaacaaagacctgttggatacacagcctagacttacttttttgttttttgttttttctgatagaaacatgagttctgctggcgctgatgggagaaaagcgatgagaagatgtgacggactcattgactcactggtccattatgtcagaggaaccattgcagattaccagccagatgacaaggtaattcaagagataaatatcctgttttgtcttactaagatgcttcagaatattcttaagatagccgcttggttttaggtttattcactgattcatttactgagcctaagatcttccattcatccttagaaatattaaaacctaggccaggcatggtggctcacgcctgtaatcccagcactttgggaggctgaggcaggcagatcacgaggtcaggagattgagaccatcctggataacatggtgaaaccccgtctctactaaaaatacaaaaaatatagccgggcgtggtggcgggcacctgtagttccagctactcaggaggctgaggcaggagaatggcatgaaccccagagcttgcagtgagcagagattgcgccactgcactccagcgtgggcgacagagcaagactctgtctcaaaaaaaaaaaaaagaaatattaaaacctattgccttatttttctattttccaggctccaatgtctgtctgtctaaccacactatgtggatatttgaaaggagcccaaatgctacatggtcagcaatgaattttaatgtatctcttttttcattcccaaacttgttccttctttttataatcctttttttttttttttttttggaggcagagtctagcttcatcacccagcccaggctggagtgcagtggtgcgatctcagctcactgcaaccactgcctcctgggttcaagcaattctcctgcctcagcttcccaaataactgggattacaggtgtgcgccaccatgcccagctaattttttttgtatttttagtagagacagggttttgccatgttggccagcctggtcttgaactcctgacctcaggtgatccatcacctcagcctcccaaagtgctgggattacaggcgtgagccacagcacctggactataatccttcttaataatcatcaccatccaccaaaagaagatggaaatctgagtaattgtgtgctgtctacctctgaaaaggctttcagttcttacacttccctctaatgcttctaatgttttcctacattgtgcatctttcatgccgattattgcaatagcctcctagttggtccctataaacagtatctcctccccttctccagctcaacatggctagtaagttacgtatctaagctatacagttgttctggacacactctttagaaagtaaactaaaaagactcagcctctacttcttagcattgtactcctgactgttcatgaaaaccttagcttttctagccatactcattgcatttcccccaggcaacccgcagtttaagcacacccagttgcatctggtaaaccttgtaagagctaaagcctgtgtcctgtgatatcacacctgcaaggatatctatatgtatacgatcaatattcttgtcctgttttctcaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagaggtatattgggaagtttttgaaagaatgagaaagggagagaatgagagagagtgtgtgtttgtgtatatgtgtatgtctaagtacttggtatatatcggcactattttaagttattttaattcttacatcaaccttttgaagtgtgtattattaataccctcatttaccagtgaggaaacagagacacagtaagattaattttcctggaataattcagcaaataagtggaagagattgaatacaatgccaggcagtctggctccagattttcattgctacccatgaaccgtactgctttatgccttataggttaggaaataagcttaatgcagcatagctaattgtatataaattgtttttattaaagtcggccctgatatttggccttgggtattctaaaaacaaactttggacatactaaaagcaaacctcataggaaggaatacatatttatttccatactgatatgaaaactaagagaatgtaacctcccctccttctctgagtatcgtggtatttgtggaaaccagctggtaaatttagaaccctggtgctatcctggacactttcacaagactctgagggaacaggcctgtttttcttatctacagggtggttgtgactaatttagcttttagctcaacagcagcctgaaaaccattctagaatgacctatgcttaattctctgaattttctctcactgggagaaatatcaagttaggggtgtggagtgttattaggaagaaataatcattatgggctaaaagttaagtgattagaaattatatatatttgcttttaaaatttctatttcaagggcttcttatgcaaattatgagcctttctagacagtatttctggtctcctggtttgagtgtgaaattatagccatcacctgacatgcattaattctggattccttttgtgtgtggtcagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccagtgagtattgggcctgatttcctactttttaaaataatgatattatagacatacctacattcaattcagagatgaaacagtgagggaagagaaaaaggtttcttattttagtaaagacaattctcagaaattacagagggcttcggtctcagcttatgcaaagtcaagtcaggctgcttgactgacaagtcaagtcagtactctttcagttacagatctcagaatcctgcctcaagctggtttaagcaaaaaagaggaaatttttggcttatggcactgaaaactccagggtgggccttctttctgtcgtgactggacttaggtgcaccagtgattacagttgactttcttcatctccgggcttggttttcctctgctgggtttgttctcaaaggctctctccatagggtaacaaagacagccatgaattatttcaggctcacgttttatcagcccaatgtgtcccccacaagaaacaaactaccattttcccaatagtgttgttaagaagttggagaatatgtctcacgggctggcttgggcctcttgcccatttctgaaccaatacctgtgtctatgaggctatgatgttctaattggccaagtctggatcatatgcccagatgtgcacttccagggcatgggtttgattggatgagggccactgccacttgtaccacatgggctgaaatggtaaaggagtgctccctaatggaaaatgagactgttactaccaaaggaaggaggaataaatgctgggaaggcaaaaacaacagcagatgtctactgcagtatggagttggaaaggccatctgtgcttttgtgtcccagaaattcaactacaaaataaagagctgatcctctttccagatgcacttactttatagcagcaaagtcaaaataattaaaatagtaaaaggttattcccttccccatgtattttatacccttcctatatattaaggtattctgtaagtatttaatgatttaaactaagcttgtattctttgccttggtcatgaaacgattagaataaactccccccaaatagctcattgtctgtctagtctccaattatctctgtagagaaaagtactattgtaagtagcaaaaaatatttatgttttacttgagaaaccatatttattctttaatatgtgtgtttacacagaagcttgttctctgaataaaattgtgaaatgctaaaaccaatatttctcttaccttagcattgtggttaagaatgcaaccaaactttcatctgtttggctttctgcaaaatgtacattgagaaagaaactgggaactaccagggagcccttaatgacacagggacactaatgaatcacgttattccccattttcctatgctaggtttcccaaaaccatttctcttactttgctaaactatagaagccctctttttaattcccagctaacataaaagaaaattaaatgggggaggggttgtgtgtgcgtgtgtgtgtgtgtgtaagcttgctgtggtctgagtctagttcaatataagctaaccctttaagcttggattttagcctcttccattccaagagcctcccacagaatccagaccaggggtgctttcatttttctgaggatacagggatatttatgccacttaatctctcaatattagtgtattacctagttcctacattcatttgctgaacaaacattcttttgagcatattacataacagacactagcagttatggtgtaggttacacagcagtaaataagacaaatccctgtgttgggtaatagtcttactgggatgaaaaacagaaatttaaagtactaggaaaaatttaaggtaccaggtccataaagggcccaagtcatacctaaggggcctaataggccatccctaaagggaagcttacactaaactgatactgattcatacccaaggttgttagaattggacttgattggagatttataagagaaaatcattagcagcatgggacaaatatgaagcccctttattttattttattttattttattttattttattgtattgtattgtattgtattgtattgtatttattttgaggcggaatctcactctgttgcccaggctggaatccagtggcacaatcttggctcactgcaacttctgcctcccgggttcaagcaattctcctgcctcagcctcccaagtagctgggattacaggtgcccgccaccacgcccagctaatttttgtatttttagtagagatgaggtttcaccatgttggccaggctggtctcaaactcctcacctcaggtgatccaccagcctcagcctcccagagtgctgggattataggtgtgagccaccgcactcagcctccctttattcttttaagttacgggatgctttttaaaattttgacatatgtgtttttttaataatacttttcctacttttgtatgcttagatgctgtgataaagatctctggctttataatttcaaacaaggaatcattgaataggaaaacatgaaaattaggtcatacacatagtaccagaaaatatcaagtccattggccatgtgatcgtaactgagatagcactgagcaattaatgaccgtgtaccttacgtggcaaagaacccaagctgaaataaataggttcctaaaagacagattatataatttacatacagaattatgacagaatttctagttagtaaaagtatgttagtctaagctttattagttcagttataatggtcactctagtagcaaaaggatggaataataaaatttacttatttagcaagcttttaaatataatataaattaaaagattaaacattgtatagtaaaagttaaaagtcattgaaataaagtttcgggtttttttgggttttttttgtttttgagacagagtctcattctgttgcccaggctggagtgcagtggcacagtctcggctcactgcaacctctgtctcctgggttcaaataattctcgtgcctcagcctcttgagtagttgggattacaggcatgtgccaccactcccaactaatttctgtatttatagtagagacgggtttcaccatgtcagccaggctggtctcgaactcctgacttcaagtgatctgcccacttcagtctcccaaagtgctggggacaggcgtgagccactgcacccagcctgaaataaacagttttaaaagccctttatttaatatcgatcggaaaaaaatgaaacatattccctcagcggcccccaacctttttggcaccagggactggtttcatggaagacagttttttcacagactaggctggggagagatagtttcaggatgaaactgttccatcttagatcaattagattcttataaggagcacacagcctagatccctcatgtgcggttcacaatagggtttgcgccctcatgagaatctaatgtcactgcggatctgacaggaagtggagctcaagcactaataatactcgctcactgctcactttctgctgtgcggcgggttcctaacagtccacggactggtactgtgacccgggggttgggatcttccccactaccgcataccttacccaaaaataaataccaacaggaatgaaacctaaatatgaaaggtaaaacaataaagatgctaaacaattacatggaagaatatcttcatgacctgaaacagggaaagacttcattaaaatggacacaaaaaagactagccttaaagtaaatatttgataaattgactaaattaataacttatgctatcaaaagacatgttaagacattaaaaaggcaaaccacagaatgggaaaagatttttgcaacatgtataagtaacaaacgtgggtatccagaaaatatagaagagttgaggtaacaatacataaacaagacatggacagcccagtagaaaaataaatggacaagagacttaatagacgaaagataacattgaaatagctaacagttataaattctttcccatggccaatgtccagaatggtgtttcgtaggttttcttctaggagtcttacattttgaggtcttaacgtttaaatcttaaatccatcttgaattaatttttatacatagtgaaaggtagaagttcagttttgttctgcatatgactagccagttatcccagcaccatttattgaatagggagtcctttccccattgcttatttttgtcaactttgtcaaagaccagatggctgtaggtgtggagcttcattgctgggttgtctattctgggacctaattaagctaaagagcttctgcacagcaaaataaactatcaacagagtaaacagacaacctacagaatgggagaaaatgttcacaaagtatgtatctggtaaaggtttaaatccagaatctgtaaggaacttaaaaaattcagcaagcaaaaactaaataaccccatttaaaaagggagccaaagacatgaacagacatttctcaaaaaaagacattaccagtggccaacaaacatgaaaaaacgctcatcatcactaatcatcattaattatcaatcaaaactacagtgagatgccatctcataccacttagaatggctactattaaaaagtcaaaaaacaacagatgctggtgaggctttggagagaagggaacacttacatactattggtgggaatataaattagttcagccactgtggaaggcagtttggaggtttctcagagaacttaaaacagagctaccattccacccagcaatcccattactgagtagatatccaaaggaaaataaattattctaccaagaagacacgtgcactcatatgttcatcaccatgctattcacaatagcaaagtcatggaatccaccagggtgcccatccgtggtggattggataaagaaaatgtggtacatatgcaccctgcaatgatatgcagccatgaaaaaagagtaaaatcatgtcctttgcagcaacatggatgcatctggaagccattatcctaagtgaattaatgcaggtacagaaaaacaaataccacatattctcccacttatacgtgggagttaaaccatggttactcatggacataaagatggcaacagtagacactggggactacaagaagagggagagaaggagggggaaagggatgaaaaactaactattatgtactatgcttactacctgggtgacgggattattcatatcacaaaccttagcatcacacagtatacccgtgtcacaaacctgcacatccaccctctgaatctaaaagttgaaattttttttaaaggccaataaacatttgaaaacatttttcaacctcattaatgatcaaggcaatatgaattagaagtgttatttgcaaacagttgaccagagaattaacagtcattctcacatacttacaaaagctagaatacagaatctctatttggtagcactcattgcttattttccttatggagcaaattctaaaggtcatcctacttcaggcattctcatttccctcagcaaatcggaattagtgaaattttgccatgctgtccccaagctgagcaaacagcatttaaggaatcagacctcatctagagtcacatgttttcaatgattgttcttacaaattaacatgaaaacattaatgctctttattatatctcagcatatatcattaaatagtatagtatgatgtatctataaagcgagattttagttctcaagaaattctcatgttttaaaagaaaacaaaaattttaagaaatattttgtgactttatttgattccccatcttgttttcaagtaccttctgagatgataaatcttcagggaaacttgatagcatattatttgtacaattcaggtcagtaaacatttgtataggacctatcatgtggaaggtaccatacaaggcactgaggtggagaaaagatggataagatatgttctttcaagaggctaatgaatggtctagtaggagagataggcagtttaggagagttgtaaaatagagaattagggagtagtggtaaggaaggaaatgaaagaaaatgtcaggctacagaggactgtatgagccatactaagatgtttgaacatcattcggaaggcgatgaagagtcatgaaagggtttaaatctgaggtgtggaacataatcagattaaattttacaagggtgattctggtgtaaggctttgaaacccccactggtgtttaagagacaacaagtttactagcaacattgagttccttgtagagattggaggccataatttgcagattggttcttctgcaaatgcattgttcgccctagcaatatttggtagacaagtataaaatcagaaaagaaaaaagttaaatgaaccgtatattgcagttttgatgggtgagagaaaaataaaccagactgacaagattgttgagattattggaatttttttttttttaagacagagtctcactctgtcgcctagggtggagtccagtggcacgatctcagctcactgcaacctccgcctcctgggttcaagtgattctcctacctcagcctcccaagtagctgagattacaggcgccaaccaccatgctcagctaattttttgtacttttagtagagacggggtttcaccatgttggccaggctggtctcgaactcctgacctcaggtgatctgccttcctctgcctcccaaagtgctgggattacaggcttgagccatagtgcccagcctggaaagataatatttaatgtgatggttcatgcaccatagtctaaataagaaatttaagacaggagagaattgataacttgaggtgtaaggaatgaaggttaggtaaaggaactaaagttcttgatgaggctgaagagaaacatggtaggagggagggagggagagcagggagaacgggaaactatgttcagagcctgacattgctgagtttatgttttcagaggcaacatgtctctgagtgaacacaggctctgtgtgaccatggaagtgagtggctgatgtatggaagagatgaaagtcagggactgtggggaagtctaggaactgtgaggtaatcattttgatgaggtatatgaataggaggtggagaaggctgtgaactgggctccaaagcctccagcaaatgttgaggaaagaataataggccttgtgatagcaaagaaaatgctgtggggggtgatagagctggacggtggtgactcagaagagcaggacttatgcatttgagggaaaacggaatagtgtagaagcgcaactgggaagacagagagtgccaaacgtccctcctggcccaggatacaggagtggtgtccagtagtctcctccttggatggctacaggggaaggattcttctcagaggagagcaaatagtctaacagaatgttctgcaaattaatgaaagacaaattttaatttgtttataatagaacaaacattagaaaatagtaattaaattcctttgagtcatggacactttgagagtctaataaaagttatgttttaataactaataaacagagtattgcaattgtatctaacaattacatgttttcttcctccttattttttttttttcccaagatgaggtcttgctttgtcacccaggctggagtgcagtggtataatcatggctcactgcagccttgaccaccagggttcaagtgattctctcccacctcagcctcccaaaaagctagaaccacaggcacataccacaacacccagctaaatttttttatcatttgtagagacagggtctcactatgttgcccagctggtctcaaactcctggcctcaagcaatcctcctgcctcagcctcccaaagtgctggaattacaggcatgagccaccaggcccagcttcttcctactatttttaatattgaaaaaaagatactgactaaattataaaaacaataagacatgacagttatttgtttcattatatattaagcaggctcagtttaaagtaagttgattagcattaaagtcatatctgaaggcccaaaatgaacttgaaatgattctacttcccaatgtttatacattttctcccactgatctgataatcctgttcctaaaatccagacatccatatgagagttcacaagaggtccttatggcttagtccatttgtttggttgtttgggggttttgttttgcttagttttttgctttggttttgtttacatttttgttttatgtttgtttgtttggtcactattgggctaatactgaccattatttagatttataaccttcaatcttgtgatgaattggttttgaaaactgcaggctacaattttttatttctctagtaagctcctggaagtcaagatattttatattttcaaaaataaaattctctccttcagactgactgtgcccacgatagtttacagctacaaccaggaataacaaatgcaaggactgcgatcaagttaacatggatttgactgaatatacatccaaacttataagtgggttacagaaagtcaattggcaagtcatttgtatggaaatagtgatgagttttcccatttaaaagttaataatggccaggcacggtggctcacgcctgtaatcccaacactttgggaggccgaggcaggtggatcacttgaggtcaggagttcaagaccagcctggctaacatggtgaaaccccgtctctactaaaaatacaaaaaattagccaggcatggtggtgggcgcctgtagtcccagctactcaggagactgaggcaggagaattgcttgaacccaggaggcagaggttgcagtgagccaagatcatgccactgcactccagcctgggcgacagagcgagactctgtctcaaaaaagaaaaaaagaaatgagtaaattaattagtgtgtgtaaattgccaaaacttgaacaagaagaaacagaaaagatgactaatcatcaaccagtaaataaactgaaataatgaaagacatctccctttaagattttttctcagctcagttagctttctgggtgaacacagattccatgttaccgtggaagtgagtggcagatatacagcaatgtaggttgagcatccctaatccaaattttcaaaatctgaaatgctccgaaatccaaaacctttttagcaccagcatgacaccatgcgttgaaaatgttatacttgaccttatgtgacgagtcacagtcaaaacgcaggcacacaatacacagtttactcagcatcctcaagcagaaaaaaaaaaaaaaaaaaaccctcccagctcccttcagctgccatatatcttttccacatacacccagtttcccccacgcaagcaagcacacacacaaaggatagtaaaatggcatatgtgcaggccaggcatgctgatggcaggtttcccacaatgccccacatggagccaagacctgcatgcatgactcaactgtgtttggttgcttactctctttgctgtgtggtgtaaagatattgttgaaaatgacaaaatggcctgcagatacccctcagggtaactgataaaaagaggaagcatttatgtttacctctagcacagaaagccaagctgttggagaaactggacaggagtatatgaaacatccatatatgacctgaagaaacagaaggatacaccgctgaagttctgtgctgaaactgattcacagaagttagtgaagattagaaaactgcataaagccaaacatgaagattttgatcatgtattgaaagtgcggatctgtccacgtcacagtgaacacatggcacatagtggtatgctgaccatgaaacaaaggtcaatgatgaactgaaaattaaaaggaactgtgaataatcaatagtctggttgcagaaatttaagaaaagacacagcattacatttttaaagatttgtgatgataaagcatctgctgatcacaaagcagtgaagaaattcattgagtttgccagagtcatggctaatgaaaatctgaagccaaaacaagtctataatgctgatgaaacatcactgttttggcatcattgcctcagaaagacactgactacagctgatgagacagcacctactagaattaaggctgccaagaacagaatatgctgggatatgctaatgcatcaggcatacataagtggggtgatagataaaaacttgtgtcctcactgttttcaaggagtgaatttcttaccagtctgttattatgctaacaaaaagacctggagcaccagggacatcttttttgattggtttcacaaacatttggtaccaagtggctcatgcttgctgcagggagactcaattggatgatgactgcaaagattttgttattacatgacaactgttctgctcatctcccagctgaaattctcatttaaaaaatgtttattctatgtactttcccctaaatgtgacttcatcaatttagccatgtgaccagagtatccttagatcaataaagagtagattaaaaaaacacttttcttaaatagcatgctagctaccagcagtgtgcagaggtgtgggtgtgagaaagtgttcaaaaggagtttagcctgaggatgctctatatgctgttgccattgcttgaaacaggtgtgcatgactggcacaactctggcctacaactatgtcgactggtaatgaagtcaccagatggtgactttgaaggattatatatgtcaagtgagaaaaaaaaatgatggctgaactccttacctttgcaaaaaaatagaccttcacaatctgtcagttagctggaagaagtgaatactaaagaagtttctaacattgataacaaggctctacttgttcattcattgaccaatggtgaaatggccaaaatgattctgaataaggtaattgtggtaatagtgatattgttaacactgcagaaaaagtgcctgtagatgacagggtaaaattgtgtgatgggcttattgaagaactagagcagcaggcattcataacagaacaactcatgtctatttataaaatcaaagagagactgctaaaataagagctattgttgagatgggggccaagagggcccattagaagcagctgcagtccacagcacagagaggaatgaaagcatcaagtgaattcagcaccttcaactgaaatatccaggttctcgcattgggactgactaaacaatcaccctgatccagagagaataaagaaaagcagagtgggtcagtggcccacccaggagcctcacggagccaaaggaacccccacccccagcaaagggaagcagtgaccgattgtgcgacccgcccaggaccatgcttccccacagatctttgcaacttgtggatcaggagatcccctcatgagcccacgctaccagggccttgggtccaataaacagagctgtgcggagtctcagcacaggtacacacagagacaagagttttacatactccggccccggaatttccagcaaggtgacagatccctttgtacattcccctaggaagggggctgaatccagggagccaagcagcattgttctgcaggccccacttccacagcacctcacaagttaagtcccactgtcttggaattccagccagccaatggcaacacaatgagtctgcctgaaacaggatggagttccctgtgggaggggtggctaccatttctgtggtttggtcaactgcacattccagcctgccagctccagagagtctgggtggtccagatgaggaagggatacccccaacacagcacagctgctgtgccagattgtgcccaaactgctttaaagtgggaccctgatccattcctcctcactgggcagggcctccctgtggggggccttcaatcactccagctgggcttatatggacagagagctctgatctctccctgggatgcagctcccagaaggaggggaggctgccatctctgtggttcagtcaactgagctgttccagcttgcctactctagagagtctgggcagtccagatgaggaagggtcctccccaacagagcacacctgctctacagccagactgcttctttaagcgggtccctaattctgttcctcctgactgggtgagacctttcaataagggtctccagaaacctctgaaacgagcatttgggccagcagcaggtcagtacccaccctgggatggagtgtccagaggaaggagcaggctgccatctttgctgcttcacagccttcactgttgatacctccaagtacaggaaaagcagaggcaactaaggtctggagcagacccccaacaaaccacagcagccctgtggttgctaagagtcagtagcctgaccgtgaaaagaaaaaaacaacaacaacatcaacaaaaaagaccccacagaaaccttttcagaagtcagcagcctcaaaggtcgaaggtagataagcccacaaagatgagaaagaatcaatgcaaaaacgctgaaactcaaaaagacagagtgcctcttctccaggtgaatgcaacacctctccagcaaggcctcggaactgcgatgaggctgagatggctgagttgacagaagtaggcttcagaaggtgggaaataacaaacttcgctgagataaaggagcatgtcgtaacccaatgcaaagaagctaagaatcatgataaaacaatacaggagctgataaccagaatagccagtttagagaggaacataactgacttgatggagctgaaaaatataacatgagaacttcacagtgcaatcacaagtatcaacagcagaagagaccaagtggaggaaaggatctcagaccttgaagactatctttctgaaataagacaggcagacaagaatagagaaaaaagaatgaaaaggaatgaacaaaacctccaagaaatgtgggattatgtaaagagatggaacctgcaactgactggggtacctgaaggagacagggagaacagaaccaagttggaaaacatactttagtatatcatccagtagaattaccccaacctatcaagacaggccaacattcaaattcaggaaatggagagaaccccagtaggatactccatgagaagattatccaagacacatacttatcagattccaggtcaaaatgaaagaataagtgttaagggcagccagagagaaaggccaggtcacctacaaaggtaagcccatgagactaacagcagacttctcagcagaaaccctacaagccagaagagattgggggccaatatttaaaattcttaaagaaaagaatttccaacccagaatttcattttcagccaaactaaccttcataaacaaaagagaaataagatccttttcagacaagcaaatgttgagggaattcatcaataccaggcctaccatgcaaaagctcctgaaggaagcactaaatgtggaaaggaaaaaccattaccagccactatgaaaacacactgaagtacacagaccagtgacagtatgaagcaaccacataaacaagtctgcaaaataaccagttagcatcatgatgacagaatcaaattcacacataacaatactagccttaaatgtaaatgggctaaatgcaccaattgaaagacacaaaatggcaaactggataaagagccaacccccattggtgtgctgtcttcaagagacccatctcacatgcaaagacacacttaggctcaaaataaagagatggaggaaaatttaccaagcaaatggaaaacagaaaaaagcaagggttgcaatcctagttctgacaaaacagactttacaccagcaaagatcaaaaaaagacaaagaagggcattatataatggtaaagggttcaattcaacaagaagagttaactcagctctggatcaagcggacctgatagatatctacagaactctccaccaaaaaacaacagaatattcattcttcttctcaccctacagcacttactcaaaacttgttcacataatcagaagtaaaacactccttagcaaatgcaaaagaaccgaaatcataagaaaccatctctcagacaacggtgcaaccaaattagaactcaagattaagaaattcactcaaaaccacccaagtacatagaaattgaacagcctgctcctgaattacttgtggataaataacgaaattaaggcagaagtcaagaagttgtatgaaattaatgagaacaaagagacagtgtaccagaatctctgggacacagctaaagcagtgttaagagggaaatttgtagcactaaatgcccagatcaataagctagaaagatctcaaggtatcaacctaacatcacaactaaaagaactagaaaaccagaccaaacaaaccccaaggcaagaaatagccaagatcagagtggaactgaaggagatacagacacacacacacacacacaaacccttcaaaaaatcaacaaattcaggagctgtttttttgaaaaaaattaataagatgatctactagctagactaatagaaaagagagaagaatcaaataacacaatcagaaatgataagtgggatatcaccactgaccccacagaaatacatacaaccatcagagaatactatgaatacctctatgcacataaactagaaaatctagaaaaacatggataaactcctggacgcatacaccttcccaagactgaaccaagaagaaatcgaatcccttagtagaccaataatgagttctaaaattgaggtagtagtaaatagcctaccaaccacaaaaaacccaggaccagacagatttacagctgaattctgccagaggtacaaagagcgggtaggtaccatttctactgaaactgttccaaaaaattgaaaaagagggactcctccctaactgattgtgtgagaccagcatcatcctgataccaaaacctggcagagatacaacaaaaaaagaaaacttcaggccaatatccatggtgaacatagatacaaaaatccttagtaaaatactggcagactgaatctagcagcatatcaaaaagcttatccaccaccatcaagtgggtttcatccccaggatgcaaggttggttcaacattcgcaaatcaataaacgtgattcatcacataaacagaactacagacaaaaaccacatgatctcaatagatgcagaaaaggcctttgataaaattcgacatcgcttcatggtaaaagctctcaataaactactgcccaaagtaatttatagattcaatgctatccccgttagactaccattgacattcttcacagaattggaaaaaactattttaaaattcatatggaattgaaaaagagccgaatagccaagacagtcctaagcaaaaagatcaaagctagaggcatcatgctacctgacttcaaactgtgttacagggctaccataaccaaaacagcatggcactggtacaaaaagcagacacatagaccaatggaattgaatggagaactcagaaattaagactgcacacctacaacaatctgatcttcaacaaacctgacaaaagcaagcaatggggaaaggattccctatttaataaacggtgctgggagaactggctagtcatatgcagaaaattgaaactggaccccttctttgtaccttatacaaaaattaactcgagatggattaaagacttaaatgtaaaacccaaaactataaaaaccctagaagaaaatctaggcaataccattcaggacataggcactggcaaagatttcatgacaaaaacaccaaaagcaatagcaatgaaagcaaaaattgacaaatgggatgcaatcaaactaaagagcttctgcacagcaaaagaaactatcatcagagtgaacagacaacctacaaaatgggagaaaatgtttacaatctatcttcctgacaaaggtctaatatccagagtctataaggaacctaaacaaatttacaagacaaaaaaaaaaacaaccccattaaaaagtggacaaaggacatgaacagactcttctcaaaagaagacgtacatgtggttaacaaacgtgaaaaaaagctcaacatcactgatcattagaaaaatgcaaatcaaaaccacagtgagataccatctcatgccagtcagaatggtgattattaaaaagtcaaaaaaacaacagatgctggcaaggttgcagagaaaaaagaatgcttttccaccattggtgggagtgcaaattagttcaaccattgtggagaacagtgtggtgctttctcaaagatctagaggcagaaataccatttgacccagcaatcccattattgggtatatacccaaaggaatataaatcgtcctcttataaagatacatgcatgtgtttgttcattgcagcactattcacaatagcaaagacatggaatcaacccaaatgcccaccagtgatagattgaataaagaaaatgtcatacatacacaccatggaatactgtgcagccataaaaaggaacgagatcatgtcctttgcagggacatggatggagctggaggctgttatccttggcaaactaatgtaggaacagaaagccaagtaccacgtggcctcacttataagtgggagctgaacaatgggaacacatggatacttggtggggaactacacacactggggcctgttgggggatgagggagagcatcactggaagaatagctaatgggcgctgggcttaatacctaggtgattggatgatctgtgcagcaaaccaccatggtacacattaacctgtctaacaaacctacacatcctacacatgtacccctgagcttaaaagttgaaggaaaaaaagccattgttaatgaggcagatgactctagaggcaacattttgcaaaaccatccaacagaatgcctcctcatccctaaaggacccagttcctggtccctcaattgcttttcatgtttcttctcacctgaaaacaaaaaatacagtggacagttacctttccatcaaaacacagcatggtagagacggaaagcctgccgttgtctgttgctgtctaacagctgagacaggtattctggtgatgctactgtgcttcttagttacctgaacacattattttttttaactgtattaatggcatatcatatttttaactgttaagtacatgtgtaagtgtaagaaaatgattgcttatcagtagtacatgaattcagagtcaggaataatggtgatgccaaacaaccacagattgtccacatgggtggctgagttagtgacacctttgctttccagtggctcctcgtatataaactatttcatgcacagaattattacaaatattggataaaatgacctctaggctatgagcgtaaggtgcatatgaaagataaatgaatttcatatttagacttggttctcatccccaagatatttcattatatatttgcaaatattccaaaatctgaaaaaaaccaaaacacttctggtctcaagcatttcagtgaagggatattcaatctgtatggctaaattctaccaaaagaagagattacttgtattacacaaatagctaaaggagatagaaaaagattaaatactacccaactaacttaatgatgttagtataaccttgattctaaaagtgaaaagggtagtacaagaaaaggaaaagggaaatccattttatttataaacacagatggaaaaaatgttaataacctaattaaatccaacattgcattgcatttgtttgtttgtttgtttgtttgtttagacactgtcactctgtcacccaggctgagcgcagtggcatgatcttggctctctgcaacctctgtctcccaggttcaagcgattctcctgccccagcctcttgagtagctgggactacaggcacgtgccaccacgcctggctaatatttttgtattttttagtaaagacagggtttcaccatgttggccaggctggtcttgaactcctggcctcaggtgatcagccagctttggcctcccaaagtgctgggattacaggtgtgagccaccacacccggccccaagattgcatttaaaagtactgaataaacaggtttttatctagtaattgacttgaaaacttaataagagtttaaagaaaatacctttagactagttccatcacagttctaatttttaaaacatcttcggctgggcatggtggttcacgcctgtaatcccaacactttaggaggctgaggcaggtggatcacctgagtcaggagttcgagaccagcctggccaacatggtgaaacaccatctctactaaaattccaaaaaattagctgggcgtggtggcacacacctgtaatcccagctagtctggaggctgaggcaggagaatcacttgaacctgggaggtggaggttgtggtgagctgagatcacaccactgcactccagcctgaatgacagagagagactttgtctcaaaataaataaataagataaaaataaaacatcttcatcaacctctggtaatctacagaaaacttaatgttatcgtgaaatcaaatacaatagcacttataggatatgtctcacaaaacagatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattggtgagtcggtataagtatctatgtgtaatatgtacatgctgaagatacaatgcaatgaaatgttgtctgtatcacctcccgttcacaaagatgcactggaaatgggagtaaggagtaggtgataaaccggcctgccttttgtgccaccagatatcacaaacaggctttctcagtggatctcaccagagattttttttaaatatccaacatttaaaaaaaaaattactacaaaagagaaattttagagcatactaataattaacaagataagtaatattgttgatatttttcactgggtggcaccctcagtcacaccatccaatgaagtctttctaatccatatagttgtctttcagaatgttctctctgtggctctcttaagcaccacaattctagaacatttgaaaaacacatatagtggtggtttactttagtagtttggcagtgtgttggactattaaaaaaatggataaacagataatcacaataaaaagacaaggagtcactgaatatagcaaatttggcatggattttttttgagtaactgtgatgagacatattttgcctttgactgtattattgacagagatgataacggtacttttttatttgtttgcttataccaagaagtatgtgataaatgtttgttgtatctagtagaaaattacaaaatgagatgatagaaagataatgctaaaattaaacatgcttcataatgctctgtaatcggtcgtttctaacaactcaaattcggtttttcacatttcacaaaaattataaacaatattttgcctgttttaatggattagatttttaaatatgcacatatatagccccagagatattaaaggctgcagttatgttttagtaatgtcattttcaaagccagccagcagcacatttgacaggaggttttatgcaatggcttcatgctcattctaagtagagataagcctggaacattctcagtgaatctgaaagagacctcgccataggcactctcagaattattaaaatgctctccccatggtcttttgtgctgaacttcaatggcagtgtattatcctttcccttttttgttcttttcccaaatgaaaaattgactccatctttaaaacaccaccaaggtaaataacagcactatacacattaagcatgtaccttcagggcagaaatgctgttggcctcaggttctgcagtcccctaaatgtcgggaaggtatagctgtagccacatggtttatattagaggattctgttgataaacttcactttaaggataacagagaaaagaggcttcagcaagataaatgctattttaaaattccagattggcttcatgtcaaatatataagtaaaaggacttctcttaattcagaattttaatagcaagaaataagtgaaagtcagcttgaacacatgctttgtgtttctcatgagagctttctaagccaggtaactttccctgttctcacctgcaataaagttgttatgttttacttacatctagagaaataaacttgaaacttacattttctcaaaaacttaaagacaggcaatggagcatggtaacagaataacagatttcacacagaaaacatgggtttgtatctcacagtgctattttgccagtcaaggcctttcattctgtagtttaacttactaaaaggagggagacttctgataatagcatccactgagagcttaccacatgcgcagtactgcaatacaattaacatgcattgactcgttccctcagaacaaccctgtgacgtagacattattatcccacattgcaacttagggaaaaacaaatagagacattaagtagcttgctcaggccatagagctgtaaagtagcagaaccaggactgaaactacagcactctggctttagatgaacgctgagctctccacagtatgctgtgtgcttgaaccacagtcaaaaggaaagtgttcaggcctgtgagcaaaaggtatgtcttacctgtcaatcaggtccaggtattatgatgacatatcattcagtgccttttattgagtacttgtccatttcaggaataatgatcaacgctgtaaacacagaaataagtaagataattggcttcaaggaacccacagcctcatctgaagttgagacagtcacacaattcattactatcagtatcatagagagagaaatgtgcttcaagatgccacatgaacacagatgaaggcacacaataaaattaggcagtatttgttaattgctgataaacacaacacgtattcagaagctgtggggatcagcaaaagcaaaagatgcatgctctctatcttttaagaagagtctaaagtggttagaggaaaaagaggaaaacatacatgaaaataactattacaaaaagtttaagcacaagttcacattgaccaaaatatgtaccataggacaagttccagtggatttatcaaatattaacaccttttaagaattttcaatagatttttgggtacaggtggtgttcagttacatgcaaaagttatttagtgattatttctgaaatgttggtgcacatgtcacctgagcagtgtacactgtacccaatgtgtagtcttttatccctcaccccttcctacctttcccccaagtccccaaaatccattatataactcttgttcctttgcatcctcatagcttagctctcacttataagtgagaacatccaatatttggttttccattcctgagttatttcacttagaatagtggtctctaattccatccaatttgccgcaaaggccattatgtctttctttttaatggctgagtagtattccatggtgtgtatataccacatttcctgtatccactcgttggttgatgggcatttaggttggctccatattttgcaattgtgaattgtgctgctataaacatgcatgtacaagtgtctttttcatataatgacttcttttcctttgggtagatacccagtagtggtattgctggatcaaatggtagttctacttttagttctttaaggaatctctatactgttttccatagtggttgtactagtttacattcccaccagcagtgtagaagtgttcccttttcaccatatccatgccaacatctattaaattttgatttttaaattatggtcattcttgcaggagtaaggtggtatctcattgtgcttttaatttgcatttccatgataattagtgatgttgagcattttttcatatgtatgaggcgtatcaaaaaatttttcttatgccatttgtatatcttcttttgagaattgtctattcatgtccttagcccactttttgatggaattatttggcttttttcttgcttttttgagatccttgtagattctggatattagtcctttgtcgaatgcagtttgtgaatattttctcccactctgtggggtgtctgtttactctgctgattatttattttgctgtgcagaagctttttagtttaattggatcccatttacttatttttggttttgttgcatttgcttttgggttcttggtcatgaactctttgcctaagccaatgtctagaagagtttttccagtgttatcttctagaatttttatggtttcaggtctcagatttaatctttgatccatcttgagttgatttttgtataaagtgagagatgaggatccagctttattcttttacatgtggcttgccaattatcccagcatcatttgttgaatatgttgaatagggtggcctttccccacttaatgtttttgtttgctttgtcaaagatcagttggctgtaagtattttgctttatttctgggttttctattctattccattggtctatgtatcttttttattttctatagcctaattgtgaaagtggcatgtctatttttttaatacctttcttgttagtacaaaaaaaaaaagccaaactcaaaacttataaccaagaagttatatacatagtagaaaagtacatttaaaatagtttatttctctttttaaaatagtaggccaggcgcagtggctcacgcctgtaatcccagcagtttgggaggctgaggcgggcagatcacctgaggtcaggagttcgagaccagcctcaacatggagaaaccccatctctactgaaaaaaaaaatatacaaaaaattagccgggcatggtggtgcgtacctgtaatcctagctactcgggaggctgaggcaggagaattgcttgaacctgggaggcggaggttgcagtgagatgagatcgtgccattgcactccagcctgggcaacaagagcgaaactccatctccaaaaaaaaaaaaaaaacaagagtagtattacttatgtattggaaaaaccttgggaagcaaagattattcgtttattatttatttactatttaattttactttttaaaatagagacggggtctcattatattttccagactggtctcaaactcctgggctcaagtgatcctcctgtctcggccttctaaagtgctgggattacagacatgagctaccttgcctggccttaaaaatgattttagcttggccaggcgcggtagctcacgcttctaatcccagcactttgggaggcccaggcgggcggatcacaaggtcaggagatcaagatcatcctggctaacaaggtgaaaccccgtctctactaaaaatacaaaaaaattagcccggcgtggtggcaggcacctgtaatcccagctactcgggaggctgaggcaggagaatggcatgaacccgggaggcggagcttgcagagagccgagatcgcgccactgcactccagcctgggtgacagagcaagactctgtttcaaaaaaaaaaaaagattttagttcactattaatattgttgtagaaaaacagctcctattaacatttttcctcaggtttcttacgtgggttttttggtaatagtatgtattctttttttttttttttttgagacagggtctctctctgttgcccaggctggagaatagtggcgtgatctctgcccactgccacttctgcctcccaagctcaagcaattcttgtgcctcagcctcctgagtagcagggactacaggcacaggcatgtgccactacgcccagctaatttttgtatttttaatagagacagggtttcaccatgttggccaggctggtcctgaactcctgaccttaagtgatccacccacctcagcctcccaaagtgctgggattacaggtgtgagccaccgaacctggccaataatattatgtattatttatataaatatactgatttttcacatacactattaacataattattttctttttattatacatgcttcatagataggttttgtgatgaataatagtctttgcaggtgtgttttagttaatcatagtcctattataaggatattcaggctttttagtttttcagttacatgtagtactgtcataaagatctctgtagaaagcttttttcattttcaaagtgatatttttaagatgtattcctagacatggaattaccgaattgaagaagatgaaaatgttttaagttcttgacatttctgccaaattacactctgaaaagattttcaatatactgagcacagagtatcctcttttcaaatatttttaaaaatttgttattagggaaattacatctttccatgtgttgttaaccagctgtgtttctttttaagaaagttcttggccgggcgcagtgtctcacgcctgtaatcccagcactttgggaggccgaggctggcggatcacgaggtcaggagatcgagaccatcctggctaacacggtgaaactccgtctctactgaaaataaaaaaaaataaaaaaataaaaaaattagccaggcgtggtggcgggtgcctgtagtcccaactactcgggaggctgaggcaagagaatggcgtgaacccgggaggcagagcttgcagtgagccaagatggtgccactgcactccagcctgggcaacagagcaagattccgtctcaaaaaaagaaaaagaatgttcttcacccaaaatatattgggatcttgggattaagaaacaatctttttaatcaagtgttttgttttttttttcattttgtagccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcgtaagtccttcagttctgcccgtcagctgcctccctttcccctcaccagcctgtgtgtaaataatccggttgtgaatgtgcggtcatgaccatcatgtgcaacatggcagcaaacaggatgtaaagccaggccagatcatctggtcagccctcagtgatcagccaaggaaagaactgaatccaccacaccacatgcttgtcccttctcttctaaagtatcaacagagggtcagactccagaacttctcttggttgtgcattccagcattgtattggcctaatgaattagtttcccaaagccacagctgtgatttaataacagcagaatgtaggcaaagcaggagtcctctgaataggcaagtgcccttttcctcacttccatcttaggaggggatgtcacaccaggtggtttagaagaagcagtgatgggctgggcacagtggctcatgcctgtaatcccagcactttgggaggcccaagcagatggatcacttgaggtcagaagttcgagaccagcctggccgacatggcaaaaccctgtctctagtaaaaatacaaaaattagctgggtgtggtggtgcgtgtctgtaattctagctacttggaagactgaggtttgagaatcacttgagcccaggaggcagaggttgcaatgagccgtgatcgtgccactgcactccagcctggttgacagagtgagattctgtctcaaaaaagaaaaaaaaaaaaaagcagcagcagcagtgatgacacaggagaagcagtcagggggtagcctgatgagaaagtcttgctttcacagttttttctctgtcttatctcttccgcatcttattcccttttgataatagaaggtccaatgcatgtcattccacatctgtgttcctgttttcaacttttccctattaaaaaaaaaaaggaggagaatgaaaaaccttgtataaccaaattatttactattagttaatttagagtgatgagattggaaaggggcatgaagattatctttttctctttatacaattctgaattgtttgacttattacaaatagatatgttacttttgtaaataaccaaacaagaaaagaaatggctatgatagcctagttttaatgagttacaaagcagatgacttcacctgtactgaagaaatgtgtgcttggctgtacagggatgtacatgttacctctactacagccccacccaatttaggccccttctgctctgcagccccactctgcagtgcacacaaggaaggaagactgcatttagagtcagattaaaacaagccctgagcactggctggagtgtcagttccccaagaatattcacccatccccagaggctggcagatagtattagagttgctcagtctttgtggaaagagtgaattactgttgcaaaacagaaatgacttttcttccaaatagtcatccaaacttccaagcaaatcaccgtaagatagtatgatgctcattattcgagtattcagacataacaattgttgcacatggcaatatgcaattacttttggaaacttctggtagcttagcaagataaggggtgagctactctgttacttgtttatttccgagtgtccacttgtgagtcctcacatgccctgtctcaaaaacaaaagttaacaaggagcttcttgccagtggtgtctgctgctctttccttactagagtgttatatatctgacctaccgtttgtggactagcctgggaactaattatcatttataacattacatctttgaataaaagagtaccaagtatcaaacaaccaacttataaacaaatattatgaatataacagccttgcaatttaataactttttacagttttgaatattagagacccatcactttgatggatttatttgcccttcagttattaccaagtgattctgaaaagtccaggggttactaataagtgctgatttgactgctcctccctgccaggctagtatggaggagaaagacttttcactcttgaaggaacacaccatgctcttctccgtacatctttgcactctctggttttggttttatgtttacaaatgcctgtgatatggggggaaaaagaatctttgtttaagaaaaaaaatcagccatgtgctaatcaggtgatagaagagaaagagatctaaggcggcactgatctaagccagaggtgggacatttaggataaagttaaaagcagaacatgggctgggcacagtggctcacatctgtaatcccagcactatgagaggccgaggcaggcggatcatgaagtcaggagatcgagaccaccctggctaacacagtgaaaccccatctctactaaaaatacaaaaaattagcctggcgtggtggcatgcgcctgtagtcccagctacttcggaggctgaggcaggagaatcgcttgaacctgggagacggaggttgcagtgagccgagatcgctccactgcactccagcctcaaaaaaaaaaaaaaaaaaaaaaaagcagaatatgaaagactaagtacagttcaaatgcagtggtgactttgatttatagcaagaacaagttttccatttgctctatatggaaacgtaaagagattttgaaactgctttaacaagggctgccacaagaatttcttttattgacttgaaaaattactcctacattcatgatgtcacaaaatcgtatgtatttttcagtcatggtttcatgcatttttattctataaacatacattataagtatacaaatatagattatattctataaataattcaaggatttataacatatctaaagatacattccttataaatatcagggatttttctgtataaattacttgtttgtttattattattattattattttgagatggagtctagctttgtcaccaggctggagtgcagtggcgtgatctcggctcactgcaacctccgcctcccgggttcaagtgattctcctgcctcagcctcccgagtagctgggattacaggcacacactgccacgcccagctagattttgtatttttagtacagacggggtttcaccatgttggccaggatggtctgacctcgtgatctacccacctcagcctcccaaaagtgctgggattacaggcgtgagccaccccacctggcctataaactatttatttattagcactgtgctagtggtttaaaaagaaaacaaaaacagatatggtccccgccttgcagagcttgctgcctaattgtctggtcaccgagtggcctgacttcatggatggctgctgcggagtagcagttgaggagcgaagaggtcttacagaacacccacaggccgcatccagaagcctcactcattctccctgatctcagaatgtccttttcttttcagctatgcctccaacaaagcaagtaaagctgcttccgtccttctgtattctctgtgggcacacacggaactgcatcatgcctacaagaaggtaagaacatgaacaaggaatgtgtcatagttaacagagccaggtaataatggcccacttgacttgaccctgggaagaaatcgctaaaaaactgcattttcttgtgtgccagttttgttacctttcacgtttctgtttgcttattccaaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctatcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaaacaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaagtagtgttgcttgcattggcgtctgtgtatatctggtttatttgtgtatcttggaatatatagtatgattgacataaaatttgaggatttaaccttataaacttcaattactaagggtttgatactttgtaattagttatattttccccttaattaaaatcctaaatttttaccaagagacatttcctgtgagaatggtgggactagatggtgacctgaccataaaaatgaagacacatgcagacgtgttagctgcggttagattttagtatattattgggtgattctgtgactgtgaaaagacagactacgtttgatttccatgtgctgctttgttcactctgtttgcaaacacctcactactttacaatttgtgaacacctctcagggaggttcttctgtgaatgaacagttttgatcacaggtctatacataaatgtgtttgttttcctatgtgtcccagacagggcccatgccttcagagaaactaatgggcaaagctgggcctttttgtttatttgttccaaagggctgctctctgtcaagaattcttaatggtcttctggaatgaagggggttgctgccctagatttccatcactggaaacgtttgtgtagatctgatggcaataaccaaagggttatctgataaaatagagaggggattaacatgtcaagtgggagaataagcagcaggactagataaaccactataaaaccaatttaatcaccttctgaagaagcaatttcttagaagaaaacaggagatgggagatatatatatatatacacacacacacacatacgtttatatatagacacctacatatatatatatatgtgtgtgtatgtgtatgtgtgcctatatactatagttataaaatgagatttcccctaaataaaatgtctaatgaacttactgctttggaataaggaggacttcagtatgtgtgtacattgaacaaaattgcagaagaagcctcaaatcacagaatctcaggattaagagggaatttagaaggcatttggtcaaatcctcctcaaagtatcatcttgcatgaaaaagattcagttcttattaatgtgacagaaaagaaaaacatacagtcatacactcaactaatgctcaacatgaccatataactggctcttttcaagactcactgttggattaaagtatttcttgtgggagggaaaatagataagggagcaaacttttcaaaataaaattctgctttaagtttcatgttttagtttatagtgatactgacagtttcatcacttatgaagtaaatgttaacctttgaaggactataagaaaaactctttgtgatatgatgttcaggaaagagctcaaaaatcccaagcattggcataagaattgttgaaaatatgagcagaagggaaagtgccctgaaggccctagtctgggagactcagtgaaaggatccagcagtccttagcctgagaagggtgctgtgtcacctctctgtacatatttgaaagcccactgtagagaagatgataggcttgttctggcataacacagaggatgaaaccaggatcaatagggggaggctgttatgagactagctttgatagggtaatagtggacatatattgagtacttctcacagcctcatgaaatcatccttttctttttctttttcttttttttctttttttttttttttttttttttttgagacagagtctcgctctgtggcccaggcttgagtgtagtggtgccatctcggctcactgcaagctccgccccccaggttcaagcaattctcctgcctcggcctcccaagtagctgggactacaggcgcatgctaccacgcccgggtaattttttctgtttttagtagagacaaggtttcatctcgtc

SEQ ID NO: 12392 - DNA, 23928 bp, Human
tgagtaaagatgggcaaggctttgttctgtggattcggagctggagatggaaaggaacagagtgaggagccctgaaatcctgaaatgaggagaggaggctgtccctttcctcctcaggctgagggggaggaatggactggtctctccaggcccaaagtggagagggggctgatggctacaggacagatgaaagggagggacttgggtgccgggaccagggcagccgcaggtgacaggtgcaggggctttgggaagggacagggatttcccttgcaaaatccattcaaacagatatcgagggaacctgatcccagggaggaacccagaacagcatgggctgccagaggggcccccagaagggccccagactggagggagggagagaggagagatgacgctaagggactgggggaaacgaggaggaagagtcctctgaattgttaccatttccaggaggcttggtcaggccctgctccggctccatcccccggccctagaattgctcttctgcagattatttctgtgctgggaattcccttagctccagcctccactgggcagtttattatcttaattccgcatgaagagtgtcctccctcaccctccaccctgccctggaccagacctccagccgcgacaattctagggcctgggtgagggtcttaccgttgttgggggtatgcaaagccccatgggggggtgacccagggcaaaaggccaggccccagaggggaaggaagtcttgggtagagctccctgcctcccaggctgggctaagaagggcgataagaggagcagattaggcaagaggaagtgggctgggctgagctggactggtgctgaactccctgggcctggggcagagtgtgggtcaggcacctgagcagctggggctgagcctggccaaccagagcagccatccctccgccccagccccgctgcaggctggggtacacagcagaggcgggcacacggaggagagcgcagtggaggcaggggctagggctgctcagtgggggtccaggcctcaggcagtcccagaggcccagaggtgggagtctggtgaggtgggtgaggggagtgattgccttgcctcatgtgcccctcattttctttctttttttatttttttcgagatggagtcttgctctgtcgcccaggctggagtgcagtggcgccatctcggctcattgcaagctccgcctcctgggttcatgccattctcctgcctcagcctcccgagtagctgggactacaggcgccgctgccacgcccagctaattttttgcatttttagtagagacagggtttcaccgtgttagccaggatggtctcgatctcctgacctcgtgatccgcccgcctcggcctcccaaagtgctgggattacaggcgtgagccaccgcacccgcccgcccggcaggtgcacctcattttcatgggggaggaagcattgagaaagaggagccgtgtgttcagcaaactttgcttattcaaaacactccattccagctgggccctgtccccaccccacccctgcctctacggtgctcccaacctttggggtcagatgcccatgctctggacccttcccctgaggaggtcctttctcctagtgagctccctgtgccttccctcagtccaggcctgggcagcagtctccccagctggtctccatgtcgtccttctccagccctcctgggccaaatctgaccagagaccaccacagggactgagaggccctggctccaaggcgacccggcctcatgaccacgtctccgctgtgagcagcgcagagaaggaagcccagagcaggaagtgctgagaggcacagggtggggctgggggtgggggcgggggcctccagaagaggcgggggcttcctgcttcagcctccttgggcagaagcagtgaccacaggcccccatggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgtaagtggggcaggggcctcagctgctggagcaccaggtggtgggggccgggctgctacggggctttgcttgggtgggaggattggtttatgtctcctaggatccaggcgcctgtgtggtttggccaggcagctgacaccactgcttggataaacaaacctgggattaagggtgtatgtccccagctaaagggctaagccttggttctaggtgtgagaagtgggtgagctgcctgggtggtcactggaggtagtttatttgggtctgcttctcttctccttcaaacccccaagagaagaggaggaaagtgcaccccagagctgaggcaggctaggaggagaggtgagctcgtccccgctcccagcacagatgtcttgcccttgctccggcagggcgctcagacccagctccttcaccccctccactgggcatcatcctgtccagggaagccttgctctcccctgcgctgctgtgggggcagccacaaaaggcccctggacctaagtgagaactagaggcttctgctcccagggaaggagctgatttgacttctgctaccccttgctgggctcagcattgctccccgatgcaggcctgtcagcaagggaaggggaagacactgctgcaccctgcagccctctctctgctgtgtctgttccttcctacacggggctgctcccaggctctggttctcctggcccctgaaaatgttaccttaggccagggattctcttaggctggagagaacaatatggagatcctccttcagggaggggaggctgctgggctcgcccagtctgagagttagagtgctgggcttgtcccaggaagggaaatgaaggcttggtgggggagggaagacagcccttagtgctgacttgtccacctgatgggaggtgggatgagggggtctgggtctaggcccttcggggctgggctaggctaggggatctcgctgcccatgactatgggttggggccctgtggtgagatgcttcctgcttccctaggagtgatgtggggttggtgtagcatggcagtggcatggaggtgacatgccccaggagcctgtggaatgagggaagtggctcagaatgaaaagcgaagtggcctctctcagttcctctgggcagtgtgtgtaacctgactgggcagagggtcacagggtggcagtggaggtcgggggttggtggccagcggagactgtccttcttcctaagctggcacctgtgtacctggctgttcccttcccctctccaaggtagggcattggatgttctctggatcctgacctgcacaagcaagaatgtcccaagcctatccacaggtccatgctgctgtgagacagggctctgctttcaggctgcttttggcacagttagtggatggcatgggtgtgctgtgccatgttgaataagcagaatacataggatgtaagcaaatcccaactttatttcatctcccatggcctctttacaatatatttggtaggagaagctctccccctggccatggaaagaaactctgcaaggccacaagacattatatttactctcaggtaacacagtccagtggtcacttttcatcacaaaatccagtccgatgtcagaaactggctataatcaaaactccaacctttatttacactgacatcttctacccttctccttctaggaatggtttcaggtaggctgcaggccccctggaaagggccttggtgggattccctgctggtcctgctcaaggcccctctaggcatgagctatagggagggaggtgggaaaggggtaaccaagttctatttaaacaggtgctgtcataaattggctcatgctttctgagcctggcagaagcttaaagctgattctttctctggaggacatttttgaggattcttgggagacccaccccttcgaatgggaacctgttgcttgaagtccccccagcatttctattttaggggtcactcacaactatgtcttcagccccttcttaccaccttcagcttcctgtggctttaggccctttgcccccactctcccatgggcccaccctggaccccagcaaatacccatgcatccattgtcccaagggtgcaggcttgtccaacaggccagcaccccctgctctgcctcacacagttagctcgctgtagtccactaggtctcctgggcaggagtccgacctctgtctgttatgcctacaacttcaaggatcacaggggcctgttgtggggtggggggaaaggggagggagagcattaggacaaatacctaatgcatgcgaggcttaaaacctagatgacaggttgacaggtgcagcaaaccaccatggcacatgtatactatgtaacaaacccacacattctgcacatgtatcccagaacttaaggtaaaaaaaaaaaaaaaaaaaaaagagatcacaaaagctctctaagtagagttgaaacccctcactaggcttaaggtgggggatcaggcactccaactctcccttggggaggtaagggaatggagctcccaacacagctttcttaaaattggcttctccacaaaaattttcccttttccctgtactctaaccacctctgatctgagaacattttttggatcattcaccttgtaaatgctgcatttggtctgttttagtatacggcaactattgtgccttgctggaaaccttaattttaatatcttgttatgtacacatacaaagaccgttaaactaaaaggtagcctatgtgctctgtcagtgagtggaacaggactttagaaggtgagttcattcattcattcattcattcatttgctcattcagcaaacaccacattcaagtgccaagcaccaagcaccaagctcaaggtctagcacaggcttgttgtcctggagtccatgagtccctggggatttcctaggtgggcttgtaagtctgtgactcacatccccccagttactgtagcacatttcaggaagggttttcagaagttggggggcttgggttgtccttgaagttatttcaagcagaggagatttgggcacttaggtttggaggtgggaaggcttggtatctttatgggacagttgaatggacagggtaggaggtgttcatggagggaagaaggggcatatgggaagttaggttgcatctggattgtgcagggccttggatgctggtgcaggagtttgggctcttggctctcgctgtgtcaatctctcctgggtggtagtaggcagtctcgctctatgagatgaggtaggggccaagatcctctttagggtctagagggagaatgtctatttgggctttagaggggaaaacccttctcttccagaaatggcatccccaatcctctgtccctcctggtgcttagctctagacaacaaaaggaaatgccttcagatttctgggatgggcacctcctgggaagataatgagctctgaaacccctggcctggaccagggaggcttggcctgaggtcttggaacagagtgctggctccttctctctgcaggaaactacagttgcctctccagttatcctccgtgtggatcctaagggctactacttatactggacgtatcaaagtaaggtgagaaaacccttgtgtgccatggccctggactcctgcttatcattgaggccagacagccccctggctgcaccaaggtggaggcatggatgctggggagtacagaatggcctggaagggtggctccagaggctcccctgtaggcaggggctctttgctctggaaaggaggatgcagtcactccaacctgtggctacccaaatgttccatccttagcatcccttggggagagagagagacaggcgaaagcactgctgctgaaggctgatgctctgcctgtggctgtgggttgacttggggctctgggagatgagagataggccccagcctctgggcaggaggacgggaaggggaagctgggaagggtccaggatggtggaggagacactgcaggctccagctccctgccagggaggaatggacagagggaaagggaggaggatctgcatgaatagagagaacctgggccataggaagggaagtttgggtccagctggccctgggcagcctggcatctagagagaggtgttggccaagatttgaagggtgtggaagctcccttctccctattgcttattcttgacctggactttttgtcccacatcccttctttgctcccaccgggatccgcaccctgcccccaggagatggagtttctggatatcaccagcatccgggatactcgctttgggaagtttgccaagatgcccaaggtaggtgtgtccagtagcagcccaggctcaagcacagctactagctccatggggcaagggcaggggtccctgtgggggtgggaagcctgacttctgaagcacggggaatggttccttggctgggcagcaaggaccgtggctggaagccaaggaaggggagcggcagctcctgggctcgcctgggctctgagcttcagaactgcgcacagtgagctgagatggcagggatctgggaggaggggtcacctcctgcccctaaagcaccccagtctgtctgggaggggtggcttacacccccacccccggactagtttgcctatatttgcctaatgctggtaggaaaattggaggaagggattggtgggaagcggggtttcctgagactgggagctaagaatctatcttcaaacaaaagtggcaaccaacacacacaggactcccaggccggcctccccgcctgcccgccatcttggctaaccttttcctcagggcctctccttcccatcccagccgctggagtcagggacaggaagatgctaaggcctgtggttcctgggatggggatggggttctgcccagtgggccatagcccaagtggctgaggggagggccagagagagccacactgggcagggagggagcacacctccatcctaaccataccaccacgtgctgcagagccagaagctccgggacgtcttcaacatggactttcctgataacagtttcctgctgaagacactcacggtggtgtccggcccggacatggtggacctcaccttccacaacttcgtctcctacaaggagaacgtgggcaaggtgtgccagggagcactgggcctgggtctgggcccctgggatagcctggacttcctgagagacacaggcctgggcgggggtgctcaggagcctgaccgctgctctctgtggtcctgcaggcctgggctgaggacgtactggccctagtcaaacatccgctgacggccaacgcctcccgcagcaccttcctggacaagatgtaagtgccctctgcctggcctgagccctggtgctgagcatgccagccctgggccttgacgggctgctttctgcccccagccttgtgaagctcaagatgcagctcaactctgaagggaagattccggtgaagaagtgagccccccaacccctccccaggcttccaggggctccccaaagcctttctttctcaggcctgactcctctctgtacctggtacctttctctgccccttcagctttttccagatgtttcctgctgaccgcaagcgggtggaagctgctctcagtgcctgccacctccccaaaggcaaagtgagtggatctgcacccctgcccatcccccagcattcttgtccccaccagaaagcaacttggccaggaatggtgggtgggggagcagaggtgacatcacagccccagccaagagcctggagagccaatcaaccctggagctgctggttactgacactaggcacaggggtggagccagggcaagggagtgagaccctgagctccaagcaggtttgtctatatcccctaccctgggtggtgggggcgctggggctgtggttgatggactgtgttcagggcaggcagcagaaacggcatgcattcccagtctagtgttgggaatgggagctgagcgtgaatgttttcagcctggaggagcgagataaggtcggcagtggcaggcggcagtctgcagggatctggaagtctgcagcgtgtcgagggagaggaactgaaccaaaggcggaagctgccaagatgcagacttctgctctgtacagaaaagcatttttccctgtctttttagttaaataattaatttttaattacaagttgtaagcagggtcaccccatgaagcaacttgtgtgaattacaaaaaggagccctctgggctgatatggccctgagctaggcttcaagcctggccaatggagcgaatctcagcccctgtccctgcttggccagtgctcttgtgtgggtcccagcctataccccatggagtattttctcctggtaagaatttggaatgttataaataaataaaaccacgacccccattgatcacctgcccacatgaatcccaggaggagcatttaccccacagccacagctctgcagagttggtgactccttgatgcagtcagtcacagggatccaaatgtggcgttggggagaggtaggaatgggctcctgcggctcccctacagccagcaacacttacctgtggtcagcacacatccaccctccctctctcctgccgcctgagctcctcccttggctaagtcctccttatctatctgctttccttgtgtctcagtagaggctactgacccaactttgcttggagctgaagctccagagacagggaggggtttggggagatccagttagactctcctgctcagaccctctgctccaaactaagactgatgttggccttccagtgtgattctgaaagacatttaatgttttttttggggggggaaggaatgcaaaggtgcagaatccctgaataccacaaatgtacttttcatttctatttctatagatttgcctattctggtggtaaagtaaatgaaatcataaatatatgcttttcgatgtcaggctgtattcatttctcataatgttttcaaggtttatccatgttgtagcatgcatgagtacttcattcctttttaccacctaataatattccattgtatggatataccacattttgttcatctgtttatcagttggtagatgtttgggttttttgtactttttggttatgaatattcatgtacatgattttgtgtgaacatgtgtaaattctcttgggtatatacccaggggtggaattgttgggtcatgtggtcactctatatttaacaatttgagaaaccgccaaactgttttctaaagtgagagcattgtgtagggatttatttatttatttttgagacagagtctcactctgttgcccaggctggagtgcagtggcgtgatctcagttcactgcaacctctgcctcccaggttcaagcaattctcctgcctcagcctcccaagtagctgggattacaagcatgtgccaccatgctgggctaatttttgtatttttagtagagatggggtttcaccatgttggccaggctggtctcgaactcctgacctcaggtgatccaccctcctcggcctcccaaagtgctgtgtggggttttaggttagtcacatcccgctgacacttgtgattgtctgttttttgttttagccatcctagtgggagtggtatctcattgtggttttgatttgcatgtctctaactacaaattatattgagcaccttttctgtgtttattagtcacttatatatcttctttggagaaatacctgtccaaatccattgtccatctttcaactgggttgtctttttgttgacttatctcttatcggatatctgatttgcaaatattttatcccattctgtgggttaccttttcactttcttgatggtgtcctttgaagcacaaaagtttttaattttgatgacgtttaatttatctttctttgtcccggtgcttttggtgtctccaaatattattgttgaattgtcctcctttcaattctatcagtttttgttttatatattatggggttctgttgttaggtgcatatatgtttatattcaaattgcttctttttgaatatttgtcctccacttaaaaaagatagcctactagcctggcaagcagcatcatttcttctgacctcttttctacctcattctggttattcttagttccgatcctgccccagccaatggaatagccactgtacaaaatcagggtcagagcaaaccagctaagcatgctctctgctcagcaaccagggccttgagaagtggatgcttgggtgtccttgaagttcttctgtctgccttgagcccgccttctgaccaggtccccttgaccagggctgggccgagtttgtggttcttagctctgagaaggtgagggcaggggcaataaggttactatgcccctagaatgacgccatcaatcctgaggacttcccagaacctgtctacaagagtttcctcatgagcctctgtcctcggccagaaatagatgagatcttcacttcttagtgagtttcttgggttgtgctggtcatgggaaaagggtggtggctaacaatcccctcctcccacctgccatgccgggagtcaggaggcttcactggacaagggggttgtctaagcctccaggcccaagggatatggacctgtgctcttctctctggcttgaagccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggtgaggactaagggaaccccttgtcccctgtggtcctgtcctgccttggcagcggggttgtagcctgacagctatctcctgtcccccaggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacaggtgggccctgataacattggtgccaacctctgctttcacaggggttccctgcatcctccacaggggttgcccacatgctgctggccctgagaataacacagaccatgatggagtggcggtagggggagagctgggctgcctttgggtgatgccctcacctcttccccatcctctggctcagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagtgagaccctgggcacagaggctggtggccgtggcagtagggaagggctctgggccagaagctttgaggggttggagggctgaagctagagaagatgaatggctggaaggcctcagaccattggggaccagcagggattgggggccaatggcggccatgcagttatatgtgtgtattgaaactaggcaggggggaaaagtgctatcacgagacaggcagtcggaacgctgaccttctgttcatggagtctccttctcctccaggaagcaattgaggctattgcagaaagtgcctttaagacctccccctatcccatcatcctgtcgtttgagaaccatgtggactcgtgcgtatccaggcccattcagccacattctcacccagcccccagtctcctgtctgcaactgtcctccccacaactgccccagcctctaaccattgcctacagcttctcccacgtctcagtataatcaccctaaggcctcatgttctcctgctcgagtcccagcctccctgacctcctggcccctgatctgggtcatcaagggcacaaaaggatgcataatagggttggtgctgagcggctgaaccctatccccgcttttgctccccgcagaccccgccagcaggctaagatggctgagtattgccggacgatctttggggatatgctgctcacagagcccctggaaaagttcccagtgagtgggcttcgctgtgggacatttgagccttgggcctgggaacctggggcagggtgagaaccaggttagggagggagacactcccagaggatgctagggttcacttggttagatgcgggtctgggatcctgtcaccttccgtgtgtcaggcactgggctgggcttcagggtatgctagtgacaaagacacagtcactgccctcaggtgtattaccctctagtgaggagacagacaagtaaccaggccattacaatccagtggttgttatgggagcacctggggagttctgatctggtcttggggatcagggaaggcttcctggaggaagtgatggacagggctcctagagtagcctgttaggtcctcctggtgcagatggccttgggccagggtcccatactcagggacagctacaacaagcacaagatgagccgcatttactccaagggataagctggatttatctcagtgagaatggggatgataagcagtagtgagaggcaggtcaagaggagtgggggaggccgagggagcatgcctggtaataaggagctcaggctatgccatgaaggtgagaagatggtgctgacctgctctccactccatagctaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacaggtgagtcggggaggactatggtggggggtattaggagcatctggaacaggagaggggctggacctggaggagccatgcaggagccagtgccgacagagctgtatgtggcagtgtgggctggcgaggaagggactgagctggaggaggaggaggtggaagaggaagaggaggaggagtcaggaaacctggatgaagaagagattaagaagatgcagtcggatgaggtgtgtgggggtagccccaggcccctctgtgtcatcctccaccgttaagccccctggatgggggccttgggccccattcctgggctctgcaccatcctcctcttctttgccctcccctcttctccttagggcacagcgggcctggaagtgacggcttatgaggagatgtccagcctagtcaattacatccagcccaccaagttcgtctcctttgagttctctgcccgtaagttagcatgagtaacttacgggtgggtaagaagaagggggatctcccccttccttggacttggggccctgcctataaatatccagccacggagtcaggcaaagggcttgcttaagtggcagtggctcccagtttctctagtgaggaacttggcaccaaacagaatgctctggagtgtgtcggtgacaggctgggcgttatgacaggccaccttggctgggatggcctggggctcctgcagctgcctgcaggctctgtggctcccagggctgaactgtgctgtgggctggcccaagcccagaagccctggccgtgggacatgagacttcctgagagggagtggaggcagagaaaaccaccagagcatactgcccctttgcatgcttcccctttcatggacagcccggctgtttacctgtatcttctctggacacaagcacagtacgttgctctcactctctgcatgtcccatgcacgagcacctctttctgtctcctcctgtgcacagctggacttctgtagcactaacttctcatccctgaacccacagcctgcatccccacctgggtacactcatggcatgtactacagttaatgtgcccctctccccagacgtgttcagccatagcttacatacctcactccctgtgcacatcaaagcatgtgttcacatttcatgtgtgcacagcatgttactgaccccctaggctcagcctggcatgttccccataccctctgtgcccatctatggcatgtgggtctcactctccacatccatggcacacaccccacccctgtgcatacacactgagaacacccctcaccccagcaggcactgtgattcatacacttctcccagaggttggtccctaaacctcaggtctcagtggaaatgctggggtggaggcatctctataggccagagggagctgccccaaaggggaggccaagactgagggaggggacagcctgataaaactcctcccctccctttctcccctatatagaaaagaaccgaagttatgtcatctcgtccttcacagagctcaaggcatatgacctgctctccaaggcctcggtgcagtttgtggagtatccttgaggtttcagtggccagggtccttggcttgggtggggagccagaggagggcctggggacagggcccccagggtaagctgttaggttctcctggtgcagatggccttggctagggtcctaaactcagggacagctacaacaagcgccagatgagccgcatttaccccaagggaacccgcatggactcctccaactacatgccccagatgttctggaatgctggatgccagatggttgccctcaacttccagacgatgggtgagggcattcccaggcccctaagaatccttccctggtccctgcgccccccacctttacatccttgaggggtctttggaacaggctggggagtcctgctgttagtgtagactctgggagcatgcccaggtgcgtgagaatttgggggtagaaatgcattagcctgtgcccatgtgcctgcgcatacatgatggatgtaaagatgccaggctgccggcgtgggttctggccgctccacccaggtatgtctgtgggccacctgccccagctgccccagctcccaccacaggccctcagcctggctgtggctttcctccttgctgcctccaggctgtggaccctgcctaagagaggagacactgcaaggaaccagactgggacaggagaagccctcatcctcacggtccacccaacctccccattcaccagacagcaaaggctgggaatggaggaaatggagactgggcacagccccagggctgggccttcctcactgagtgtccttgtccctccagacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggcaaggccctggggcacacaagtggccgggaggctgaggtcttgagtagaagggcacaggagcccacccctcactcaactcgcaaccccctcccctgatatcctggaaacttcagccccagccagttcctgcagtagcaagttgccttggaaactgcctcctcctcagcactggaggctgccacttggtccccatggaaaccaacgggaagggctgaggctggggtgggggaggggaggaagagtgggcagagtggggcagccggagccccaggtcctgggggaaggcattgttccctctttggctagggagggaggtgggaggcccacctcttcccttcatgctagaagcaccctggtcctcagagcttagctgtaacccgtgggctacacagcctctctactcatggccagagctgagtgaggttcttcataacacccaagaacgaatgcttcagctctaggcagccaggggccccagatgcttggggaagagcctgggtggggatttgatgctggttttcctgggcccctacccccaggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaaggtgggggccagggcatggcagggcagagtctgtctagttcttggcctctacttacagacaagaggaagtaaacaaggcagctccttgaccttcctcctcctcctcttcccatccctcaccctgggccctcctgtttcaagagtgcaaaacccaagtttacagaagtttacttggtaggcagagtgtgtgtgtgtgaagattagaggcagaaatgtgcactcagggttgaggttcccatgggagtcttttgccccactggatacccactggcaaagctgtcaagggctatctgtgccaggccccctcagccttgggctgcaaatccagccctcctcccctgtgtggaaccagccatggcatgtgctgtggggatgtctttgtatatggcctagagtgtgccctctgtctgtcctcaccaaatctggtgacactcaccatgttctcacactgatgctgagacttctggagccagggagggggtcagcttggctcctctctcccctcccagcctgtcatgtccccaactctccccagatcttgatgcctgagctggcctccctcagagtggctgtgatggaggaaggcaacaagtttcttggacaccgcatcatccccatcaatgccctaaattctggtaaggagtggggtccttcactgttccaagatcagcagcaggagcctgtgcacagggtggggcagcttctgggagggggcctggagtgaggccttacctaagccctcacattgtaaggagtagggcagaacagtacctctccaggaacctaagagaggcgggaactctgcccacctaacagaattgctgtaattttctgaaacggctggggcagtttctcaagtagctgacacttatgggcatttaaaatttgctaagggcttataatacattctcacttcatcctcacaataaccacatgagtagacactcatcccctcttcatagatgagtaaagtctcagagagttaaagtaacctggctgaagtcacacagccaggatggtgcagtgccagactcagacccttgggtcctaggctgtgtgtgcacagtgctggcaggaacgggctctggctcactgcctaccctgtcctgtctcacagggtaccaccacctgtgcctgcacagtgagagcaacatgcccctcaccatgcctgcgctcttcatcttcctggagatgaaggactacatacctggtgcttgggcaggtaggagcccatggcatgccaggagcctcggggtgtctgttcccccttccttcccatcaagccagcttccagagttggggtgggatccagatggggcatcctggagtgggtgaggacaggggagacttccagccacatctccatatacactatgttgtaatgtcctgtgcacccacccagatctcactgtggccctcgccaaccccattaagttcttcagtgcccatgacacgaagtctgtgaagctcaaggaggccatgggaggtctgcctgaggtctgtgttgcctgcactgctgccaggggctcaccagagattagccctatttatgggagaggctggggagagggccgagtcccaggctcggggagagagggctgtcaagccaccttcctgacctgctctccctacacagaagcccttcccactggcgagtccagttgccagccaggtcaatggggcgttggccccaacgagcaatgggtcaccaggtatgagcttcggtccgcacacctactgggggcacctccacctctgcacccacaggcacttccctttaaaaaatttcacctagggaaagtgcggggcagggggcacatactgcgactcccagggggcggtgtggaggaggcgaacggagccaaggggccccccagagcacctgccagcccagcccgtggctcttgcagcagccagggccggggccagggaagaggctatgaaagaagctgcgggtaaggcctgctgagcccggtgatctcggggatgagcctggggcgggtccggggctccttgggggttggacgggcaggacggcctggccggtgttgcgcctcacccgggcctccgcagagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggtaaggctcgtggcggtgccctgccctctgcagcgcgggtggcgcaggatctcagggcctgtccccacgtggcctccccaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgaggtggccgggaggggcagggcgacaaccccaccagccccaccgaccccaccccccatggaccccattcgcccctctcaccgacccaaccccctcaccgactcccctccaccgacccccgccccccgcactccctctgaacaacaaagggcttctcgccaagcttacttcctctccctgcagcaaatctccaaaatgatggagctggccagagagaaacaggcggcagagctgaaggccctgaaggagacgtcggagaagtacgactgcctccctcccacacctgcttcgcctcccagcaagggctcagccgcacaaaacagctccttcatgcctgtctctctgcagcgacaccaaagagatgaagaaaaagctggagacaaagagactggagcggatccagggcatgaccaaagtcaccacagacaagatggcccaggagaggtgagccctggaggggaggcccagggctgggcagaccccacttcaggtggaaaggggcctctacaaatggatcctgactcacttcccaaagatgcatctgtcccctggctctccaaaaagcggatcccacctgtcacctttgatcagagtgtcctcctcagacaaaacacggaggccaacactacatgggcagagctctggaggcagccaagcctgcagggagggagctgaggccttgggattgtagcctgtccactgtggtggcactgtttcccacggaaggacagtgtgttttgatggggaaatggttccctcagagggccccaggactcccagtggcccctacatactccttgggtccccacacctgcccccagctggttcctgccctatgttggatttctcatttgcctacatcctgcgtagacttcatgttaccctactctccctaggggttttctcccttttctaaaactccaattacaccaacaggttgaagagagagattaacaactcccacatccaggaagtagtgcaggtgatcaagcaggtgtgtaagggctgtgtccttcctaaacacacacacacacacacacacacacacacacacacacacacacacacactctctctctctctctctctcttcacaagtaggaaggggtggccccaggccctgactttgcccttaggagatgcactgcctagcgctgtccatgcagctggggtggcaggggacatcctggggttctggcctgtgtatggaggttggggtaccagcctgaagggatctgtctctggccagttctcatgtgtggaaatgatatgggctaactggcccatatcagggccaggggaggctgggactggcgagggtcaggggatgaagagggagtgaggaagcttcctgaggtgccaaggaataatggacctgaagctcccctagggatcattaaccacagaacacagctgccacctactgggtcctgacctgtgccaggcactctgccaggtgcctcacatgagctgtcttgtataatcttttacagtccagtgagacaggtgctgctatccttatcttacaaattttaaaaactacctaatgttaaggaatttgcccaaagtcttacaactagttagctgggattacagctggattctgacccagcttgcctgtctgtgttgtcctgattctctgccatccactcccacccagatgacggagaacttggagaggcaccaggagaagctggaggagaagcaggcggcttgcctggaacagatacgggagatggaaaagcaggtaacaggttcactactgggacccccagcagaactgaatgggttccgggttgtaaaggggccttgccccagggagctgccagtgagagggtaggggaagggggccatcatccttcactgtggggtcctgaggccctttcaaatgaggcagctctgcagatctccgcctggttaggatcccctttcctgagaggctcctgatgggctctaccactcccccaccctgcctctcaccccagtctcctgggagctccgaacatggatattgggcatctcctgttcccactgtccagggagcgagggtggccagcaggcccctcctgagccaggcaggggtccttgctgtctccacagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgtttcctgcttaagcctggtctctattctacaggtagaaaatgggggcagggtagtggagtgcccctgaaatgaaacgggctggggaaaaaaaaatctcttgggagctgaacccagggtgaggtcctttccagagtccagtgaaatggccctgcctctggacttgaagaggattcatttccccttctgctggccctgatgccacaatcactggaaaattatgtcaccccctcttcgcccccacacagatgtggcccttcattgtctccactctcggggttggagcagaagagctgagtgcaaagatgtcccctattttagggggagttccaaacttttaggcaatctaggcccctttaggaagacagagtggttggatgctcaggaccctatggcagctatggttgacctcaaaacttgctgtggaggggcttgtgggcagccactcactgcaccgatgacatgatcccaaatcccaaatagggacaggcactggcttaggaggcagagggggattgattctgggaagaggttgttttcttattagagttacagcacatgccgttagctgtgagcacctgttcctttggaaagtaaacaggtcctcctgcccccaccctgccatcccatccctctgggagtctgacctctgggattctaccaggccctggctgtagggtgaggtgagggggctgatcatttactgggctaaggcctagcattgatcagcctgctccctacatcattacagactggatacgctggggcagaccacctataccccagggtggtgccctatgttcaacccttctgccaggcactgggctgtaaaggtgaggattcgggcctagaggaactcactgacccaggcatgtgcacgtaagccagagccagagcccaatggagcccactgggcagcccccagattttgctgatgactgtacaggagaaggaaaagctgccttcccctcacctctgggccaggccacgcagagtctctgggctcccagtctggagctgggtagcccaggaatggggaaggcgatgcaatcctgcccccggagaggcctctgcatagcagactggggccttcccatgtggccaggcctagatacctgcctccctgctttcctcccaaaaaggcaaggtgtcccttaggcaaatgccatctctgggtcctggagatgaattagtctctggctgcaggggatgtatagaagaagagttgacgccttcccttggggtactggggcaggtgaaggacacctgggttccatcactgctgtgtatctatgggactggggcaaggctcccttcacgcatcatgcctcagtttcaccttttgcacaaagagaagggtccctacccctttcccaattccattgctgactcagactcgagtcccctgctgactcaccccgccccctgcatcccctgagcagccctctggatctcccagacacatgccaccaggcccaaccctgccaagctggtgcaacgtgacagcgtgagggggctggtgacacttgaggaaagaaggggcctgagagggaggcagttgcagacagagtggcagaccacactgaggcatcttggggagggagcccttctgccagcctggggcctgctgggaggacaggcccagcaggtgggacaggaggggagaggaggggaggtgagtatgacgtgcctgcctgccccctgcctgcctgggctccatctcctgtcagccttcagctccctaagcgacagcttctaattccggctgttggtgcctctgtgctctgcagcaaagtctcagctttttttcagctttgctgtttcttttctgttcagaacatactgagcccatagagaagtcagagcaaaggctccagggctcgagacctggcaccaccacccccttcctgccatgggaaccaactgctccttccaaagggtacccagcacagcactttctgccccaactcttcttccctggaactgtctcaatccaccacgg

SEQ ID NO: 12393 - DNA, 106199 bp, Human
  misc_feature (1)...(106199): n = A,T,C or G
ccatgctagtagcctgtccatttcctgcagagaaaaaagagagttaccagtaatacatgcatatatataaaacaagtggtaatatttggatcatatgcaatactcatgatggtataacaaaacacaacaaaaaatgtggaggcttaaaaatctggctttaaattccttttgggctgggcacggtggctcacacctgtaatcccagcactttgagaggccgaggcgggtggatgacgaggtcagatcaagaccatcctggctaacacggtgaaaccccttctctactaaaaatacaaaaaaaaaaattagccgggcgtggtggcagtcgcctgtagtcccagctacttgggaggctgaggcaggagaatggtgtaaacccgggaggcggagcttgcagtgagccgagagtgtgccactgcactccacctgggcaacagagcgagactctgtctcaaaaaaaaaaaaaaaaagaaagaaaaaaagaaaattccttttgcgttttgtttgtttggcttcacattcttgttgctgccacttaatttgctgggaaaccttaggcaaattacttaatctgagattcaatttcttgtctttttttttttttttattcgtgacaggatctcgctgtgtcacccagactggagtgcagtggtgcactctgggttcactgcaacctctgcccccgtcagctcaagcaatcctcccacctcagcctcctgagtagctgggaccacaagtgtgcaccaccacacctggctaatttttgtattttttgtagagatggggttttgttatgtcgcccaggctggtctcaaactcctgagctcaaatgatccttccacctcagcctcccaaagtgctgggattataggtgtgagccagcacgcccagctgagattcaatttcttcatctgaaaaatggggatatctatggacgaccatagcttattaataaaagaaaaaataagtatgaaaaatagggataatatctcactatctcttaggtagcagctgtatcaattaaaataacatggaaccaggagcaatggctcagagacagggtgcagaggctaaggcaggaggattgcttgagcccaggagttcaaggttgtagtgagctatcattgtgtcactgcactccagcctgggtgacagagtgagaccctgtctcaaaaaataaaaaataaaaagataataataacaataagatagcatgggtgaaatgttgaacacatggtagatttgcacttacctctttcttcctctacacaagtccttttcttcctctacacaagcccttgtcccagctaggtgaatttagacactctatcctaaaatacatctagcactttctttccatccttctgctcatgctgtttctctgcctcttcctctccacttactgaactcttatcagttcttagtgattctcaccattatatgagccagaagagaagcatataatacatatatgacagtatatccctggcctctgccataagtgcataattattgccaaatagttgaatgagcacctttagacttgtatgaatgcctcagaaaatcatagaattaaaaaggactggccaggtgcgatggctcacacctggaatcccagcactttgggaggccgaggcgggcagattacctgaggtcaggagttggagaccagtctggccaacatggcgaaaccccgtctctactaaaaatacaaaaatcagccaggcgtggtgtcaggtgcctgtaatcccagctctcaggaggctgaggcaggagaatcgcttgcacccgggaggcggaggttgcagtgagccgagatcacgccactgcactccggcctgggcgacaggagcgagactccgtctcaaagaaacaaacaaaaccaaaaataagccaggtatgatggtgtacacctgtaatcccaactactccggaagctgaggcaggagaatcacttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttattttgtccctaattcagccagcaaacgttaaaaaccatttatgagataatagatgaatctgaacagactgaatatattattaagaagcactgtcaattttttaggtgagaaacggtttgactattcaagcttaataaatccctagaataaaatgggataatgtctggacccacttccaaatggctccaggagagggggagtgtgcgattccgcaggagcaggactggccacaaactggcagctatttaagctggccgagtacgtgggggcgggggtcgttcctcgttatattctcctttttccttttttttttttttttttttttgagacggagtctcgctgtcgcccaggctggagtgcagtggcgctatctccgctcactgcaggctccaccccccggggttcacgccattctcctgcctcagcctccctagtagctgggactacaagcgcccgccatcacgcccagctaattttttgaatttttagtagagacggggtttcactgtgttagccaggatggtctcgatttcctgacctcgtgatccgcccgcctcggcctcccaaagtgctgggattacaggcgtgagccaccgcgtccggcctttttttttttttttttttttttttttttgagataaagtatcgatctgtcgcccaggctggaatgcaatggcacgatctcggctcactgcaacctccgcctcctgggttcaagcgagtctcctgtctcagcctcccgagtagctgggattacaggcacccgccgccacgcccggatagttgggtttttttgtttttgtatttttgtagagacagggtttcacgttggccaggctggtctccaactcctgacctcaagtgatccacccgcctcggcctcccaaagtgctgggattacaggctcgagccaccgcgcccggcctctctttcccttttttaggtttgaaagattccacaacaagaagttgaaaagtataaggcggtgaggcgccacgcgcaccgagagctacctccccagcctgccgctgcagccgcatcccggaagccggcagaagggcctaaggctctctcccgtcagggcggagcgccccatccccttcccagcgcccccaggatggacggccggttcactgacctagcttgagccacgcgccgaccaggagcgacagcaggggcagcagcggtaacccatgccgggccatcaggactgccgcgctgcgccgcgtacacccacggccccgctgcgcatgcgccctcatgcaccgcagcggcagtcgacccctatgcacatgcgcaggctgcgccaccacccgccccgcacccaatagttcagcagggggaaactgacggagcgaggcggaggactggccacaccaccttcaggaccgcccagggaattaaggaaaaccacgttgagggtcccggccgttccagaggccccttcactacttttctgaacctttgggacagttttcattccccttaagattgcttttgtgcgtcataccattgcaagaacagaaaggaggtttcaacttaacatttattgcacaactcacttcaggccactgctgacatcccaaaacacagcctagtaacacacaacttcaccttcaaggactgcagagatagaccaactatatataaataatctcgtggaaacgtaatttgggtgagaaaaatatgacgctagagactttgcgatgaatattttgcctaagttcagaagcttgaaaatacagttggcctacaatctcaaatttcacccaataaccgtggcccttagtcaccacaccttccatcatctttttacctctgcctgttcttgccctttacagttgcagctctctcaactcccttgcctctagttgactcctcttcccatttcctacaactttgtggcgggagcattttagcaaagccatttcaaaggcgttcaaagtccaactgatccaatgcatttactcagaaatttataccaacagggatgctttcaatattttaaattacttgagcatttatattagcataaaaattttaaaaccaaatgcttaacaatagggtagttggataatttaacatacgtccacataaaattaaaccattaaaatttgcttttcaagaaatatttaataacaaggtaagtaacatatgcttatctaacatggaattttatgtcactgctgctaaagcaaaacatcctgttcactggataaaagacctgctttatgtgtatacacttcagtgcaatttttaaaaatactataatttcagaacttccaaatttcaacagatgccagtgttctctccttttttcatatgggaaaatttctttcaaaattatttgaagcttggacaaaaattccacagctgtattcctcaggatcactttgcagtcttcaagattcagatacagaggaagcttcaattcaacctttcagagaagacattccagctcgcatgatctcatcaaccaagagaatgttggtggcaatcacagtgctgaaagggggacaaaaataagatggctcagatgattaggagccctaattcgactcaacttcccacttccaaccaagctgcacacattacatccaattaaatttcccccttcccctctacacatcagagggctagttcagtttccatacttccagctgatcacattattcatgggggaaaggagcaactaaacagagaacaccaaatgaaaaaagtatgattctctaacagtttagttttcattttcccaaacttaccaggagtgaagaagctgtttctttacacaatagttatcccatacgcctacttctgctgccaccattggctcacctaaaaggcaaccaaatcttaaaataagttcagtcagtaagaaccaacaatattgtgtgcagctttgcttatcactgatgactcatttcctccagtattaactatgagaattcaaagcttctctgttagcccaattttctactctaaaccatgacccccgtccacaatatttgatgaatgtctgacttatacttagaagtcctgaacacccctctcttcttctggatacatttctgtttactcatactgaagtatagcacttcaactataatctgactaaaatggactgatcatttccctcattccagaaaccttttctattaatgttgacaataggtcttgcacatactgcatggaggtacctgttatctcctactttgtacttaatttgtgttgttttgttacaggaacctaagatcagggctgtcaccatttcactagatttctacatccccttttctggcattaattgctatctttagctggttttcacccatgaatataatcaccacatctattttcttatcatagtacttgattaaaaactgagtaaggcaaatgcaatatgaaaatccttcaacattaatctgaaccatctaccaccactcaacatctccaaaattgtatccccaaattactcatgtctactcgtcccttaattatacctagtcattccattttttattaatatcctattttatcccattttagaacccagagttccctaacagcactggtgtcaaattgcaaagcaaaacatttttaatctttcctggcttcaactcacacgtattacatctagttttccctctacaacagttgcattctcttacctgtgttcaggtccacacccacaagctgacctgattctgaatgttctgcttgaattttaactaatgtttcctgaaggtcaaaaccagagttctgagcaagaacctaaagtaaacaaatttaattcttgagaaaacaggaactaataactgatagtaaaaaaaaaaaaaaaaaaaaaagaaaaaagaaaaagaaaatctcggcctggtgcagtggctcacgcctgtaatcccaggactttgggaggccgtggaaggtggatcacctgaggtcaggagttcgagaccagcctggccaacatggtgaaaccccatctctactaaaaataaaaaaaaacctggccgggtgtggtggcaggtgcctgtaatcccagctactcgagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaaaactgtctcaaaaaaaaaaaaaaaaaaaactcattgcataaagacagaacatttatgttcccttcagagaataccagacacaagttactgatcaactctctcaactaccccaaacccagcagcaatacaccagtcataaattatatatcaaaactggtatataatagaaaacaatgatatcagtctaaaacaaaagcaaaaagcaagtttgtactcaagtataacccctaatactgcaaatattaaactacaggttatctcttgccatctgcaatgtcagctattcaggcttcccagagaaaccaaatatatctggatgatgaggaatacctgttctagagtcagaaagaaaactgatcaaacttgcttatccaaaatccactttatgaataaatcctacattatcagaaaggtttgatcagctgaatcttttggaagattgactgttaaaagcatgcacaccttgggaataatgagcaatgcatcagcaaatgcttggactccaagctgtgccctgccctttacactgggcttatgtttaatcagggcttctgccattgccacttccacggcaccagcacctggaaccacacagcctgttggatgggggaaaaggaaaaatgctaagaaaactgcagaactaattatgaataacaaaatatacatatgaaagccattaatttcttacaaatttactatgacaaaatacaagtgactaacataccaaataggagaatggttcaaccagaatggcttcactagccactggcagctttcaacagatcagtattagttcatttatttgtattcacctttaataatgatatgctatgaaaaaccttagcataccatcagtcattctaaagggaagactgcttttgcatggtgtctggctgtgtaaactactgataaaaacacagtattcggccatgcctttcagaccagcaaaacaatataaaagaattgaaatacagtgaggatcttaccatcatcaatagcatttttgacagccctcaagccgtccctcactgcatctttgatctgagtgagtgtgtgcttatttggtcctttgatcaataatgtgacagaacgagggttgttacatttctcaataaaggtaaacttctcttctccctatgtgtagaaaaatatgattttcaaaaacaggatttgtgcagagtgaagagagaagagggacttacagagaatgacaagtagcatattaataaggaacaaacttgatcacattaaagcaaattatctccttttgaaaaatcacataaaagaaatgtgattttccccatcaatggcttcccattactacacataaaccttcaaaatgtatataaacaaaaatctgatcctgaatttcaattaatttttctgctaaagacttcatgaaccaggcacggtggctcatgcctgtaatctcagcactttgggaggctgagggtgaaggacagcctgagcccgggagtttaagaccagcctgggcaacacaattatgaacctgtttctacaaaaattaccaagaaaaaaaaaaaattagccagtcatggtagcacacacgtctgtggtcccacctgctcagaagcctgaggcgggaggatcacttgaacccaggaagatgaggctgtagtgaactgtgatcacaccactgcactccagcccgggcaggagtgagaccccacctcaaacaaacaaacaaaaataattcacgagctaaaaggttctattacctttaagaaaaaaatacacttaccaatgtatactcatatacaagtcctgcatgtcccaagcagtcaggacttaggtcgtcaaaagaattcagggctaccccaccacaagcaagagtcagcctgaaatagcattttaagggagatggataagcaacgttaccagtgaatttcaaagataagaccagtaatttttaggaaggaatttttcagaattacacacaaaattaaattttaaaatgtactttaagcctttccatttgccatcaaccagctaaaaactagtcttttctcttaaccctccatttaaaccactctccccaagttagcaaatgaaatctaaaaggtggacaagagctctttattagccaggcatggtggctcacacctgtaatcccaacactttgggaggttgaggtgggtggatcacttgaggccaggagtttgagaccagcctagctaacatggcaaaaccccatctctactaaaaaaacacaaagcaattcagtgggcatggtggcagacacccgtaatcccaactactcgggaggctgagaatcctatgaacccaggaagtggtagtcgcaatgaaccaagatcatgccactgcacgaaagagcaagactgtctcaaaaaataataataaaaaattttttaaaaaagctttttattgtggggagctctttggaaaaaagtatattgaattcagaaacaaaaagtaaaataatgtttacaaggggcaagggggagggagaaatggggagtaactatttaatgggtatacagtttcagtttgtgatgatgaaaaaagtcctagagatggacagtgctgacggggtgcacaatgtgaatatagttaatgccaattaactatacagttgaaaaacccaaaaataaagtataaggaaaaagaaataatcccaattcacttgcaaaatgagtaaaagtcaaattactcggatacctctccatatttctccttttagctctgcgcagagcgactatgccttcttttgaaagagcatctaaggaaaaggggtcaattccctgtaacaaaaataaaaattaatttcaacatctttcaccttaaaagtaaaaaggatgatacgtactatttagtttatacattgagttttcattctcaccttttgattaataacaacaaatcctttatctgaatcgccacagactttccttttcagttctattatttttttaaccctatcttcaatgaattttctttcagctttcacgagtttttctctctcttctgcactcttgtaaaaaaagccagaattcacttctctattaagaaaaaaaaaagttacagaaagcagggaaacattaagaaagcagcttctgaaactggattagtcctaagatttaacagttcactgagctccaatcctgccccttatgcatcttcagagactgtttcctatagctcccccaaaccaatttgagcattattgtccttacagtgggaaacaaagtttcacaaaaaagtaactcgcctaaaatacgaagcttctccatttcactgttaaggggctataaacttacgttttctcatactctaatgacacgttacaagtgaggatgtatgcatcctccacccttttcttcatatcaggatgccgtgctccgtggtccaaaacaagccctctgattaagctgtttaaacacacacaaaattatggttattgattttcagatgggtatttaatatattaaacactgaaatgagaaggtattgatatttcacgcagtcacatttttcttttttgagatgaagtctcgctctgttgcccaggatggagtgtagtggtgccatcttggctcaccgcaagctccacctcctgggttcacaccattctcctacctcagcctctcaagcagctgggactacaggcacccacaaccatgcccagctaattcttttgtatttttagtagagacggggtttcaccgtgttagccaggatggtttcgatctcctgatctcgtgatccgcccgccttggcctcccaaagtgctgggattacaggcatgagccactgcgcccggcctatttcttaaattacctgaagatcctacgctgtacagaaaagtctgcagagatggtctcactggtaggctgtcaaactgtgatgacgtcctttaaaaacatgttttctaccaagcacctgtaatcccagcacttacggaggcagaagtgagaggacaccttaatcccaggaatttaaaaccagcctgggcaacatagggagactccattctccacacagacacacacacacacacaccccaaagggaaaacaaacatgttttctaactaactctttgaaaaaaatatttttttaaattcctctactacttctcattatgctttgtacctagcaattcaataaatgccaaatgactgatgttgttcacttttcagaatcattctaaccataaacataacattcaccttatttcaggagaaaatattactaaaaacaatattctcctagcagtttatccaacttatatcttcaagtaaatatataacattttatatccaaagatatttttaaaattgccatctcacgcctgtaatcccagcactttgggaggccgaggtgggcggatcacgaggtcaggagatcgagatcatcctggttaacatggtgaaaccccgtctctactaaaaatacaaaaattatccgggcatggtggcgggcgcctgtagtcccagctactcgggaggctgaggcaggagaatggtgtgaacccgggaggcagagcttgcagtgagccgagatcatgccactgtacactccaggctgggcgacagagcaagactccatctcaaaaaaaaaaaaagccaactatctatattgtacaaagcacccctaaatttctaaacacagtttattttttgtttttgttttttttttaatgggacggggtttcgctcttgtcacccaggctggagtgcaatggtgtggtctcagctcactgcaacctccgcctcccaggttcaagctattctgctgcctcagcctcccgagtagctgggattacagtcatgcccggcacgcctggttaatttttgtaattttaatagagacggggtttccccatgttggccaggctggtctggaactcctgacctgaggtgatttgcccaccacagcctcccaaagtgctgggattacaggtgtgagcctccatgcccattagtatttcacagtcttctaccacctaccttgtatcagtttcagatttatgtttcatctccatgatctcaatcatgaagagatcaataggttcatcttgctttttaatggccaaaatggagtccactacagcctgcaattggaggagcataaccgttaagtaaattcaatttgcagcagaaacatgttgcttttcagaaggctaaagtaggcagtttcattttacaattctacactgatttaagtctttttctatcagcaaatagaatacattatatgtaaaaggcaacagctgaagtcatttacatttctgaaatctccatctataattcccaaacattaacattaattaacattaacattcctcgttttattaaaaatactggtaactggaagctttctaataaaaaaatctccactttataaaccttttaatgaaagcttcaattttacttttataacctggttaggtatactattattttaatttcctcatttttagagacacagattaggtatcattgccacaaaaatgaacctacacagcaccttgtaattgaaattggtaatcatattcatgtttctactatcagagattttctatataggtatactataccagacatagacaaaatttaatacatacctctgttaagacatctgcaagttcagcatgaactttagtacgaagagatgttctggccacatctataagtgtttccctgtccatctctctgcttactttgacttcttccaaaaactgaagggccttttcctttgcagcttcaaatccttcagtgattattctaggatgaaggccctaaaataaacacacattaacacttgcatcttcaattaggtgcaaccatagttcatgataaagttcaggtaattattgaaggagtgttctggatcatcatacctttgaacacgaggtaatataatgtgctggctttctgaatacatttaaaaggacaaatattcctttcaatgcagagcagatgaacaggtaatgaatgctctagcacagggtcaaagccaagggaactataaagcacacttgggtgttcactgtgcaaaccactctgaatcatttcaaaaccaacactgtgtcccaacaactcacagatggtagcattatcctatctttattttctttcattttttttgagatggagtttcgcacttgttacccaggctggagtacaatggcacaatctcgactcaccacaacctccgcctcctgggttcaagcaattctcctgcctcagcttcccaagtagctgggattacaggcatgcaccaccacgcctggctaatttttgtatttttagtagacacggggtttctccatgttggtcagactggtctcgaactcccaacctcaggtgatccgcccacctcggcctctcaaagtgctgggattatgggcgtgagccactgcgcctggactattctatcctttctataggtaatctcaaactaactcacatcatttactaataaaaataaagactgttctctttctccaggaaattctgacaatacattcatattcactgaggtttgctttaaccttggaactagtcagggctaaaaaagtggaatttatccaaatataagcttttggttgcctttttcctaacaaatatgcctagtcctaaacattccatttttagatctcaattattaatctacactaaagacagatgcaaatcacataggcaatgcaacttgattacaaaattattttcaggccaagaaaggttctataacctgtccaaggtcacaatttgttttagaccaggataaagacccagatttaagccccctaattctactgtatgacctcagctactattaacagcacatcaatttgtataaatatcagacacttcctatatacaaaaaaaaattacagaaacaagagttgtgcatacttcagaaatgtagagatccgcctgtttcagcagctctccaatgattaggacattagaagtcgtaccatcaccagttatatcatcctgggctgttgctacctttgctattaaggaagctgttgggtgttgaatttgctgaaagtagaaaaagaatgaatcacttaaaacaatatgaagcagtctaaatataccacagacaaaatgcaggaagggcctctttgagtgctatctacttgaaaaagctacccaaatgttggctacaaattacttcgattaactatcatgcacatgcaattataatgattgaaacgtcttcatgtgtaatttatttcccaggttatctctactttacagatgaggaagcttgaggctcagtagaagtttactcaagatgacagagctaccagttaacagtaacacataattgtacatccttgcctctttatggcaagtgtagagctctagtgagaataagccaggtatctcctaaagggcacacacattataattatttttgtaggtttgtaattttttcaaagaaaactgaaaaacagacttctggagattggagagaggttccaatgggacgagacttctgaggtggtagcaacaatttattagctacagtggtggttgtgtgtgtccattttataattatttcttaaattgtaaatgttcaatgtgcttctctctacctacgctgtatttctcacacactaaaacccaaataattttttgttttgttttggagataccctcactctgtctcctacactggaatgcagtggcacaatcttggctcaccgaaacctcagtctcccaggtttaagcgatcgattctcctgcctcagcctctgaagcagctgggactacaggcgtgcaggaccacacccggctaatttttgtatttttagctgagtcggagttttaaccatgttggccagggctggtcgtgaactcctggcctcaaatgatccacctaccttggcctgccaaagtgctgcgattacaagcataagccaccacacctagcccccaaacaattctgaagtcaagtttaactgtggctccacttttcaaacacgggccaccactgagcccactaaaaacaaaaactacacctcctaggttagcaagtccttactaaagatatttcatctggatgttgatggcatggtataccactagcaaaaccctacatattattctgaactcaaatcagcaggaaataatttccttttcttggatttgaactgctaagttttgggaatttagggatgagtaaaaagcatactcccctcaataatctaatattctccatccctaagacttgcaaagagacagatttatctcccctccagttggagatagagatgagacctaacagagaaactgctgttttaaaaagagaaaacccagctgggcacgggcctggtaatcccagcactttgggaggctgatgcggggggatcgcctgaagtcaggcgttcaagaccagcctggccaacacggtgaaatcctgtctctactaaaaatacaaaaatcaactgggcgtagtggcgcgagcctgtaatcctagctacttgggagactgagacagaagaatcgcttgaacccgggagggagaggttgcagtgagttgagattgtgccaccggactccaggctggtcgacagagcgagacttcgtctaataaaaaaaaaaaagaaaagaaaaatcatcctcatgcattttgcccatgtgattgtgtcaacctctcttaatttttcaagttttaaaataattaactttaatatacaattacagccctttagcccggactgtgaatggcaaaaaagcagggattcaaaggcagggctgtcagactccaggcactcaggactattactgattacacgccacttctgaatgttctcctaccttgaaaatggacactgcaaatctttctacaaagaaaacattctacggaaaatcaagacctttctgacctagcccagagcacctctcaccatttcgtgaagcagcacattgccgtctttagtaagtttgatgtctccagcgccagaaacgagcctgtttaaaggacagaaatgaaccagactatgactttttcaacgataactaaaagtcccattagaaaacgggcttttcccagattttagggagccagggatgtggggctagttatgtccagcaggatggaggacaggtgtagtgcccaccccgtccccgcagagattgtgccgagtcctcagggtgcctggaagccccagagggcggggaacgccgcgctctagagccgctttgttctccgcggagactgcatcgatgcgggaagaaatggccgggacggtggggcttaggagggacacaggaccgaccccggaggacgccgagaaggacggctgcgcagccccgaggcggcgggctccagtccgcggtcccgggcccgccaggtgcgcggcggcgcgcggtgcccgcccggccctccggttcagccccgccttacatcttcatggtgcccttgggccccaggttggtccttagcacgtcctgcagaccccgcgctgcgctgatgttgaccgccagcgccgcctgcgctcgggccacctcggccttggggttcagggtcttcaccgccgccatagctgctccagcggaggaaaaggaaacgatgctgagtgcccagagccggcgcggcgtggccgggaggaactatccgggtcttctggaaaagtcggcccgtctggccggcccccagcgtgcccgcgcgccgccgccattgggccacaggtcgtccggcgcccgctcattggtccgcggctgcacggctcctgcggtcccacccttcgcgcctcggccttgtcgtcatcgcgcacgggaggagcttgttcccggcattccgtgctccttggttccggcgttggagctctttggggcccagctttgcggacccgggagctcgggacgcaggcggggcttgtgctccgcgggggcagggcgtagggtgggcctcctacctcccctgatctcgcggtttgttccgtttcattggagcttcccggaccgtgtgctcgacggtgccctaggtgccgtggggccacacgcgagtctgataagcaccctcccccggaatcatgcggtgctgtgaggcctagcgaagatgaagatagaatgcaaggtagaaagtgctggatacctttagaaagctgcaggactggtgcgatgggagttgagacgtaagaacctgcccgtccgtagggctctggatgctgctgaggcccgaggcccctatggcagatttgaaaattcacccttgtagagtcattcctgcctttgagcggactcccttttaaggtaaatttccaaagagctccacaattgtttccagtatccagtgtcccgccaaataccagggattcagtaacacgtggtattttactttatttattttctttttgtaaacatagggtctcactatgttgcccagggtggtctcaaactcctgagctcaagtgatactcctgagttcaagtgatcctcccgcctcggccttccaaagtgttgggattacaggcgtgagccaccgcgcccggctgtattttatttttaataaataacggaaattgttctgaattcaaaaggcaccaaagggcatgtagtgaaaattaaatcttcctcccacttctagttcaacactagagacaagcaaagttacccctgggtactctatgaattttcggaatgctttctgaatttataaacttacatatgaatataatcatttccccacacaaatggcaattcataatacacactgcagggtgtgttatactttaagtgtcttggagattgtgccatatcaagactaatgggaagtcctcggtaacagcagcgtgatgttctttgtaagaatgactcaactaggggccagggctgggtggctcacgcctgtaatcccagcactttgggaggatgaggcgggggcatcacttgtgcccgggagttcaagaccagtctgggtaacatagcgagactccatctatacaacaaatacaaaaattagccaggcgtggtggtgcacgtctgtgatcccagctacttgggaggctgaggtgggaggattgctggaatctgggaggtggaggttgcagtcagctatgatcttgccactgcacttcagcctgggctacggagctgaccctttctcaaaaagaatgacacaactaaccggtcacctactgactgatgtttaagttgttcacagtctgctattcagactgcagtgaatatctgggtatatgatgctcttaggtgggtttgtgtatttgagaatcacaaaaacatctatatatgtgactagtagcactgcacgatagaagactagttattagttccataggcattacacggtgtgcatgcggatttattataactgctgttaaaaatgttatgaggaggccaagcatggtggcgcacgcttgtaatcccagtactttgggaagccgaggtgggcggatcacttgaggtcaggagttcaagaccatcctggccaacatggtgaaaccccgtctctgtaaaaatacatcagcctggcctggtggtgtgcatctgtgatccaagctacttgggaggctgaggcatgagaattgcttgaactcaggaagcagaggttgcagtgagccgagatcatgtcactgcactccagcctgggcaacagagcgagattcctcaaaaaaaataataataataataaaggccaggtacagtgattcacacctgtaatcccagcactttgggaggcagaagcgggtggatcacctgaggtcaggagttcgagaccagcctggccaacatagtgaaacccgtctctactaaaaatacaaaaattagctgggcatggtggcggctgcctgtaatcccagttcctcgggaggctgaggcgggagaatcacttaaacctgggagttggagattgcagtgagcggagactgcattactgcactccagcctgggcaacaacagcgagacttgtctcccaggcgacatctgatggaagcatattaaatacataaataggtgttcttgataaggggaaaaaacaatttaaataacatgtataagaagttctcacttttgaaacatttcccatgggtctgtacagggaggggaacatcacacactgggacctgtcagggggtgggagcaaggggagggagagcattaagacaaatacctaatgcaagcagggtttaaaacttagaggatgggggctggacgcagtggcttatgcctgtaatcccagcactttgggaggccgaggcgggcagatcacaaggtcaggagatcgacactatcctggctaacacggtgaaacctcgtctctactaaaaatacaaaaaaaaaaattagctgggcatggtggcgggtgcgtgtagttccagctactgggaaggctgaggtgagagaatggcatgaatccaagaggcggagcttgcagtgagccgagatggagccactgcactccagcctgggcgacacagtgagactctgtctcaaagaaaaaaacaaccaccaaaaaaaccctagaggatgggttgaagggtgcagcaaaccaccatgggatatgtatacctatctaacaaaactgctcattctgcacatatatccctgaacttaaagcaaaaaaaaaaaaaaaagccaggtgtggtggcacacgcctgtaatcccagctacttgtgtggctgaggtggaattgcttgaacccaggaggcggaggttgcagtgagccagaatcacagcactgcactcccagtctcggcgacagagtgagaccttgtctcaaaaatggaaggaatttgtaaaaaacagtaagaagaattcccatactctacccacagatcccccagtgtaaacatcacatttaacccaggaataagaaattacagtgatgccggatccaatctatagatttcattcaaattttgctaattatgtcatgaatcttctatctctggcccaggattctatttatccaaaattacatttcacatttagttgtcatgttcttcagtctggaacagttctgcaatttttcagtctttaatgatcttggcatttttttgaatactggccagttattttacagactgtcccttactttagggttatttgatgtttccttatgatttttttttttttttcaaattttttaaagacagagtgttgctctttgccccaggcctggagtgcagtggcatgatctctgctcactgcagcctccgcctcctcgggttcaagtgattctcctgcctcagcctccagagtagctgggattacaggcacccaccaccatgccgggctaatttttgtacttttagtagaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctgggttcaagtgattctcctgcctcaacctcttgagtagctgggcactacaggctcccgccaccatgcccagctaatttgtgtatgtttgtagagacagggcttcaccatgttggccaggctggtctcgaacccttgacttcaggtgatttgccccctcggcctcccaaagtcctgggattacaggtgtaagccaccgtgcaaagccatcccagcacttttggaaggccaaacgtggggaggatcctttgaggccaggagttcaagaccagcctagacaacatggtgagaccccatctctacaaaaataaaacaataaaacaccgaggtgggcagatcacctgaggtcaggagttcgagaccagcctgaccatcatggagaaaccccgtctctactaaaaaaatacacaattagccaggcatgatggtgcattcctgtaatcccagctactcaggaggctgaggcaggagaatagcttgaacccaggaagcagaggttgcagtgggccaaaatagcgccattgcactccagcctgggcgacgagtgaaactttatctctaaaaaataataaataaataataaaaaccaataaaacaacaacaacaaaagcaatagattccccgagctgagtgttccttagctgtgatccaaacccaccatctttgaggcatccatctgggccacattgtgttaccccatggaagttggagggaaaggggaactgatgcaaatatcctactgcccacactgcttgctgtgctgtaagcaataaagttctttgtctctgacacaggagacttgtttctttctttttttttttttttttttgagacaaagtcttgctctgtcacccaggctagagtgcagtggcatgatcttggctcattgcagcttctgcttcctgggtttaagcgattctccttgcctcaacctcctgagtagctgggactataggcatgcaccaccacacccagctaatttttgtatttttagtagaggtggggtttcaccatgttggccaggatggtctcgatatcctgacctcatgatccacctgcctcggcctcccaaagtcctgggattacaggcctggagccaccgcgcctggccaggagtcttctttcttaggccacatccataaaacaagcaagagactaacgtattagtttgtaagtagggtaaagtcaaatctcagacctaaccatttgcaagtggtaattttctattaattttttcttttatatatttttaagagatagagtctcactctggtgcccaggctggagtgcagtggcgcaatcactgcttactgcaacctcgaccttctgggctcaagtgatccaccatcatgcctggctaatttttttgcagagacaagttctctgaaaagctatgttgctcaggctggtcttgaactcctggcctcaagtgatcctcccactttggcctaccaaattgctaggattacaggagtgagccactgcacctggccaattttctgctttcatcattcattatacatttattggttgaaattctgctgtaaggaagaactttcccttctcctccatgaatgactgactgaatgaatgaatttgtatcagtatggattcaagaattctatttttttttttttttttttgaggcagagtttcactcttgttgcccaggctggagtgcaatggcacgatctcagctcactgcaatctccacctcccgagttcaagcgattgtcctgcctcagcctcccgagtagctgggattacaggcatgcaccagcatgcccagctaattttgtatttttagtagagatggggtttctccatgttggtcaggctggtctcaaactcctaacctcaagtgatctgcctgcctggattacaagcatgagccaccacacctggccctttttttttccagtctcactgtgtcacctaggctaaataaagtgcagcggcacaatcattagctcactgcagcttttaactcctgggctcaagtgatcctcccacctcagcctcccaagtagctagcctcaagcgatcctcctgcctcagcctcccaaagtgctgggattacaggtgtcagccaccatgattgacctattatctgatttcagccagcaatattgtttttcttaatattattcttacactgttaattaaatgtgatttaaataatcttttaactctcggttattatagatgaaacagcctgcaaaaactcaccctacttcatttattccataatctttgtcctcctaatttttctattgcatcatttctgtattgtcagagtaggtaacgtttacattctgttttttctcccccaaacctgggtttatttagtcttagttttgcaatgatgtacactcaatgctcttgcttgtccctttgctgaagttccctttgctatccattggtgagtaatgtttattcattagcagtgtcctcaagaaaaatattcccatgcaagaccaggcacagtggctcatgcctgtaatcccagcactttgtgaggccaaggtggacagaccacctgaggtcaggagttcaagaccagccttaccaacatggagaaaccccgtctctactaaaaatacaaaattagccaggcgtgtattcccagctacacgggaggctgaggcaggagaatcacttgaacctacgaggctacagttgcggtgcaccaagatcgcgccattgcacttcagcctgggcaacaagacgaaactccatctcaaaaaaaaaatattctcatgggaaaaatatccccagaattcctgtatgttcaaaactatcgtttgtagcctttgtgtgtgaatgatggcttggcttgttttaaaacaaaaaaatcgctggctcataactttattcatttgtttttttgagacagggtcttgctctgttgctcaggctggagtgcagtggcatgatcacagctcactgcagcttccaccctggggctcaagctatcctcccaccttagcctcccaacaggtgtgcgccaccacgcccagtgaattttttttgttttattgtagagacaggggttggggtgggtggggggaggggtggtctcatgttgcccaggctggtctcgaactcctgacctccagtgatcctcctaccttggcctcccaaagtgctaggattacaggcatgagccaccacgcccagcctctatatctttaaatatttatttatttatttatttatttatttttagagatatggggtcttactctgttgctgaggctagccttgaactcctggcctcatgtgatcctcctacctcagcctacctagtagctgggattacaggttcaagtcaccacacccagttaaatacttatttgttctaatgtttgggttatcttcgttgaaaatttcaattgtgcatgttggctttctttggtctgtcctctacagctgtctttttttttttgagatagagtctcactctatcgcccaggctggagtgcaatggtgccatctcagctcactgcaacctccccttcccaagttcaagcaattttcatgccgcagcctcctagctgggattacaggtatgcaccacctcgcctcacaaattctaatttttgtatttttagtagagacaggtttcaccatgttggccaggctggtcttgaactcccgacctcaggtgatccaccaaccttggcctcccaaagtgctgggattacaagcgtgagccactgcaccccgccaactatcattttttctctaatttcatttaattccttttgtttatatgatttgcttttctcatttttatcatccatattggttaatatatttttcatagtgtccacttttatttgtcctctttttagcttcatattcacttctgtgatggttattttacctgttttttggagatggtgtctcaatatgtttcctaggttggatctgaacgcctaggctcaagtgatcctcctgcctcagcctcctgagtagttggcattataggcatgtgccaccatgcccagtgtgatagttatgtgttttccttctacatccttttttttttttttttccttctgagacagggtcccactctgttgccgaagctggagtgcagtggcacgaacatgtctcactgcagcctcaacctcctgggctcaagctttcctcctgcctcagcctcctgtgtagctgggaccacaagcactcgtcaccacacctggataattttttgatgttttgtagagacagtgcttcagtttgttgcctgtgctggtcttgaactcctggcctcaagcaatccttctgctttggcctcccagattgctgagattacaggtgtgagtcactgtgcccggctcccttctgcttctttcctggattttgtcagttttgtcttgccttattttgtcatgttttccatgaatctctatatttgtatttttggtttgtccttcttggaaataattcattaagttttttttcagacagatttttttttttttttttttgagacagaatctcgctctgtcgcccaggctggagtgtagggatcttggctcactgtaaacctccgcctcccggattcaagcgattctcctgcttcagcctcccaagtagctgggattacaggtgcacgacaccacaccctggtaatttttgtagttttagtagagacgaggtttcaccctgttggccaggctggtctcgaactcctgacctcaggtgatccaccagcctcggccacccaaagtgctgggattacaggcatgagccactgcgcccggtccagatctttttttttttgagacagagtctcgctctgttgcccaggctagagtgccagtggcacaatctcagctgactgcaacctctgcctcccagttcaagcagttctcctgcctcagcctcacgaatagctgggattgcaggcatgcactaccacaccgggctaatttttgtatttttattagagacagggttttgccatgttgccccagctggtcttgaactcctggtctcaagtgatctgcccacctcggcctcccaaagtgctgggattacaagtgtgagccaccgtgcccggcgcactcacacgtttctaatgtctctccatgtccaaattttctcttcttacaaggacaccggtcacattagattagggctcactctgaacacctcattttaacataatcgcctctttaaagaccttgtctccaggccagactaggtggctcatgcctgtaatcccagcacttcgggaggcctaggcgggcagatcacaaggtcaagagatcgagaccatcctggccaacatggtgaaaccccatctctactaaaaatacaaaaattagctgggcatggtggcaggcacctgtggtcccagctatttgggaggctgaggcagaagaatcgcttgaacctgggaggcagaggttgcagtgagctgagattgtgccactgcactccagcctaggccacagagcgagattctgtctcaaaaaaaaaaaaaaaaaaaaagagagagagagagagatagagtcttgctatgataatcaagctggtcttgcattcctgggctcaagcaatcctctcgccttggcctcccaaagtgtttggattacaggcgtgagcttctgtgctggccaaaacagaatgttggagacacacactgaatttacttggaaggctgattgttttcccacgccctccctaggagggtgagctgggtgttgggaccttaactctgcccataagatgttcaggccaggagagatgccctttaccccttgggttacaagggtttccactccctttctgcttgattgaggcttgccctcagttctttgtatccctgctctgctctgcttgtttcaaacaacacatttttgcactgtgtcatgaacagctcatcttcagagagtctgtttttgctggtgttttccgggatctgcatgtgcctcttcccatgtaactttggtaggccttgtgcaggtcttggagtttccagtgactttttgtcttctagtttcgttgaatatgggatttctgcctcattccccccctcaccaccatatctccctatcactttgcataatttctaggaggaggaaggggacaattcagtcaaatattgccacagttcttatactataatcatatcgctttgtaatataaatttctcccactttttccattataagattaaaaatagctcacaccaaaatcccatcgcttgaacccagaaggcagagattgtagtgtgttgagattacaccacggaactccagcctggacagagacagagccagaccctgtcccaaaaaaataaaaataaataagtaaataaataaatgaataatgtttccttttttatatagatatatagacatagatatataaccatatatcatacctggatatagacacacatagagatttctttgttcaaaaatggctcaaacgatatatacgttcttcaacttcctttattcatgtgaacatatcatgggcatatttccatggtatgacttattttgaatgccaatgtttatattaaatcacatttcaaactgtgttcactgtgttctttcaagacatttatattattttaatgtattggtatttttttttttttgatggagtcttgctctgtcacccaggctggagtgcagtggcacgatctcagctcactgcaagctctgcctcccaggttcacgccattctcctgcctcagcctcccaagtagctgggactacaggcgcccgccaccacgcccagctaatttttttgtatttttagtagatacggggtttcaccatgttagcgaggatggtctcgatctcctgacctcgtgatccgcccacctcggcctcccaaagtgctgggattacaggcgtgagctactgcgcccagccatatattgtttttttttttttaattttttttttttttttttgagacagagtctttctctgtcaccagggtggagtgcagtggtgcaatctcggcttactgcaacctccacttcctgggttcaagcgatttccctgcttcagcctcacaagtaggtgggactacaggcacgtactaccatgcccagctaattttttgtattttagtagagatgggctttcaccatgttggccaggatggtctcgatctcctgacatcgtgatctgcctgccttggcctcccaaagtgctgggattacaggtgtgagccaccgtgcccggccagcaatgtattggtatttaacgtattgataagaaatattacaattgttagcaaatattttatacacacagatataaaaagcatccgtatacctaccatcctacttaaaggaaaattattataatatcattgattaactacataccttttctcaatctcatttcctttcttactttcagaagtaactactgtcctgaattttatgttgtaaattatcatttatgacattaaatgatagtctctttttaaagtttccagtggctattggagcatcacagtaactgagaatgttcacagtactgctgtgagaattcttatatatgtgtcattttttttttttttttttttgagacagagttttgttcttgtttcccgggcgggtatgcaatggcatgatcacaggtctccgcctcccgggttccgcctcccgggttcaagcgattatcttgccttggcctcctgagtaactaggattacaggtatgcaccactacacccagctaattttgtatttttagtggagacggggtttctccatgttggtcaggctggtcttgaactcctgacctcaggtgatctgcccgcctcagcctctcaaagtgctgtgattacaggtgtgagccactgcacccagcctcatttttttcttttttttgggggacggagtctcactctgtcacccaggctggagtgcagtggcgtgatcttagcacagcctcaacctcccaggctcaagccatcctcccacctcagcctcccaagtacctgggattcgaggtgtgtgcctcgaggtgtgtgcacgtccagctaattttgtttattttttgtacagattaggtcttagtatgttgcccagggtggtcttgaactcctgggctcaagcgatcctcccacctaggcctcccaaagtgctaggattagaagcatgaggcaccacacccagcttactcatgcaagtttctcctgagtgtcttcctcaggtgggattgctgggtcatagaaattgcacgtgttcagtgttttttgtctgtttgttttttagacggagtctcgctttatcgcccaggctagagtgcagtggcgcgatctccgctcactgcaagctccgcctcttgggttcatgccattctcctccctcagcctcccaagtagctgggactgcaggcgcccaccactacgcccggctaatttttttttttttttttgtattttttgtatttttagtagagacggggtttcaccgtgttagccaggatggtttccatctcctgactttgtgatctgccctcctcggcctcccaaagtgctgggattacaggtgcaaggaaggactgagtgacagcagtgagggactgaataacaggttccaaggcataactggtgccagggtaggtgaaggaaacggaagcatcttaaactgtccaagtctctggcaagtggggctgtgggactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaaatttgttagcttacaaaaatgtgatctatagaaaacctttcagagctgggtaaagtggatcacacttgggcttgagcccaggagttggagaccaatgagacccagactctactaaacaaaaaccagcctggtgtggtggcacacacctgtggtccaacctactcggaaggctgaggcaggaagattgcttgagcccaggagttcgaagcttcagtgagctatgatcgtgccactgcacttcagcctgggttacagtgagaccctgcctcaaaagaaaaaaaaaaaaaggaaagaaaacctttccggaacagtagtatgacctgtattacttttgactaaccaattgtgattaaaactttgcaaaataatttgctaatatttttattacaccttcattatgctgtattgtatttggttcttatgtgctattattccagtaattatgcctttgtcttcattatgctatattgtatttggttcacatgtcctatcattccactaagaacagctatgaagctttttttttttttttttgagacagagtctggctttgtcacacaggctggagtgcagtggtgtaatctcggttcactgcaacctctgcctcccgggttcaagtgattctcctgcttcagcctcctcagtagctgagattacaggcgcctgccatcaggcctggctactttttgtatttttagttgagatggggtttcgccatgttggccaggctggtctcaaactcctgacctcaggtgatcctcccgcctcagcctccctaagtgctgggattacaggcatgagccactgtgcccggcctgatgaagcatattttaatctgtttcacagttttgccttgtctggcaagattacctcctggttgttacacttgtatgtgaccactcattagtgtcttctaggcaactatatatatatattttaatgtgatgtgctctagcaaaacaatgtctacaatacagccatctcatgctcacaagtatcaatataggtgtgaatatgaggtggattccaggaccatgaagaggtggcagattttaattaattaactaattaatttttcagagacaagggcttgctctgttacccagactggagtacagtggcatgatcacggctcactgtaacctcgaaatcctgggctcaaatgatcctcccgcctcagcctcccaagtagctgggactataggcatgcaccaccacacccagccagattttagtaaatataaatattttatctgaaatttttaagaatatttaatattttaaagaatacttaatattaaacatttatgaaatacaaataatagcataagttaactcttctagccttccacatttacttacttgagtttcttttcacctcaaacaaaataaattctgttaccacttagatacaaacatttggtgtttaacattttgtttcttttattatgctttttatttgtttatttgtgggtttttttgagatggattctcgctctgttgcccaggctggagtgcagtggcacgatctcagctcactgcaacctcctccccccacccgggttcaagcaattctcctgcctcagcctaccaagtagccgggactacaggcatgcaccaccatgccccgctaatttttgtatttttgctggagatggagttttgccatgttggccaggctggtctcgaactcctgacctcaggtgatccgcttgcctcagcctcccaaagtgctgggattacatgcttgagccaccgcgcctggccagaaaatttttaaaaagaaataggccgggcgcggtatctcacatctgtaatcccaacactttgggaggccaaggaggaaggatcgcttgagcccaggtgtttgagcccagcctgggaaacacagtgagacccccccccatctctatttaaaaacataaataaaaattaaaaataaaagtaaggtgcaaagactctcattttgttactcatggttgcattttaattaagaatataagtagtcttggccgggcgtggtggctcacgcctgtaatcccagcactttgggaggccaaggcgggcggatcacgaggtcaggaaatcgagaccatcctggctaacacggtgaaaccccgtctctattaaaaaatacaaaaaattagccgggcgtggtggcgggcgcccgtagtcccggctacttgggtggctgaggcaggagaataccgtgaatccaggaggcggagcttgcagtgagccgagatcgtgccactgcactccagcccaggcgacagagcgagactccgtctcaaaaaaaaaagaatataagtagtctttgaagttcttttgggacctacactgctgcaagcgtataatgccaaacgtggatttcaaaagaggccccccgacggagatttcactaattgctaaatcagtgcagcagtcccttgcttccctcacctatccttatcctaagtggtggtggcggcagcgcggagcagcttctgaaggtccgggagctcttttcctctgcaaagcggaggtgccacaggcaccgtgcacctctcagactgcaggggctgagcccccggaggaggagggggctggttcagggagcccctcccctggggcggggccaaatcgtcctcccagcccggctttgcagagcagacagatctggtgtctccagtttacagaagcacttgcagaactcatcagaagccaccccgcttatcagcagatctcaagagagcgttcggtggaggccctgggtctgcacagctcacctccctgggaactgctcgcccgagcgtcggagccggcgctggccccctgcagccggaaggttgcagccgcaggagccccggaggcccaggacacagggtaagtcccggcttgtgccttccctgcgcccaactttcagattttgccgactttccttttcctcttccaggcttcctctctgagtctacatttcttcttaatcgcgtaggcagatcatttcctaaaatctccaggctttcttttcattgatttattttttgggtagcttcacttgtctaatcttacagcagctgcctgttgccaaacagcatgaatgaatgatgcaatcctacacaggagcacccttagtgcaagattggaacaatccccaaactcagagttgaagtgtccgactttgtcttctttcccattagaattagaattttaaaataagtacttaccagatacattgttataacgatacagccttaagttgggaattaaataaatcatgctttcattcattaaatatatttattatattttcttttctttttttatttttatttatttttttttttttcagacagagtctcgttctgtcgcccaggctggagtgcagtggtgtgatctcggctcacttcaacctccgcctacagggttcaagggattctcctgcctcagcctcctgagtatctgggtacccaccatcatgcctaactaattttttaatttttgtatttttagtagagacagggtttcaccatgttagccaggctggtctcaaactcctggcctcaagcgatccacctgcctccacctctgcctcccaaagtgctgggattacaggcatgaccactgtacctggtcactatattttctttatgtatgatttgcatattattactttttaaatatttgatgactgatattggaatgaggatcagggaggaaaataataaaatccaagatttctgtattaccgtgccgggtaggttttcaatatcatgaccatatagccctgtcactttcatgtcggtgaaacaaagtagtcaggacttttaaaattttcaaatgatttaatatatgcctgatacctaccctcctttccttccttcttttttttttttttaagagacagggtctcacttggtcacccaggctagagtgcagcggtgcaatcatagctcattggaatctcaaactcctgagcccaaactcctgcctcagcctcccaagtagctgggactacaaatacgcaccaccatgcctggctcatttattttattttttgtggagatggcatttcactatgttgcccaggcttatcttgaactcctgggctcaagcagtcctccctcctcggcctcccgaagtgctgggattacaggtgtgagtccccatgcccggcctttttttttttttttgagactcgctctgtcacccaggctgaagtgcagtggcacgatctcagctcactgcaagctctgcctcctgggttcatgccattctcctgcctcagcctcccgagtagctgggactacaggtgcccagtagcatgcctggctaaattttttttgtatttttggtagagacgtggtttcgccatgttagccaggatggtcctgatctgacctcgtgatccgcccgccttagcctcccaaagtgctgggattacaggtgtgagccatcatgcccgcccaagtctgcttccttgtctctgcatttagttctcctaagagattctctttccctctcccttgtctttgtaccctgctaatcaggtgtacatgatttcctatcagacttgaaccttgcagaattgaagccatagaagagtatgttgactctacagtgcttgaaggtgggtaggagtaaagcatttcccagaggaagcagtcttaggaaattttgcctctgacccatttttgtgccagtcccgccaggagagagagtgaagccagtctccctctttcctgttttgtgtatggacttcgatgttcatttcctcattctctctttctaggctcttgctcttgcagaatccacaggtctttcttgaggaaatctgtagacagaactttgtgctgcgtttttatctagggaaggaacagaagagtgtcgtctcctagaaatctagcactggagaaacgtgagtctgatttgccttttcttggttttgttttggttttttgctgtcattgtaatgttttttacgcattgaactgttacacgtttgtctatctgctagcagtttactcttttttgagacagagtcttgctttgtcgcctaggctggagtgcagtggcgcaatcttggcttactgcaacctccacctcctgggttcaagtgatatctcctgtctcagcctcctgagtagttgggattacaggtgtgggccaccacacctggctaatttttgtatgtttagtagagacagggttttgccatgttagccaggctggtctcgaactcctgacctcaggtcatccatccacctcggcctcccaaagtactgggattacaggcgtgagccactgcacccggccagcagtttactcctcacctgaattttaaaaattgatgtcaactatgtggcatgcagaagatctcagcttcccagaatagctggttatattacatatcatttcaacttttattttagctttaaggagtacatgtgcaggtttgttacatgggtatatcacatgatgctgaagtttggggtacaattgatcccatcacccagggtttgagcgcagtacccagtaggtagtttctcagtccttgccctccttcccctgccttcttgtagtcctcagttttttttgtttgtttgttttgtttgttttttttttttttgagacggagtctcgctctgtcgcccaggccagactgcggactgcagtggcggaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggcccctcagttttttgttgttgttgttttttgttttcacagagtctcgctctgtcacccaggctggagtacaatggtgtgatctcggctcactgcaacctccacctccaaggttcaagtgattctcctgcctcagcctcctgagtagctgggattacaggtgcccaccaccatgcctggctaatttttgtatatttaatagggacagcatttcaccatgttggccaggctggtcttgaactcttgatctcaagtgagttgcccgccttggcctcccaaagtgctgggattacagctgtgagccaccgcacctggccatcactgtgtgtttttcccgtctttgtatcctcatgtacccagtttagctcccacttataagtgagaacatgtggtatttggttttctgttcctgcgctaattcacttaggataacggcctccagctgcatctgtgttgcagcaaaggacatgttttcattcttttttatggctgtgctggcttttttttttaggccgggcatggtggctcacaccttgggaggccgaggtgagctcccagcactttgggaggccgaggtgagcagaactcctgaggtcaggagttcaagactagcctgtccaacatggtgaaaccccatctccactaaaaatacaaaaattacctgggtgtggtggcgcacacttctgatcccagctattcgggaggctgaggcatgagaatcacttgaacccaggaagcagagattgcagtgagccaaaatcataccactgcactccggcctgagtgacagagcaggactccatctctaaacaaaagataaaataaaatatagtgtaagtgcatgtgctggggatcccagcccttgttacagggaacctctttgactctcctctgattcagaaccttttcagaatctactgtgtattcttttttttttttttctttttttttttttgagatggagtctcgctctgtcgcccaggctagactgcagtgtggcacaatctcggctcactgcaacctctgcctcccaggtccaagcaattctcctgcctcagcctccccacgcccggctatactttgtactctttcaatgcccggggacctgaacaaatttatccctactaccaaagcaaataagcttggttctcgcaactatgcatgaccttcacaactctgtacaggcttttattttttcttacacaggtgaagataagaggtcagtcctaacaaggtgaaggaagtaaggtgatcttagaagcctcttgaaagatacagagattgagaagttgggaaagcatttctttgggcaaggaaatttttcctcttatccaaaatcagacctccgaaggctggccctgcaggaaagcttgcttttgtactttggaactagggatgagaaggccttgtcagcagtggctttttttttttttttttttttaatcagttggtcctttgcttgccaagagatgaactagctggggccagccaggcagaagttctgttctgagctgcagaaggcagtggtccggatgggacctgggagctgctgtgtctgagaatctgagaatagaccttcccaccggcatgtcttctaccctggccctgccctctccctccctgttagagccaaatacgaagaatccagagtccattctctggcaatgatttttctgtgtgtggaattctaatgtacacaatttactttgaagcaactgaccttactcagcagactttttccccctatagccacgagaattttaaatacgcatagattgtgagtcactcctggtggagacaatgaaaagaggaggaaattggccaggcttggtggctcacacctgtcatcccagcactttgggaggccgaggcaggtgaatcacttgaggtcaggagtttgagaccagcctggccaatatggtgaaaccccatctctactaaaaatacagaagaattagccaggcgtggtggcaggcgcctgtaattccagctactcaggaggcaggagaatcgcttgaacctgggaggcggaggttgcagtgagccaagatcacatcactgcactccatcctgggcaacagagtgagaccccatctcaaaaaaagtaaaaataaaaattaagaaggaggaaatcaaaagtgtacagggaggtgcaccattttgcagagcaggatgggaagagctaaaaggagctgtggccgagtttgctctgctgcccaatcaagcagggagggagttgatactcttgtaacccaatgggtgaaggccatctcccctggcctgaccgtttcatgggcagagttaaggtcctaaaatccagctcagtctcctagggagggtgtggaaaaagaatcagccttccaagtaaattcaatgtaaagtgagtctctaacattctattttggccagcatggtggcttacacttataatcccagcactttgggaggctgagatgggaggatcatttgaggccaggaattcaagaccggcctgggtaacatagtgagacctcatctctacaaaaataataataatagtaacttagctgggtgtggtggtgcgtgcctgtggtctctgctactcaggaggctgaggcaggaggatcacttcacctaggaggttgaggccacagtgagctatgattataccattggcactccagtgtgggcaacagagtgagaccttgtctctaaaaaaagccaaaaatattctgttttctccttgggaccacattacaacccaggaggcaggtgtcaacaattctgagctgtaagtcaggcctaatgttcagctggggatgtgtaaatcagttctcacttttagtggaggaaatgtacctttcctttcaaactcaaggctgatggtcttgcttttttttttttttgaggcagggtctcactctgtcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaactattgctagtgtcagtggttggaaagaggttcaagtacctggttggccttttttttttttttttgagatggagtcttgctcttgtcatccaggctggagtgcagtggtgggatctcggctcactgcaaactccacctcccgcgttcaagcaattctcctgcctcagcatcctgagtagctgggattacaggcacctgactaatttttgtacttttggccagggtggtctcgaactcctgaccttgtgattcgcctgccttggcctcccaaagtgctgggattacaggcgtgagccaccgctcccggccaaagtaactggtttttcaaacatggccagtaattatttgtctaatcatttcgacaagactggaaacctcttgaagatggcacccatgcattatgcattcctctttgggtcttgtgtcagggtccctggggactggctttgagattctggtgtccatcagtcattctcaggagcattgcccattcttagttatgttatgttgcctcatgcatcttcttttttttttttttttgtttttgagacagagttttgctcttgttgcccaggctggggtgcaatagcgcaatctcggctcgccgcaacttctgcctcccgggttcaagcgattctcttgcctcagcctcctgagtagctgggatgacaggcatgtagcaccatgcccagctaattttgtatttttagtagagacggggtttcaccatgttggtcaggctggtctcgaactcccaacctcaggtgatccacccgcttcagcctcccaaagtgctgggattacaggcatgagccaccgtgccgggccttctcatgtaccttcttaaaaagttctttagcttatcccacttacctcattttagctcctcttacaccatttgtctgtttctggcttcctcttcactcacctatggttcattctccattcttagtggacttgcactacagtaagtgctgctactctgctgatagacctgctgacttcaaggtctttacagtgagcctgcctgggcatgtagtatgaattagcttgatttctgctggaccaaagccaaatgactggtttctttttattttttatctttttttttttaatagagacagggtttcaccatgttggccaggctggtctcaaactcctagccttaagcaatcacctgtcttggctgcccaaagtcctgggaacaggcatcagccaccatgctggcccttgttgagttcttttttttttttttttttttttgagatggagtctcgctctgtcacccaggctgcagtgcagtgcagtggtgcaatctcggcttactgcaatctccatgtctccacctcccagattcaagcggttctcccgcctctccgtcccaagtagctgggattacaggtgcctgccaccatgcccggctaatttttgtatttttagtagagatggggtttcaccatgttggccaggcgggtctcgaactcctgacctcaagtgatcctcctgcttcagcctcccaaagtgctgagattacaagtgtgagccactgcagccggccccttgttgagttcttaataactgcttaggttcaactctatttaattcataaaatatttaattcatgaaacatttaactaacacctattgggtgctgggtgcagagatagaagataattcaactggagtgattgactgattttctgggttgatggggaggaaataatgtggtataagggaggccacttgatctgcacggtgaagaagtaggactttcttcatgacatgggggatatggtgattccaggcagaggagcagcatttgaaatggtgtagaggaataaaaaaacacatgacataggccgggtgcggtggctcatgcctataatcccagcacttttgggaggccaaggcaggtggattgcctgaggtcaggaattcgagaccagcctgggcaacatggtgaaaccttgtctctactcaaaatacaaaaattagctggatgtggtggcacgtgcctatagtctcaactactcagaacgctgagggaggagaattgcttgaacccgggatggggaggttgcagtgagtcgagattgcaccactgcactacactccagcctgggtgacagagcaagactccgtctcaaaaaaaaaaaagtccttagtattccttgagccataaattgtgtgtgtcaccaggcgcagttgctcacgcctgtagttccagcactttgggaggctgagtcgcatggatcattttagcccaaaagtttgagaccacccttgggcaacatggtaaaacaccatctctactaaaaatacaaaaaattagccagatatcatgcctgcctgtagtcccagctgctcaggaggctgagccagggaggcagaggttgcagtgagctgagattgcaccactgcactccagcctgggtgacagagtgaggccctaactcaaaataaaaaaaaatgtgtgtgtgtgtatgtgtgtgcatgtgcatgtgaataatgtgtgtgtgtaaaaatgtgtgtgtatgtgtatttgtgcggactgaggttggtaaaatccacaggcataggagccagatcgtgatgggcataaattatgtaataaagacattatgttaatggctgggtactgtggctctggtagggcaccggtggctcacacctgtaatcccagctctttgggaggctgaggcaggaggatcatttgaggtcaggagttcgagaccagacaggccaacatggtgaaaccccatctctactaaaaatgcaaaaattagctgggcgtggtggcatgcacctataatcctagctacttgggaggctgaggcaggagaatcacttgaacctgggaggcagaggttgcagtgagtcaagattgtgccactgcactccagcctgggtgacagagcgagactccttctcaaaaaaaaaaaaaaaaaagatttattaatagacactgaaatttgaatttcatttttatttattattattacttttgagacagggtctcactctgtcacccaggctgcagtgcagtgtcatggtcgtagctcactgcagcctcaaactcctgtgctcaagcaatccttctgcctcaccctcctgagtagctaggtctataggtgtgtgccactacacctggctaattttaaaaatacttttgtagagatgaagtcttggtatgttgcccagataggtgttgaactcctggcttcaagtaatcctcccacctcagcctcccaaagtgctagaattacaggtgtgagccactgcagccagcctgaaatttgaatttcattagtttttacatgtcaaaaaatattattcttcttttgatttttttttcaactgtttaaaatgtaaaaatcagccagtcgtggtggctcacacctgtagtcccagctactcaagaggccatgatggaaggttcacttgagcccaggagtttgaggctgcagtgagctatgatggcaccactgcactccagcctaggtgacagaatgagatcctgtctcaaaaaaagtaaagtaggccgggcgcggtggctcacgcttgtaatcccagcactttgagaggccgaggcgggcggatcacgaggtcaggagatcgagaccacggtgaaaccccgtctctactaaaaatacaaaaaattagccgggcgtggtggcaggcacctgtagtcccagctacttagagaggctgaggcaggagaatggcgtgaacccgggaggcggagcttgcagtgagcggagatcgcgccactgcactccagcctgggcgacagagccagactctgtctcaaacaaaaaaaacaaaaaaaaaaagtaaaataaaataaatgtaaaaatcattcttacttgtgagccataccaaaccaggtggcagggtggatttggcctacaagctatagtttgctgacccctgacttaaaatatttttttttccaggtcaacttaaaatggccttattctgccaactgcattggttggaaatcagttgagcagtgggttgttcaactgctttgagtctgtttttaactgcagtctattctaaatatagattacttacatcatctgtgtagccttgtatatgacatattagtctctgataggaggctggtctaggcaatcttgagggtccctttcatcctaattctagtccaaagattttctaaaaaataaaggccaggcatgggggctcatgcctgtaatcccagcaatttgggagacctaggtgggaggattgcttgagtccaggagttgaagaccattctgggcaacatagcaagacccccatctcttcaaaaaaaaatttataaattagccaagcatagtggtgcgcacctgtagtcccagctacttgggagactgaggcaggaggatcacttgagccctggatttggaggctgcagtgagtcatgattgtaccactgcactccagcatgggtgacagagtgagaacttgtctaaaaaaaaaaaaatttgttttgactctctgtcctctgcagcttctgtagcagtgtggcgttccagagtttcttcctgtaccttcaccattttcgttctccttcccaggctcaagccaggacataaaggaggcaggtcctgcgggctgtgcccttagcactcttttcttatccctctctctattctccctggactttatttgtatgagaatttctcttcttcagacagggtctcatctctgaggccccatgctggagtgcagtggcgtgatcttggctcactgcaatctccgcctcccaggttcaagagagtctcctgcctcagccttctgagtagctgggactacaggtgcacgccatcctgcccggctaatttttagttttttagtagagatggggttttgccatgttggccaggatggtcttgaactcctggcttcaagtgatgctcccgcctcagcctcccagagtgctgggattacaggcgtgagccaccgcgcccagcctcttcctggactttaatcagaccatgtcttcaactagcccctgtacattggcgacattgtgtatgtttagccctcatatttagctctgaccttttttctgaggcttaaagcctttcccagtatctggaagttaaagtctaaactccttagcctggccctaggacctgcttagtgtgaattcctgatgcacagccaggcccctgggccaagccatagggtagcttccagcaggtcatctgcttccttctccttgtctttgctcacactcctcgctctgccatcacaagcctccctccttgtctccacccccgctccctctcctcccagcacatgccaaatcgatgccctgccctttgacaacccactcagagggccacttacctgtcagattcagctcaaatacttgtgcctccttgaagccttctttttttttcttttagttagagtcagggtcttgctctgttgcccaggctggagtgcagtggcacgatctcagctcactgcagctctacctcctgggttcaagtaattctcctgcttcagtctcccaagtagctgggattacaggcgtgcaccactatgctcagctaattttttgtattattatttttagtagagacttggtctctctatgttgcccacgctggtcttgaactcctggcctcaagcaatcctcctcctgccttagcctcccaaagtgctgggattacagggatgagccactgtgcccagtctgaagccctgtttcatagataaggctaaacatttttcctgtgttcccacagagccttatgcacacctctgcttttttttttttttttttttttgagacggagtctcgctttgtcgcccaggctggagtgcagtggcgcgatcttggctcaccgcaagctccacctcccaggttcacgccattctcctgcctcagcctcccgagtgggtgggactacaggcgcctgccaccacgcccggctaatttttttatatttttagtagagacagggtttcactgtgttagccaggatgttctcggatctcctgacctcgtgatccgcccgcctcagcctcccaaagtcctgggattacaggcctgagccaccgcgcccggcctcacacctccgctttaatgcttgcttcctcactacaattaggtagaaaaaaaaaaaacaactatatatatatctaaaagaaaagaaagatggcttcaaggaggcacaggtatttgagctactcaggaggctgaggcaggagaatcacttgaacctgagtggtggaggttgcagtaagccaagatcgtaccactgccctccagcctgggcaacagagtaagactccacctaaaaaaaaaaaagaaagaaagaaagaagaaactggtgtagtgtgggaagtaaacaaaaagaaaaggaaaaaaaaatgaatctgtgagaacactcttatgtggcctgcactgactttgacacaaattagattggcttagtaggcaaggtgggatcttttcataattttatttgatgtctttaaatacatttatcttttttcttgtaggaggaaaattcttccagcgatggtctcccactcagagctgaggaagcttttctactcagcagatgctgtgtgttttgatgttgacagcacggtcatcagagaagaaggaatcgatgagctagccaaaatctgtggcgttgaggacgcggtgtcagaaatgtagggatagcatttattcactttatgaaatgataaagactttctaaagagtgactgttttggatgaagtgctagaccctggctatggaacatttgcactaggctttttctttcattccttagagctgaatttgacatattcattcatttatataaatatttatggcaaacaaacatggataagacatgttcttagcttgatcggggaatgacaaccgtcactaactaaagaagatggcctggggggcgaggtccaagtgtccagtggctttgtgtcatggttgaaagtgtgaccttagtggttccctggaaaggttcagagtctcttggtggatcctgggtcagatcccctctctccctcctgccctcccgccctgcagctggggacctccctctgcagtcccagtcccccagtcatgcaccatgtcattttctttttttttttttcgagacggagtctcattttgtcacccaggctggagtgcagtgacccaatctcagctcactgcaacctctgcctcccagattcaagcaattctcctgcctcagccttttgagtagctgggattacaggcgcatgccaccacgctcggctaatttttgtatttttagtagagatggggtttcaccatgttggccagggtagtctcgaactcctgacctcgtgatccgcccaccttgggctaccaaagtgctgggattacaggcatgagctgctgcacccggacactatttcattttcaactgcctttcatggaagaatgcttaacctttggtctctttcttgatttatgacagctcacagcttgcaagaaaaatacctatggataggctgtgtgcctttttttttttttagatggaatcttaactctgtcatccaggctggggtgcagtggtgagatcttggctcactgcaacctctgcctcccgggttccagcaattctcctgcctcagcctcctaagtagctgggattacaggcgtgcaccaccacacctggctaatttttgcatttttttagtaaagatggggttttgtcatgttgaccaggctggtctcagactcctggcttcaggtgatctgcccacctcagcttcccaaagtgtttgggattatgggcatgagtcactgcacccagcctgttaatgttattttcaagcaatccttcaaaagtttattccaaggccttgctctcctagtagcaaagcctgtctgttgcacactgggctcttggtagcatcttccttttggtggatgtcgtgcagacccggggcagtaaggcatgttaaccttgaggacatcggacctggctggcctgactgttgggtctccctcctaggacacggcgagccatgggcggggcagtgcctttcaaagctgctctcacagagcgcttagccctcatccagccctccagggagcaggtgcagagactcatagcagagcaacccccacacctgacccccggcataaggtaagaggaaccccggctccaggtgtatttcagcaccagtgttggggggcacatcctcccaagagcatctaactattcctttagagtgccctctgggtggtttatttattttcattttcattttttaattttttaattatttttttaaattgtattttttcgagatgaagtctcactctgtcactcaggctggagtgcagtggtgaaatgtcagctcactgcagcttctgcctcccaagttcatgcaattctcctgcctcagcctcccgagtagatgggattacaggtgcccaccagcacacctaggtaatttttgtatttttagtagagatgggtttcgccatgttgaccacactgcttgaactcttgacctcaaatgatctgcctgcctgggcctcccaaagtgctgggattatagctgtgagccactgcacccggcctattattattttttttagagtcagcgtctcattctgttgcccatgttggagtacagtagtataatcatggcttactacagcgttgaactcctggggtcaagtggccctccctccttagcctccttaatagtggggactacaggtgcatgccaccatgcccagctaatttttaaaaaaaaattttttttgagagacagggtctcactttgtcacccaggctggagtgcagtggcatgaatagagctcactgcagcatcagccttctgggctcaagggatcctcctgcctcagcttcctaagtagctgggactacagacgtaggccaccatgcctaattttttttttttttaattttctgtagacacagggtctcactatgttgcccaggctggtcttgaacttgtgggctcaaatgatcaattttcccacctcagcctcccaaagtgttggaattataggtttgagccactatacccagcctttaaaatattttttgtagagatgggggtcttgctatgttgcccaggctgttctcaagctcctggcctcaagtgattttctaccttggcctcccaaactgctggatttaaaggcgtggcctgtgtggtgcttttggcacttacacgtggtcttgtctggccagttgtctggtcctgtcggtttctgcctttcctctttctccagggaaaacctaagctttccttgtttgtcctcatcttgtgtttttctgggtccatgggcagagtagagttctggaacggtttcctaaagcagacaaaccctacccattgttttttttttgttgttgttgttttttgagacagagtctcgcactgttgccaagctggtgtgcagtggtgcagtctcggctcactgcaacctccacctcccaggttgaagcaattctcctgcctcagcctcccaggtagctgggattacaggcatgtgccaacatgcccagctaatttttgtatttttagtagagatggagtttcactattttggtcaggctggtctcgaatgcctgagctcgtgatccacctgcctcggcctcccaaaatgctgggattacaggcgtgagccaccacgcccagcccctacccattgatttctaagtgcatttagaaaaacatataaggctgggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactctattgctctggctgaagtgcagtggctccatctcggctcactgcaacctctgcctcctgggtgcaagcgattctcctgcctcagcctcccaagtagctgggattacaggtgcccaccaccacacctggctaatttttgtattttttttttagtagagtcggggtttcatcatgttggtcacgctggtctcaaactcctggcctgagatgatccacctgccttggcctcccaaagtgctgggattacaggcgtgagccactgtatgttaacagaacattcttgaatgatctagagatagagatcattgaaaaaagaagtcaagaatgagtgtggtaattactgtaaaaatagaaataattgataaaaaataagctggaatttcctcttgggtgacataatatattaacattttaaatttaatatattaaggctgggtgtggtggctcacgcctgtaatcccagaactttgggaggccgaggcaagtctgatcacctgcggtcaggagtttgagaccagcctggccaatgtggcaaaaccccatctctactaaaaatacaaaacttagctggtgtggtggcatgcgcctataatcccagctacttgggaggctgagacacgagaatggtttgaacctgggaggcggatattgcagtgagccgagatcacaccactgcactccagcctgggcaacagagtgagacactgtctcaaaaataaataaattaattaattaatttgatactactattttatggtgttctgccacctcaacaaggtttgagaattactggaagcttaaaggatacaacaaaattcacccaatttatttatgacctaatagagccatctctacaattgatagttataatttaaaagcaaaggttggctaggtgtgatggctcacacctgtaatcccagcactttgggaggctgaggcaggaggatcacatgagcctaggagttccagaccaacctgggcaacataccaagaccccatttctataatcataatcataatcataaaaggaaataaaagcaaagcaaagcttgtttattcccaggaacaggtgtggagctccaggctgtgtgactttaccgacggccatttttagccttctcagtgacatttaagtgaagatatcatctatgcagaaagctggcattggtcagatacttctctgggtctttaaccctatttttatttctcttttaaggtgaatatgcaggttttgatgagacgcagccaacagctgaatctggtggaaaaggaaaagtgattaaatttttaaaggaaaaatttcattttaagaaaataatcatgattggagatggtgccacagatatggaagcctgtcctcctgctgtatgtattaagggtgctaattttttttcaggttgtacttttgttttatttatttatttattatttctttattttttttgagacggagtttcactcttgttgcccaggttggagtgcagtggcgtgatctcagcttactgcaatatccgcctcctgggttcaaaccattcttgtgtctcagcctcccaagtagctgggattacaggcacacgccaccatgccagctaagttttgtatttttagtagagacaatgtttcgccacgttggccacgctggtctcgaactcctgacctcaggtgatctgcctgcttcagcctcccaaagtgctgggattacaggcatgagccaccgtgcccggccgtacttttgttttagacagctgatgcatcctatattcccaacactttgggaggtcgaggcaggaagatggcttgagcacaggagtttgagaccagcctggtcaacatagtgagaccccatctctacaaaataaataaataaaataaaataaaaacagctgatttcgaactacataagatttaaaacaggagttaacaaaaacaactctcattacaagataaaaatgaagtaataaaaacacattcaatcttgttttgtcaactttgtgcaaacccaagaaaagttgtgaataaggaactaaaaaccttttaaaacttttaacaatgccttatccccgtaggatgggcaccaccttttagcctaggtgtgtgctcaataagttgatttcatttccccaaataataccatcaacaactcataaccaagattttaatgtcattttatgctttatatactagctcctcatacattacctcatttaatcttcataacagccctgtgaagtcaaatattatgttttgttttgtttttcttagatagagtctcactctgtcacccaggctggagtgcagtggtgtgctctcagctcactgcaacctccgccctctgggctcaagtgattctcccaccttagcctcccaagtagctgggaccacagacgcattccaccacacccagctaagattttgtgtttttggtagaggcagagttatgctatatttcccaggctggtctcaaattcctgagctcaagcgatctcccctgctttggcctcccaaagtgctggtatcacaggtatgaaccaccatgcctggccaaatgttgtgttcttcttactgataggggaactgaggcttgcagagattatatgatttacctgtaacatatcagagcattttgtttttatttatttatttatttttattttttggagacagggtcttgctatgttgcccaggctggagtgcagtgttgcgatcatagcttatcacagccctgaacttctgggctcaaatgatcctcccgcctcagcctccttggtagctgggattacaggtgtgtgccactgcatcccacaccacaacagcattttattcctctgaattaatgtcattttctgagactagcagaggttttatttattttttgagacaggttcttgctctgtcacctaggccggagtgcagtggtgcaatctcagctcattgcagcctcaacgtcccagaccaagcgatcttcccatctcagcctcctgagtagctgggactgcaggcgcatgccaccacacctatctaattttgtttatgttttgtagagatgaggtctcactatgttgcccaggctaatcttgaactcctggcttaagtgatcttcctgccttggcctgccagagtgctgggattacaggtgtgagccaacatgcccggccagggattttatttctaagcattttaaaatcaatgctatatatatgtgtgtgtgtgtgtgtgtgtgtgtgtgtgtgtgtatacacatacacatatacgtatatatatgtgtgtgtgtatataaatatatacacacatatgtatatatatgtgtgtatataaatatatacatacacatatacatatatgtgtgtatatatatacatatatagtatatgtgtgtatatatataatcaaatgctatatagcaagtgtcataaatatcaaatgtgtccatttcacatagggctttgcttttgccatgtcattctaacgtaagaaaaactacaccaaaaatatagtgtggccaggagcggtggctcacgcctgtgatcccagcactttgggaggctgaggcgggaggattgcttaagcacagaggttcaagaccagctgagcaacgtggcaaaactctgtctctaaaaatttattcagggattgtggtgtgcacctgtcatcccggctactcaggaggctgaggcaggatgatcacttgagcccagaagttcaaggctgcagtgagccatgacggtgccactgcactccagcctgggtgacagggtgagactctgtctcaagaaacaaaaaaggaatgacaaaattagatgggtgcagtggagcatacctgtaatcccagcactttggaagctgacgcaggaggaggttgagagcagcctggcaacatagcaagaccctacaaaaaataaaaaaaagtagccaggcgaggtggggcacacctggagtcacagctactcaggaggctgaggcatgagaatcacttgaacccaggaggcagaggttgcagtgagtggagattgtgtcactgcactccagcctgggtgacagagcgagactccaaaaaataaataaataaataaaaataaaaatcatttctctctcttttcttccttcttaggatgctttcattggatttggaggaaatgtgatcaggcaacaagtcaaggataacgccaaatggtatatcactgattttgtagagctgctgggagaactggaagaataacatccattgtcgtacagctccaaacaacttcagatgaatttttacaagttatacagattgatactgtttgcttacagttgcctattacaacttgctatagaaagttggtacaaatgatctgtactttaaactacagttaggaatcctagaagattgctttttttttttttttaactgtagttccagtattatatgatgactattgatttcctggagaggtttttttttttttgagacagaatcttgctctgttgcccaggctggagtgcagtggcgcggtctcggctcactgcaagctctgcctcccaggttcacgccattctcctgcctcagcctcccgagtagctgggactacaggcacccgccaccacatccggctaattttttgtatttttagtagagacggggtttgaccgtgttagccaggatggtcttgatctcctgaccttgtgatccgcctgcctcagcctcccaaagtgctgggattacaggcttgggccaccgcgcccagccaatgtcctagagagttttgtgatctgaattctttatgtatatttgtagctatatttcatacaaagtgctttaagtgtggagagtcaattaaacacctttactcttagaaatacggattcggcagccttcagtgaatattggtttctctttggtatgtcaataaaagtttatccgtatgtcagaacggatttgtggaattttcagttctgcctcttgcatattggaatacccaatatttcaggtaccgtgttgaagcataaatagcccccaggcaagaaacaggcttaagactctactttgcttagtgctgggtacaatgtcctcaccccatgagcccactcccacttcctgaagccctgggacctggaaagtccttttttttacttcttgggatttgtcatatatgaaatgttacaaaagttttttgttttttgttttcctccaatataacaatagagtcttaaacaaaagtactgattaaaaatggatatttgggctcaggcctgtaatctcagcactgtgggaggacaagttaagaggatcacttgaggacaggaattcgagaccagcctggacaacagagcaagaccctgtctctacaaaaaataaaaacattagctggatgtggcggcacgcacctgtagtcccagctacttggtgggctgagatgggaggatcccttgaactcagtagttcaaggctgcagtgagctgtgactctgccattgtactccagcctgggtgacagtgagaccccgtctcttaaaaaaaaaaaaaaaaaaaagatattcgaaaatcacataaagtaaaagaaataaaaacaagttttactaatcacaaaggccagcattttcccctaaatgaattaaatattaataactcctaacagcctatataaaccatttcttttttataaatgacttggaaatactcgaaagccaggtttatgtttgttttgagcagagccaagcaagggaaatttcagaacatgctttgaatgtgtgagatgctataccctccctggaggaaaaatggggggagggaaagctacggggttaacattgagaattagttgaaaaatgtatcatttaaccaaatttggccaaataattaaataattattcagccacataagcaaatcagatgaatcaaatttcctccaaatcagtttctgaaggagagacatgaaataagtttggcaccatttaaatgagattccaaacaatgaggccgttgttcccaactgtgaatacctcctggccgctctcctagaaactgttttgtggtgtttgcacttttcagtagtgccaagctctgggcaggaccaggcatgccaggaccttgaaaagtgctgcaaacggcatcagcctctgcaccgcctggtgtgcatggcaggagcaggccatgggtggacaggtgggaggaccaatcccccactggttttcactgtctgaccgtcacagctgctattgccacacgggttcttcttgcctgcggcccagagagagcccatttctcaatacaggggaattgcaatagagacagagattaattcatgcagaaccagccgaacaggaggccggagctttattcttacatcaatcaccccaaaaattcggaggctagactttttcaaggatactttggcaggccaggggattcgcttctggctggggccatggggtggggtggggtgaggtggtggggcggcaggggtggggaggtcatcggatccaggtggagctactgatggtcagaaatgcaaaaacctgggccaggcacggtggctcacgcctgtaatcccagcactttgggaggccgaggcgagcagatcacttgagatcaggagttgaagaccagcctggccaacacggtgaaactccatctctactaaaaatacaaaaattagtggggcgtggtggagcacacctgttatcccaggtacttgggtggctgaggcaggagaatcacttgaaaaactccagggggcagaggctgcagtgagcggagagatcacaccactgcactccagcctgggcgacagagtgaaactgtctcaaaaaaaaagaaaaaaagaaatgcgaaaatctgaaaagacatctcaaaaggccaatcttaggttctacagtggtgatgtaacccgcaggagtaacggggaattgcaaatcttgtgcctgccctctggaataataactggaaatggtgttgatgtgtacaccttggcagaatttaggcttctctcatcctccttgcctggtggtctctcattagctttattaaggtggttgagttttggggaagggctgttatcttttttttctttttttttttgagacgagtctcgctctgtcacccagggtggagtggagtggcgcaatcttgcctcactgcaacctccgcctcctgggttcaagtgattctcctgccacagcctcctgagtagctgggattacaggcatgtgccaccacgcccagctaatttttttctgtatttttagtagagacggagtttcaccatgttggtcaagctggtctcgaactcctgacctcgtgatcctcccgcctcggcctcccaaagtgctgggattacaagtgtgagacaccacacccggccaagctattatcatttaagctataaactaaatgtctcccagttttgcttggtccaagcccagctatgattaagggcagtttgaaggctaaaggcaagattggggggtggttaaattacatctcacttgttagagtttttgcaaatgtggtttcatttgtgtgtgtgtgtctgggggttttgttttttttgttgttgttgttttttgagacacagtctcgctctgtcatccaggctgaagtgcagtggcacgatctcggctcactgcaacctccgcctcctgggttctcatttttctttgctggtccatctttcacaagcatgcaaaggtggtttcagagcccatccatggggctgtggcctgaacataaggtggacatgaatttggctcagagggatctgatcctccgagaaatactgatggccacatgggaccctttataagaggggctggtcccacaggctgcccagctctcagcaaactgcccaaaagctgccgtctcagacaatccctgctttgttgtgttagaggagtgagtttgaaatgatacaagaactgcctttcatacgttttgaattctggactcactggaaacagctacggaacagctctcccaggagttacgcacatgcctacactaggatggactcagaaaggcatggctgattgtccgtgtgacgccattgttcattctgattatgaacaccgcttacgtaaacagaaagagctaagaattgggatcatgaagccaagagcagaaatttttcagggtattaagttgaaacaataaaagtcctttaaagcttttatatgctttaaaaaaatgactttatgcccccacccactccattctctcctggtttaactgctgcttattttttatttttatttttttgttgagacagggtctcactctgtcggtcaggcaggagtacagtggtaagattatagctcattgcagcctggaactcctgggctcaagcggacctcctgctttgacctcctaactgggaccacaggtgcacaccaccacacctggctaatatttaaattttttgtggagatgggggtcttgctgtgttgtccaggctggtcttgaactcctggcctcgaacgatcctctgttctcagcctccaaaagtgttgggattgtaagtgtgagccactgcatgcaggcctaactgctggtttaatgattcttccatttctctctcttctactggagacaagtgtgtctgtctccatggtacccagggaggcccactggggctgctgctcccaagggcaaggccacaagagagcggcagatttcagagattggcctcaggaagcggtaacatgaacctgatggcttttgaccctacgaccctcagaatctttatgagcagcttcagaaaagctaaccatgagtcacagtgcttattttcacattttgcaaggtgttttcatgtctcctcatgtgattctcacagtcctaaggtcagcagtatagaaactgctgtcctttttttttttttttttttttttgagatggtgtctcgctctgtcactaggggctggagtacagtggtacgatctgagctctgcgacctctgcctcccaggttcaagtgattctcttgcctcagcctcccaaatagctgggattacaggcaccatgcctagctaatttttgtattttttgtagagactgggttttgctatgttgcccaggctggtctcaaactcttggcctcaagagatccacccacctcagcctcccaaagtgctgggattacaggtgtgagccaccgcgcccggccctgctgtcctctttaacagctgggaaataccctaccagagttcatgacagctgtgagattacattcagagctggaacccgaggcaatgatttccacaccattctttatcttgtaagcattcctagagagttaacaatttagcaggccaggattatccaccccaagtgaatacttaacactgtggtcacaagtgctgacatatgaatacaatggagaaattttactccctgagatggaaggcctgttttgcaaaaacttcaagtggttttcatctattttttaaatttttttgtagagatgggggtctcattatgttaggctcaggaactcaagatcagctttacaatgtagcaagactcatctctacaaaaaacacaaaaagtagacagatgttgtggctcatgcctgccgtcccagctactcaggaggctgaggcaggaggatggcttgagcccaggaggatgaggctgcagtgagccataattacaccactgcactccagcctgggcgacagagtgagaccccgtctccacagaaaaacaaaaaaccccaaaactgacagtctctatactttttcttctccttcattctcttctctctccctctctccttttacttcttccctcctttctttttgttgattcatcttattattgaccatctatgatgccccagaaataaactgaaagtataaatttaataagaaatacatttatagagcagggtgcggtggctcatgcctgtaaccccagcactttgggaggccgaggtgggcagatcacgaagtcaggagtgcgagaccagcctggccaacatagtgaaacctcgtttctactaaaaatacaaaaattagccagacgtggtggtgcactcctccagtcccagctactccggaggctgaggcaggagaatcgcttgaacctgggaggcggaagttgtggtgagctgagatcacgccacttcactccagcctgggcaacagagcgagacttcacctcaaaaaaaaaaaaaaaagaaaaagaaatacatttgtaggccatgatggtgggctcaagtctataatcccagcactttgggaggccaaggcaagcagatcaaatgaggcctggagttcaagaccagcctgcccaacatggtgaaaccccatctctactaaaaatacaaaaattagctgtgcttggcgcacacctgtaatcccagctacttgggaggctgaggcaggagaattgcttgaacccgggaggtggaggttgcagtgagccaagatcctgccactgcactccaacctgggtgacagagtgacaccctgtctcaaaaaataaaaaaaaaataaaaatttgtagtgaattcttataactttatattgcatcagcaaccttttgaaatttaagttggactttctactaccagaagcagggctcagtcattcttttttttgagacaaggtgtcgctctgttgcccaggctggagtgcagtgctgtgatctcggctcactgcaacctcctcctcccaggttcaagcaattctcctgcctcagcctcccgagtagctgggattacaggcatgtaccaccatgccggctaatttttgtatttttagtagagatggggtttcactatattggctgggctggtctcgaactcctgatctcaggtgatccgcctgcctcagcctcccaaagtgctgagattacaggcgtgagccgccacagcaccgggccaactcagtcactcttgacactgtttccagttctactccctgacccccacagtccctcaatgtggtggatccagaagtctgccttacacaactgccccctggtggccaccttcccgtgggacagttacatgcagcctgttcagcaggccccactgaccctcacaccgacacggactgtgcagatatgctgcagtgaccaccattcagtcactgcaagacctcctggaactcgtgactgcttgctttattttttgtttgttttttgagacagggtgtgtctctgttgcccaggctggggtgcagtggtgcaatctcagcttactgcagccttgatctcccaggctcaagtgatcctcctacctcagcctcccaagtaagctgggactacaggcgcccaccaccacgcccagctaatttttgtatttttagtggagacaggggtttcaccatgctggccaggctggtttcaaactcctgacctcaggtgatccatctgcctcagcctcccaaagtgctgggattgccggcgtgagtcacctcacccggccacttgcttgctttaaacccaccagttaaaatccccacgtgaaacctgcttgggtgacacccaggaccccactaaaggcactggcccccaagtctctttctgacctcctgtgtatgacctccaggagtgttgtgtatccctaggatctttaagtgataaactgtttgtttggtttggttttttgacaggctctcactttgtcacccaggctgatgtacagtgacacgaacacagcccactgcagccttgacgttccaggctcaagtgatcctcttgcctcagcctcacaggtagctgggtaccatcacacaggtaccatcacacctggctaatttttaaattttttgtagacacagggtctacagaaattgcccaggctggtctccaactcctgtactcaagagnnnnnnnnnnnnnnnnnnnnnnnnnnnnnnnnnnnnnnnngacaggcatcagccactgtgcctggccaagtgataaactatttccatcttgggcctctcctaatcactggaggggtgctgtccatcttaaaggccctacattaaagcaatgggcagccaagcgcagtggctaatgcctgtaatctcaacactttgggaggcccaggcaggaggattgcttgagcccaggagttggagaccagcttgggcaacataatgaaaccctgtgtctacagaaaatttaaaaattagccaggcatggtgcatgcactgtagtcgcagctactcaagaggctgaggtgggagggtcacttgagcctaggaggtcgaggctgcagtgagctgaggtcacgccattgcactccagcctgagtgacaaagcaagactgtctcaaaaacaaaacaaaacaactacttgatatcagcggaagcttgtcaggtaaacgtccaaagaaaaagaagaaaaaatatatatatatattgttttagtcacctagaaatacaagccattctaaagattttacttacagaacactaaaagggcgggaaagtaactgattatcttgtggtatgggctgtcccagagggaggctactgcctagggacattgagttaaaaatcttcctcttttttttttttgagatgaaatcgcactctgtcccccaggctggagtgtagtggcatgatctcggctaactgcaacctctgcctcccaggttcaagcgattctcttgcctcagaatcccaagtggctagggttacaggtgcatgtcaccacacctaatttttgtattttcagtagagacagggttttgctttgttggcctggctggtctcgacttcctgacctcaggtgatccgccctccttggcctcccaaagttctgggattacaggtgtgagccactgcacctggcctatattaacacatttttgatgtggctcccatcccaagggttaagaggccaggctgggggcacgcactctcctaggcctcactaaccacagattgtgacacagcctccacctcctgggctcaaacgatcctcctaccttagtctcctgagtagctggggccacaggtgtgtaccaccacactggcaaattttttgatttttttttttttttttttttgtagagacaggatcttgctatgtcgcccaggctggtctggaacttctggtctcaagagatcctcctgagttggccttccagaagagctgggattataggtgtcaaccactgtgcccaaccatgcttgctttaaatctactaattaaaactcctcatagggaaatctgtttgagcaatgctctgtaccccactaaaggcactggcccatgcgtctctttttctccccgtctgtgctccctgactccatgtgtgtgacctccaggcatggtgtttacccccaggacctgtaagtaataaaatctttatttccatcttgggtgtctcctaatcactggagggatgccctccatcctaaagatcccaaactaaagcaaaattatgatggggaactgcaaaaagggtctttcacaggcagttgtgaaaataaaagacggttctatcaatggctagtttggaggagagcaaagtggttctaaaaaggcttttaacaagtggtaagggctgggtgcggtgtctcacgcttgcagtctcagtgctttgggaggctgaggtgggaggattgcttgaaccgaggaatttgagactagcctgggcaatatggtgagatgccatctctacaaaataacagtaataattttaaaaagccaggcatagtggcacacctgtagtcctagctctttgggagactgaggtggtaggattgcttgagcccaggagtttagggttacagtgagctgtggtcgcaccactgcactctagcctgggcgacagagtgacactgtctccaaagaacaaaaaaggtggtagggatgctgataatatggcacacttgctttttgaaacagacttaaaaacctcacgtgtgataacgaaaaatgagttggcttttataagtaatattcctcagacttataaccaataaattgaaaatgagtttggaagttttgaatactgccaatgaaaagtaatagtgtggctgaggacagtggctcacacctgtaatcccagcacttcggaaggcccaggtgggtaacttgagcccaggagttcgagcccagcctgggcaacacgacaaaaccctgtctctacaaaaaaatacagaaattatctgagcatggtggtgcacacctgtggtcccagctattcgggaagctgaggtgggaggatggctttagcctgggaggtggagactgcagtgacccaagatcgttccactgcactccagcctggcgacagagccagaccctgtctcaaaaaagaaaaaagaaaattaatagtgggacaaaataatgattcattgtgctatagaaattcagtaaaatgacttgtcaaactgagcaggaattgctaaaataaagtgataatttcataaaatagctcaagaatagaatgcccttatcaaaggtcacttagtgaccatcatgttgctaaattcatgaattttttttttttttcctagatggtgtcttgctctgtcaccaaggctggaatgcaacctccgcctcccaagttcaagtgattgtcttgcctcagcttccccaatagctgggattacaggcgtatgcctccatgccaagctaatttttgtattatttgtagagatggggtttcaccatgttggccaggctgctctcgaactcctgacctcaggtgacccgcccgcctcggcctcccagagtgctgggattacaggtgtgagccactgcacccaactatgaacagtttggggaccacatctggcccagccacttgacagcatttgacagaggtgatctctgatggactttcacttggctctcatgacgcctcacttgcttgagtgtctgctgagttccctggtggtttcttagtctcttttgcaggttcctcctcatcttgatcctctcctctgactacagtcactcccttggtgagctcctctagtctcactttttttgagacgggctctcgctgtcacccaggctggagtgcagtggtgcgatctcagctcactgcaacctccacctcctgggttcaagcgattctcctgcctcagcctcccaagtagctgggattacaggtgcccacccccatgcccagctaatttctgtgtttttagtagagacagggtttcaccatgttggccaggttcatctcgaactcctgacctcaggtgatcctcctgccttggcctcccaaagtgctgggattacaggtgtgagccactgtgcccagccttgttattatttttgagacaggatctagctctgttgcccaggctgtagtgcagtggtgcaatcacagctcattacagcctcgacctcctgggctcaagcaatcctcctgcctcagcctcctgagtagctgggactacaggcacatgctaccatgcccaactaatttttcgattttttgtagagatgaggtttcattcatgttgcccaggctggtctcaaactcctgcgttcaagggatcctctggcctcggcctcccaaagtgttggaattactggtgtgagccactgggcccggccactagggtctttctaatggcctccaacactcaagggatccagccctgtgacctctgagctcgtgtcccaccacactctccctcatgtctgcttctgccactggcttctgctgccctcagcacataccaggcatgaccttgcccagggcctcgtaatttgttcctatggagggattttccccagaagccagctgacttcctcacttccttcaatcttttgtgacaagctattttgcaagagtgacaaggtcattcacagcaatgtttgtcaatctcagaacaaattaaaaaagaaaatccaaacgtgatatgtggaaattaagaggattttattgacttttctatgttctttgagaaaatcattcacatgtaaaagtttgacatttgatatgagatttattcacactttacacatacattcttgattgtggggcagacaattgttcatttcaacaggactttcacatggtaacagtcacaaaattggcatactatattaaaaaatgaaatcaaacagctagacaaaaagtatgcagctttatgccaatttaaatctcaacatgcaccacccctcacccatgatctcagaattatctgctgtgagcttattaaaatattagccagagagtgtctgaggtcacaaatgatcgtttacaaaataaaacctcttttcctagagctacttgttttgttatagaaaaataccacaaataaaaattagtgctattcaaggtgttcatttcaaaatcacatatgatacacaagtttcaagccattgtttttgtgtctcacattgaaacatcacaatacatgatgtgaaactgatttactgattaaatgtaccttgcccagcttggaaaacccattgtctactatgtggactgcttacaaatgagagtgagttaaaacattttcagttattgggtacacttgtaatttgttcctcctcagaaactactcagaaaaactgcttgagaaacatgacaaaatttgtatttcttcctgatacaagaaatttgtctaaaaatctgtgattataaaacagatttgttttttggttttttttagtaaagaaatggctaaattttttttgtggttggaatcttattttcaagatgattcagaattcaacgtggaccccttctggagggtggggagaagtggctaagtgttataaggtatactggacaacacggggtgtttcaaagaggacgacaaggcactgtcacaatcagtccaactgtaattctttcctttcttgtgattatgtaaattttaaagaaaagaggtttctcacaagctatatacagcagcttaaaacctcagtgtttctttttcacttgatacacaattaaaattaatttacgacaaatacttgtcacagaaatgtatgtaggcacatagaaactctacagctttactggaggggcgaggtcttcagtgggatcatgattctggattccatttcctgaataagtggaactgaaaacaagatcagggttactgcacttgttactttctaaacacattatggtaaatgacactaacagacagattgccgagaatgttcacagatgtgctgcttgaaaacaagagaatatcataatatacaggactaacctcaagggcagaaatatacaagcggaccctgtatcagctgccatcctacaagatgctattaaaattacaacagatcagctgggcgcagatcacctgtaatcccagcactttgggaggctgaggcaggtggatcacgaggtcaggaaatcgagaccatcctggccaacagggtgaaaccctgtctctagtaaaaatacaaaacttagctgggtgtggtggcgcctgcctgtaatcccagctactcaggaggctgaggcgggagaatcgcttgaaaccgggaggcggaggttgcagtgagccgagatcgcgtcactgcactccagcctggcgacagaacaagactccgtctcaaaaaaaaaaaaaaaaaaaaaaaaaaaccagatcctacctggatatttgttttatttgtgggaggtaggaaaagtccatactgtgaggagaaatggtgatttctcaaacgttcgcgtaagcagcaaaatcaaatacaattatataattataacatgtaattatatgttatataatctcttgaactgaaagacaaggtaacacctactttctaggacaaattactcttttattttcttggtagtataggggctgagatacacttttttttttttgagacggattcttgctctgtcacccaggctggagtgcagtggcacaatctccacctcccaggttcaagcgattctcctgcctcagtctctcaaatggagacaggtttcatcatgttcgtcaggctggtctcgaactcccgacctcaggtgatctgcccacctcagcctcccaaagtgctgggattacaggcgtgagccactgcgcccggcctgaaatatacttgccatgcaacatggctggtactgattacctctaccaatgccactgggttacattcagccaactgttttcttttaaaaatcaagcaaacagggtttcataatatacttatgtatgtgcacatgcatgtattatgtacccagatacatactgtacatacaggaagtttaatttatctaatttcaaaatcactctttaattgatgtattaagttctgatttgggatactaacaattctgatggaaaaggaaagcttagaaaaaaattttatttgtgtaataagttttcagagaatatagaaatctacaaaaacaggtaatgatgtaaaatttacaacatccaagggtctgaaaactgtaacagatgatatacctatttgaaagcatggatattctactttattgaaaaaaagtcatgtaagtattagagaaaaattgactatctcccttccccccacaacctgataactcactatcctagcaacatactattacaaaacccacctattagtgtcagggtgaaagaacatgattgaaacagtaagacaaaaagcatatttcatggctgttaagagattacctgtgtaatataccaattcctcccagccatgtttgtgccatgctgcattccgtatgtcttccctggtctgaagatccctgtaagcttaaaaataaccacacagagaagtaagacttaaaacacatacactgcattccacccatacatccgttaaagtcttgcttcacctggacatctagttttctcagggactacttcaggtgtgtaatatactgggctggggaaattctgagcaaaattatattaggccacgtgggaaaagcaaactttcagtctttttttttttttttctgagacaaggtcactctgtcaaccagcctggagcgcaatggcacgatgatgtttcaccacggccttgacctcctaggctcaagtgatcctcccacctcagcctgctgaatagctgggactacaggaatgtgctaccacattggctaatttttgtatttttttgtgcccagtcagatgtcaaactcctgggctcaaatcatcaaaacgcctcagtctcccaaagtgctagaattacaggggtgagccaccacgcctggcccattcttaagttaaaaaaattatttgtttgtttgtttgagatggggtctcactatgttgcccgagctggtctcaaacacctggactcaagtgatcctcccgactcagcctccaaaactgctgggaatcgaggcgtgagccaccacatccagacacaattccctcttaagctttacaatctagtgaatctaagatatacctttataaaccaagtgaaattctccaataacatgttaaattcatgaccagaaactgtgagaccacagatgagcaatgtcagatcaattttactcaacatttatctcgcactacactgatctgggcagggagtgtgttccagcggtgaagccccaggatatgaggcaggcgaggtcagttgtggagagtgccgtggcccatacaaggacacagtgtataggggagcagggcaagcaatgggagagctgtgggaaaggtgcaagctgaccaggtgggtgttgaagttgaaaaggacatcactgacgtaggaataggaagaaaggcgcttcaggtggagggggatcacctgtgtcatggtacaattcacaggtatctcatccagatgccttggtttcttttcttttttttttttttttgagacggagtcttgctctgttgcccaagttggaatgcagtggtgcgatctcggctcactgcaacctccgcctcttgagttcaatcgattcttctgcctcagcatcttgtgtacctgggattacaggcatgcgcctccatgcctaattttctgtatttttagtacagatgaggtttcaccatgttggtcaggctggtctcttaactcctgacctcagatgatccacctgcctcggcctcccaaagtgctgggattataggcgtgaaccactgtgcccagccaatatcttgttaattacatttttttttgagacagggtcttgctctatttgcccagactggagtgcagtggcacagtcatagctcactgcagcctcaaactcctggcctcaagcaatcatcttcaacttgctgttgctctgtgaagccttgagtcctcccgacagggcagagacaagaggtctgtcctgcattccccacagcctctatgagagctccgccattcacactctggtgcctgcctgtttgccattccaggatcctgcatctgggaggccctctccgggcagctacaggtgctgatgtgaatggagcatgcacctggcttgacctctgcccaacagccaaagggatggaaccttcctccatccaatcctgcccttctagcacctgtgcttattcacatgcctgggagggttgcacaccatatacagccgcaacggtaataaccagcaccacacaaggctctgggggctcaggaggagtgatgatgttcactagtggggaagggtgacatctggggcaggcctggaaaaataccaaagatggtgccaaacaaaagtgtgtggggatggaaatggtgagggggtcaatgtcatgagacagtggaaccacgtctacaaaggcaggcagtgagtatgtgcaggaagctgctgctctgggtaaaatgcaggcctgcctctgtcgaggaagtaagcagtcagtctacaaagaaaggctgggaccactctgtggaaggcactcttgacttccctggcctccttcttccatggctgcttgctttaccccttattcctttccccatcatccctactcactttcagctcactaatgccatcaatctatggactttcactgttgacctcgctagttccagacagccccgtacagactgtccctctgtgacgtcggatttgctgtagtggttaaggttactgactcaagatgtgctctacttcccagtacaacttagtaatgaactcttaaatcccagtaactcgaaaagggaaaaacagataccccaaagatggtgcaccatgtacagctgcccaatctgagagaagaatcctccgacggcttcgttaccatcctgtctgaagcggattgcacgagccctgtaagaatgagatgatgtttgtttaagacactgaattagatacgctaacgagaatcggtagactaaaccttcaccatactcagggcaggctgtttaaaatgaagactaatggtttatcaaactggtatcaagttatctaaggcaaatcaaaagttattttatttactttattattatttgagacggagtctcattctgtcacccaggctggagtgcagtgacacaatctcagctcactgcaacctccacctcctgggttcgagccatcctcctgcctcaacctcctgagtagctgggattacaggcacccgccaccatgctcggctaatttttgtatttttagtagagacaagatttccctatgttggccaggcttgtctcaaactcctgacctcaagtaatccgcccgcctcagcctcccaaagtgctgggattataggcgtgagccaccacacctggtctaaaagtcattttaatgtatatgaaatgtaagcatacttttctgtagctatactaatttttttgagaaaatgtatttaataattattaaaaataaaaacagcaacctgaagatgtatatatagttgcactggtgattcttgaaataaagtctagaactggcagaggatgggacccgtcaatttaaaaagcactgcttctccagaacaccctcagaggggaagcgaggcaaacctggaactagagcacccaaggtgccacagggcactgtacccaagggagacagggaccacccctggggcagggcgttaaaacacaggtgaaggaagcacaccttcaaagcagctgatgactctgaaatcctgagaaacacccctgctctctgaactacacaagggactctgcaacttcttggatgccatacagaggaaccatgggaatgaagctttctggtggtacagcctcagtagtgcaggcaaagctgcctcttgctttttttttttttctttcctactagagcaaaccattcagaaaatgagtaccaaaggcattcattatgtaccaaatatggaagaaagtactaatatacattgtgcctctgtggacatcacactatgatcagttaaaaataggcacttggcttaaaactttaagaatttcccactgcaaaaggtatcagctctttaattttttttgaaacagtcttcctctgtctcccaggctggagtgcagcggcgtgatctcagcttactgcaatctccatctcctgggttcaagttattctcgtgtctcagcctcctgagtagttggggttatgggcacatgacatcacgctcggcttttttttttttttttttagatggagtctcgctgttgcccaggctggaatgcaatggtacgatcttggctcactgcaacctccaccttctgggttcaagcgattttcctgcctcaacctcccgagtagctgggattacaggcgcccaccaccacgtctggctaattttttgtatttttggtaggcatgaggtttcgccatgttggccaggctggtctcgatctgccccgcttcggcctcccaaactgctgggattacaggcatgagccaccaggccagcctacagcccttttttttttttagacggagtcttactctgccactcaggagtgcagtggcgggatctcggctcactgcaacctctgcctcccaggtttaagctattctcctgcctcagcttcctgtgtagctgggattacaggtgtgcaccaccacgcctggctaatttttgtatttttagtagagatgggatttcaccacattggccaggctggtcttgaactcctgacctcaagtgatctgtccaccccagcctccctaagtgcttggattacaggtgtgagccactgcgcctggctcagagccctttcctttcatacttgcaccacttaaaaaaaaaatatttagtgatgcatctgaattcctaaaaatgttttaaaatgtgcccattttttcaaaagcagtcttctagaatcaaaggtgaaaaggaaggggcttcaaatgacatagggaggtcaccagaagacacatggttaaggtctatcaggagatgacacaccatgcattacccagtaaatccataccacactgcccaggctctggcctgaagtctcagtcatatcagggtcccacaggtgacaagacttgggaagacagattcactctaattcattcaaaagagctggcagcatataaacaaggatagcaacctactaacaatgacagtgaaagatgtcactctcaaggcacaagatgcttgagttggcttggctgagcattctcttcctggaggcaaacttcatatatactgaatgataacatctcaaaagggggaaaaaaatccaagagtgatttcctgtgagtgactaagccaatctccttttttaagacagagactcactctgtcacccaggccggagtacagtggcatgatcttagctgactgcagtctggaactcttgggctcgagggagcctcctgccccggcctcctgagtagctggaactacaggcttgcaccactaagcacagccaattttttattttttattatgtttttgttgttgttgagatggggccttgctatgttgcttgggctggtctcgaactcctgggctcaagcaatccagtctccttaaaatcactctacacctctgctctaatccaccatgggctcagtgccatgatgggaaccttacccaagcgcttgggttcctttatggtgaaaaagggacttcttgctattgcccccatggattatccacaaataagatgacatctttaatctttacattgagaattaagtgatcaatatcttcacagaaattataaatctgattattgaaattaagcaaatcacttcaatgtgcattctaactctattcagaagaaaaaaacctggctttcattgatagtgataaatattccagattattcatttcattctgaatttttgtaatttagttatggtaggcaaacaaaacatacttgccttagcctggtaacaatcagaagcctgtacagacgaggtggtcaccatcttagttacctatgtgccaaaatataaattgaatgctaaactggctttataaattatatatatatatatattttttttttttttttttgagacagagtttcactcttgttgcccacggtggagtacaatggtgcgatcttggcttgccacaacctctgcctcatgggttcaagtaattctcttgcctcagccttccgagtagctgggattacaggcatgcaccaccacacttggctaatttttgttatttttagtacagacagggtttctccatgttggtcaggctggtctcgaacttctgacctcaggtgatctgcccatcttggccttccaatgtgctgggattacaggtgtgagccaccgcgcctggtcaaataattttttaaataactgaataaccccagtatgtccctgtggattccacggcgagcgagtcttgatcagtaatgggcaaaaattgaactagtgagtaatcctattccgtgagtagctacatgattaacaacaatagtccaaaaacaaaagaacaaaaattgtatataatagtagcatacaaccaaatatgtatttcttagttttcaaatgaaaagaaattctaacttccattatttagcctttgatgatctaaggaggaaaggttcattagaaataaagatcacagaactatttgttggagacagaagggatcttagaaattatttcatgcacagcaggaaatttcataaccgaaaaaagagaaaaactggggccgagcgcggtggctcacacctgtaatcccagcactttgggatgctgaggcaggcagatcacttgaagtcagaagttcgagatcagcctggccaacatggcgaaactctgtctctactaaaaatacaaaacatattagccaggtgtggcggtgcacgcctgtaatcccaactacttgggaggctgaggcaggctaatcgcttgaacccaggaggcagagattggagtgagccgagactgcgccactgcactccagcctgggcaacagagcaagactccgtctcaaaaaaaaaaaaaagaaaaagaaaaaagaaaagatataagttgaagttaaaaaaaaaggcaaaaaggtacaagttctcttttcaaggtgagagctgtcaagtaactcaaacccaaagctttttctcagcaccatgtggcctccccctttgtgggtaaatagttatgaaatgccagcttaggaaacagaaatagcaagctgccaaagaaaagtaagagttaacataattacttcaaagaaataaacacacacatcttcccctaaaaacaaaaaacaggctaggcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagcaagactccgtcttaaaaaaaaaaaaaaagaaaagaaacaaaaattaaggtacagaaatatgttaagtttcaaagaaaaaaaatgctataaatcttttgttgaattagatatagatgtatgcttcagattattttaggaaactatcccaatgtttcaaaattatatatatattctgagatggagtctcactctgtcgcccaggctggagtgcagtagtgccattttggctcactgcagcctccatctcctgagtagctgggactacaggtgctcgccaccacacccagctaatttttttttttttttttttggatttttagtagacagggtttcaccatgttggccaggctggtgtcaaactcctgacctcaagtgatctgtctgcctcagcctcccaaagtgctgggattacaggcgtgagccaccatgcccaggcagtatttttagcttccaaagaaatcccataatgaagtaagtatggagactggtaaaaagaaaacaccaacaatctcaccatcacagaaccctaaatgtcactagtgtttttctttccatttcctgtcctaggcactgacttcagctaaccaatggtcaataatttattcttgcatccctcttaattattgaggcttttttgggacaggatcttgctctgttgcccaggctggagtggaatggcatgatcatggcttgctgcagcctcaacagcaagggctcaagtgatcttcctgctcagcctccagagtagctgggactacaggcaagtgcaccactgcacctggctaatttagtattttttgtagagatgaggtttcaccatgttgccaaggctggtcttgacctcctgggctcaagggatcctcccacctcagccgcccgaagtgttggaattagaggtgtgagccatagcacccggcctattgaggctttgtatgtctctgtcttttctcatattataatagtcaggatttctaaaaacggtattaaatcataatggtgaaagctggtattttgttacaattgtaatcagcatgcttcttgtgtttcttgtgttttgaatttaaggtagctcctgggaggacgtggacagctttatcatttaaagcagggctagtaaactggccctctggctaatcccaccctctgctgatgggcatttaggttgtttctacttgttggctattataaaacatgctgctatggtcacttaagtgtttacatggatgtttgctttctaacttgcattatttagcctttgatgatccaaggaggaaagattcttgtataagaaacacttatacacatatatataagtgtttatatggatggtatcttttgggtagacacccaggaatgaaattgctgggtcatatgtaatttttcttttcttttttttgagatggagtcttgctctgtcacccaggctggagtgcagaggcgtgaccttggctcactgcaacctccacctcctgggttcaagcgattctcctgcctcagcctcctgagtagctgggattacaggtgcacaccaacatgcccggctacgtttttggtatttatttttagcacagatggggtcttgtcacgttggccaggtcggtctcgaattcttgacctcaggtgatccgcgccctcagcctcgttaagtgctgggattacaggcgtgaaccactgcgtccagcccacatgtaatttctgagggactactagactatttccaaagtggctgcaccattttacattcccatcagcaatatcggaagggtccactttctcctcacctcactaacacgttattatctatctcttttaagttacagctgtcccagtgtgcaggaactggtatcccattatagtttcactttgcatttccataatgactaagaaggttgagtccctttccataagcttatgggcattcatgtattttctttggtgaaatcctattcaaatcctttgtccgttaaaaagttttaaaatttatttaaaaaaaaattttttttttgatacagggtctgtagcccaggctgaagtgcagtggcacaatctcagctcactgcaacctctgccttccaggttcaagtgattctcgtgcctcagcctcccaagcagctgagattacaggcatgtgctaccacacctggttaatttttgtattttttgtagagatggggtttcaccatgttgcccaggctggtctcaaactcctgatctcaggtgatctgcccaccttagcctcccaaagtagctgtgagccactgcacctggcctaaacattttttaaacgtattttttattgtggtaaaaaaaacacgttaacattgaatttaccatcttacccatttttatgcagtgtccagtatatttacactgttatgccacagatctccaaaacattttcattttgtaaaactgaaactctatactcaataaacaccaattccgtattccctctctgcccagctcccggcaaccacctttccactttctgtttctatgattttggcaacactggatacttcacataaggagaatgatacactatttgtcctcttatttcacttagcattacatcctcctcaatgttcaccatattgcagtataagacaagacttccttcttttttggaggcgggggatgaagtctcgctctgttgccaggctggagtgcagtggcgcgatctcagctcactgcaacctccacctcccgggttcaagtgattctcctgcctcagcctgctgagtagctggggctacaggtgcacgctaccacgcccagctaatttttgtatttttagtagagacggggttttgccatgttggccaggctggtctcaaactcctgagctcgggtgaccagcctgccttggcctcccaaagtgctgggattacaggtgtgagccaccgcacccagcccacaatttctttatccatttatctattgatggatatgtgggttgtttctacctcttggctactgcaaataaagctatgataaacatgggtatgcgaatctttttgagatctgctttgaattctgttggatatatatccagaagtgggactgctgaatcacactaattccattttcaatttattttttatttttgtgagacagggtctcactgggagtgcagtggcatgatcatggctcactgcagtctccacctccccaggctcaagcaatcctcccacctcagcctcctgaatagctgagactacaggcatgtgccaccaccacgcctggcaagttttttttttttttttttttttttttttttatagagacagggtttcaccatgttgcccaggctggtcaccaactcctagcatcaagcgatcctcctgccttggcctcccaaagtgctaggattacgggtgtgagccaccacacccagctgctgtcttttcaaattctttacccattttttaattgagttatctgtattcttattattgagttgtaagaattatttatctattctgaattcaatttgcttatcagacatatgatttgcaaatattttattccagtatatgacttgtctttttaattaaatttttttttttagtatcactgaaagtaaggcaattttttgttttgttttgaaacagtctgctgtcacccaggctatagtgcaatggggtgatcttggctcactacaacctctgtctcccaggttcaagtgattctcctgcctcagcctcctgagtagctggaactacaggtgcacaccgccatacgtggctaatttttgtatttttagtagagacagggtttcaccaagttggtcaggctggtctcaatctcctgacctcaagtgatcttcccaccttggcctcccaaagtgctgggataacaggtgtgagccaccatccccgccctaattttttatttttttgagacagggtcttattctctcccaggctgaatagtagtacaatcatggctcactgcagcctccacctttaaggctcaggtgatcctcccacctcagcctcccgaggagctgggactacaagtgtgtgccaccatgcccggttaatttttgtatttttttgtagagttggggtttcgtcatgttgcccaggctggtctcaaagtctcaaacgtctgggctgaagcaattctcctccttcagcctccccaaagtgctggaattacaggcatgagccatcatgcccagtctttatttttatttttattttatttttttgaaaaggagtctcactctgtcacctaggctagagcacagtggtgtgatctcagctcactgcaacctctgcctcctgggttcaagcaattctcctgcctcagcctcccaagtagctgggattacaggagtgcaccaccacgctcggctaatctttatattttcagtagagatggggttttgccatgttagcgaggctggtctcgaactcctaacttcaggtgatctgcccacctcagcctcccaatgtgttgagattacaggtgtgagccaacatgcccggactttttttttttttttttttgagacagggtctcactctgttgcccaggctggagtgcagtggtgcaatcttggctcactgcaaactccatcttctgggcttaagcaattctcttactcagcctctcaaatacctgggacctcaggcatgtggcatcacacctggctagttttatttatttatttattttggtagaggttgggggtcttactatgttgcccaggctggtcttgaactcctggacttgagtgattctcctgccttggcttcccaaagtgctgggattacaggcatgagccacagtgcacctggctagtcttttgcacttctaaagcctgctgagagtttgatagggattctgctgaatctacatatcaacttgtggaaaaattgttatttttctactcaaactagcaaggaaaaaaagaagaaaccattattgacatggtgtgtatatatgacaaaagtaacgtttcagaaaagatgatatccaagaagtatgtaaactaaccttatgcaatattggttttgcttttaaaaaaaaggtgcttatcttttagaaatatatatagtactgaaatatttatgaatgaaatagaatgctgtctgggatttaattccaaacaatctgggttgaaggagttaggcctaaacaagattggccatgtgttaattattgaagctaagagatggatgtggaaggggagccccattattctctctagttttgtatgtttgaaaaatctcataataaaaacatcaaacgaaacattagtgcagtgttaagtcacagtactatcctcagatttttttccctagaattaacactatggcctaaactaatctattcacaagacttaaaaaatcaccattcagtaatatactcaccagtaattgccccattcaatcatggttcctggctgaaaacagatttagatttggtttgttagttcttctgtgaaaaaaaaaatacagaaatagcaaacagcagtagaaaaaacattaagtgacaaaactaacttcaaaaaaccttttttttttttttttttgagacagaatcttgctccgtcacccaggctggagtgcagtggctcaatctcagctcctgaaacctccgcctcctgggttcaagcaattctcctgcctcagcctcctgagtagctgggattaccggcgcccgccaccatgcctggctaattttttatatttttagtaagagatggggtttcaccatgttggccaagctggtctcaaactcctgacctcaggtcacccacctgccttgacttcccaaaaagctgggattacaggcatgagccaccacacccagccaaaactttactttttaatttaatagagacagggtctcactatgttgttcaggctggtctcaagcttcctggctcaagcaatcctccaaccttggcctcccaaagtgctgggattacaggcattagccactttaataatgctgctatgtggggctttctttctagtcctcagtaggaaaatttctagaaagtgttatattattgccttttactcttatcatgttatataatttgttcaacagtcacagtgtttattagctgctctcctttaaccacaacagatgttacatattgtaccttatcctgcactttaggtctttcttcttaaaaacaaatatgttatttagaaaaatatcaaataataagcattatgtgtaaggccataaaaagcaaaagagcttagccttggtgacagtgagacccagtcttaaaaaaatacatatatatacatatatatacatataatgctagacatacatcacagaatgtacacacaagttctgttgtcagccttacaaaatgcttgtgctttttcacagaggagtaaaaggaataacttatatttctgtacttactcggagttggtaagacctgagttcatatatattaggtccggatcttggcacaggctcattccagaaactgaactccaacaggagctgattcttcctggagagaagcatgtcacttcttgccttacgaaattccaaaaattcctttgagtgaaaaaaatgtgctcatgaaatcttctgatacttacatataagcccatttcagtaacattgatgttcctacagaatactataatagggtaatcaacaggtcccagttggcctgagacagtcccagtttacatctgttgagcttgcataatcattaacagcattccttttcattctcaaaagtgtccaggtttagatgacaaattacttggtcatcctaattatttaggtggcaatgcaaacaaatttaatttgctatatttttagattcttctaacagtgtttgatggcacatcaatagaagtagcatgcagactacaaaagagcagataattcaaaacctatttatatttgtctgggaatctatacaaaagaatttctttcttaatgatgtgtggcttttaaatttctccctattgacaaacacctgctagtgaagggagggtggaaagcaaagtcagcccaagataaactctatgtgtgtgacaaacagttcctgaattagacagttttaggtcatccagagctaattgtgcctgccatgctgattgatacaccagtcaccagtcttttgggggttttttttgtgttgtttttttgaggcagagtctcactctgctgcccaggctgtagtgcagcggtgtagtctcggcacactgcaacctctgccttctgggttcaagcaattctcgtgcctcagcctcccgagtggctgggattacagttgtgcaccaccatgctcggctaatttttgtatttttagtagagatgaggttttgccatgttggccacgctggtctcaaactcctggcctcaactgatatgcctgccttggcctcccaaagtgctgggattacaagcatgagttaccgcacccagcccagtcaccggtttcaaagtaccaccttatcagtttcaaagcataattgacttttataataagaacaataagaatttttttttttttttgagacagagtcttgctctgtcgcccaggctggagtacagtggcgcaatctcagctcactgcaagctccacctcccgggttcacgccattctcctgcttcagcctcccgagtagctgggactacaggtgcctgccaccaagcccggctaatttttttgtattttttttagtagagacagtgtttcactgtgtaagccaggatggtctcaatctcctgaccttgtgatccgcctgccttggcctcccaaagtgctgggattacaggcgtgagccaccgcgcccggtcagaattgttgtttgaatagtattacaactgtttatgtttaaatacaacttcaggagtccaaacaataaaatttctgttacaaaaaaatgaagtttattaacaaaaactgaagacagaaaagtcatttaattctgtactaacatctatatatcattagtctaagtaaacatttttcaatatcattaccttattttctctgagtttattcatgacttctgtgagggctggatagcctccttcatacctccagaggtggactgaaatgcattttaaaagacagtatacgtttagaatttcatgatactactacttgaaaatgttctagataggtataacgttaacacagcacaaaactgtaggctgggtgtgtggtggctcatgcctgtaatcccagcactttgggaggctgagacaggcggatcacttgaggtcaggagttccagaccagcctggccaacatggtgaaaccctgtctctactaaaaatacaaaaattacctgggtgtggtggtgggcacctgtatttccagctacttgggaggctaaagcagaagaatcgcttaaacccgggaggcagaggtcgcagtgagcctagatactcatcactgcactccagcctgggcaacagagcaagactctgtctcaaaaaacaaaaaaactgtaatgccccatgttttggcctatgagttacatcataatggttcaataatagattcaaacattaaaaacaattttaaaaccattttcgcaatgaattgttgaagaaactactttaatcataaaattagactgagacttggaaagctttgatgataagaacaagcattaaattagaaaattacttaagtgttacataaggcttaaggaagaagtgtttattccaaagacttcgcttcctaccagcttggtcctgctcgccataccacgtgttccaagtccccaccaaagtacaagggtagtgtttatcttcgtgaatctttggcaacacctcttgacttaaagagaagaaacagcaacactaattaaacaaccagcaaaatttgaccaggtggacagcacctgatcagtaacaggaaaaagaccacctactctgtgttctaacaactgaccttagaacatcatgataaaacggcatgtggagttaaccttttagctgaattatgttgtattccaacaccctgctgatcagaagcttaggtttctgataccccaactatctagaagagttgttcaatcagtataatgatgataaagaaaaaccaaaggtcccaggattttgggagctatgggtctactattttccatttgaggggaaaaaaaacgacatcaccaaaaaacattctgttggttccaaagacagaagaatgagagacggggaatagtagaaaagaacacagaagaaataaggaagatggaaagggaggaaagtaatgttcaagacagaggcagacaacacaagcagtaccagcaggcagaggtaacaggagcagagaacaagctggccttcaggaaggagcaagaagacagctggaacacaacatagtctggaagcgactccaacctccaatactccccaagggcatcaacatggcagaagaataaaaattaaagatacaatgcgaagcataaattatgttctactcaattcaatgggccaaggggatgggaggggtgtcacgtagtctcgcaccgaacacaccaaccaattcattcccgcgcattgtgcagggacagggacaaagccatgacaggtcacggcagtgtatgaatttaacaggggtgtcagagtggagcttggttccatggaagctttcctatggtatagattctaatgtacagggaaaggcaaagggaagagtgtaactgttttacaccaagagaaaagctaaaacctgcacactttttgaatagaaaaattatgatgaaaaagtatcatacagattcaacaatggatgcaaaaggggatcaagggcaagaaatggaacctgttcacactatttgctgactctgatatttagctagtgatcaccaccagatgctggggctacaggaccaagggtatgtaagtaccatgtgctaaccgactgcaccactggagctccatacgaccagggatacataaatggttaacagagaaaagttccaaaacggtctaagtctaactaactgaaaacccatacatctttatgacccagtatagtgaccacatcatgtgtacttttggaagagtagcatttactttttaaattaggatctgatattaaatgtatctgatgcgtgactcatgaatgttcagaaataacatgggatcaatgaaaatcgaggacagggaaagagggattctgctagggaaatgtatgtccaacatttccttttcgtcgcatgacatgagcaggaatagacaaccctgcattggaggcagtgcccaggaggaagcccagtacacatgattcaggtggggtccagaaaggggcctggcaacggggcccaggtttttcaccaacacaaagtcacgcatggatttgtagccactcctctttgctggggaccccaaacctgctcttaggagccctggccttacctgaatggagattgtaaggcaggcagtacttgtacccagaactggatgggttgggcagaatcccattattgggacccctaaaaaccaggcaggagttaagtctttatgttctgcaaacagggagctgctgaaagtttcagagaaaagaaaaaacgtgatgaaaaaagaaaacagaactcaagcagatcaatctgacaaactttggggtaatgtattgcagggcaggaaggagacacaggtatagcttggagcccagaaaggtagtcagaaaaaaagctacttgggaatggggctcgagaggcttggagagagagatggagaaggaaacaagagaaccaaaatacatgtccgatgaagaatgcacggcttaggtgacagattcaccacagagaactaaggaacgggctgagtaaaacaaggtgagtggcacagacagggaagttggaagagcaaggtgattctacatgctgggtgtgaagtgagagcacaacatcaaatagaaataggaacagacagccagaaacccgagacaggagacgaagtgataagacaggacaaaaaaggtaatccaggacaacatcggcatagggaaaaattccatttttatgagaaaagacttagaaataaacatctgctttgttttaagggcattttttaataaagagaaatgtgctggaatgagcaagaaattcaatgctattgttacatttcataagctatcttcaaaaacaaaacaataaaaaacaaaaggtttttcttctaaaaagtatgctgattatagggacaaaattgtttgctttcttaagaacgtagtagatattaaaggtaaaaacaaaactaaactaaaaacctttttcttcacatttgctcaccatgggtcattaaaatactatttctgttaacttaaaagctggtaagcttagttctcccctttcgtcttaaagtttacaaattctgtaagcaggtttagatcgcaaatcataggagaatcagcggaagggacttggatcctggagaacagaggagttgggaagaaatggcagctatgttcaaatacatacaggactctcacagggcagttttacttaggggaatcaatgaaggactcagagatgtgaattcttattcctaacactcagagctgtccagagatggaacttacttcaggacaggcagtcaggaaggtctgtggaaaggactccagcactggataagtagatggactagacagcctggcaaagttcctccaaacacaagagtctggtaacattctaaagtctgatagcctatatgatgatttagctgtgtgagtgcttaaaatcaaaacgccttcggcaatcccacatgaagctcagtttaagagcctctgaatgttcagcttcaaaagagagggatgaaagatctctctctatgctatcaagtgttagtggaattaactaacaaataaagtcattatttttccccaagtaaaggatagtttggtatacacaccaaattttgttgtatgcttctaggcattccggtttaacattgtgaactgaaacaaaagaaaattcaacgataaacttaggaacaaaggggaaaaaaagtcaactatgaagatagcaaacctgtcactcacactgtaatttgtatagattgcttgtttcctttttggctaggagattggagtgggcatcttttcttggatcaactttccggacaaataaggattttagccagctgtcttctcgagatctgttgctggaagatgtccatgtcctatggaataacaaaggtgttgtcacgcagtatactgttttcatatatccatcagttaatctggcaaacacagtgagcagctattctaggcaccgttccagaacctgggctaccaaagaatgcctgctttccatgacaacagcatgcactccaagaagcagaagcaaagaaaaatgtaaaatgtgtggcactcctataagagagcccacatttatctttgcaatttgcactatgtgtttttcaaagcaatttttgacacagaaaaaatatacatggatacctagagtagataaacccacagagacagaaagcagaacggaggttgccaggaggtgaggaaaggggaggttggggtaaggagtttcagtttgggaagatgaagaaattctcaagatgaatggtagtgatgtttccccaaaatgtgaatctacttaatgccactgaactgtatgcttaaaatggttaaaatggtgaattttacattacgtacattttgccacaatttaaaaaatattatttgatttggaaacagatagtggtgatgattgtacaacaatgtgaatataagtaatgccactgaattatgcacttaagatggtttaaatggcaaattttatgtatatatgttttaccacaataaaaatattttaaaaatacaaggaaaatgaaatacattctttctttaaaaaaaatttacccctcaagtaacttaaaaatcaaaaaaaaatttttttttagatggagtctcgctctatcgcccaagctggagtgcagtggcacgatctgggctcactgcaacctccgcctcccaggttcaagcgattctcctgcctcaccctctagggtaactgggattacagacacacaccaccacacccagctaattttttgtattttagtagagatggggtttcactgtgttgcccaggctggtcatgaactcctgagctcaggcaatccacctgcctcagcctcccaaagtgctaggattacaggcaggagctaccgagcctggccaaaaaaaaatcaagatttgtaaaaattaactttaaaaatcaaaaattttttaactgcccccacaaacctcagaataccaactttattaacacataatttgctaattttcatctcataattaaatttctattgtgaatgctttcagaaagtgaggataaatttgactcaagtcacaaactatactttactcatggattttttctttctttttttgagactgggtcttgccctgtcacccaggctggtgtgtggtggtgcgatagctcactgtagttcactgtagcctcaaattcctgggctcaagtgatcgtcccacctcagcctcctgagaagctgggactagaggcatacgtcatcttgcatggttaatttttttaaattttttgtagagatggggtcttgctatgttgcccaagttgttctcaaactcctggcctcaagcaatgctcccacttcagcctctcaaagtgctgggattataggtgtaagccactgcaattggccctacttcacaaatatctatgtgcatgttgaactcccatatgccagctaataggaatacaaatttgttgacctcccaagagggcagtgtggcatcatccatatcaaaatggaaactgtgtatgacttcagcccaataatgacacttgcggttatgtcctacggccagctatatttagacaggtgcacaaagttgaatgcatacaaatattcattgctgtcttgtttccagttatctcctggcataggccatttgaatagccattaatgcagactggtcacgtaaattaggaaatactccccgtcagaaaatatgcactcgataaaaagaatgaggtagatttatgtgcactgatgtgctgacatctccaagataaattctgtaaaaaagccggcacagaacagcactatatatacacatacagagtgagctgttaaagggtgatgacatctggggaacatgactgggcctggggtgggagtaaaggttttttcttttcattgtataaccttctgaactatctgaacaatttctacacacacacacacacacacacacacttttttgagagaatctcgctctgttgccaggctggagtgcagtggcaccatttcagctgactgcaacctccacctcccaggttcaagcgattctcccgcctcagcctcctgagtagctgggactacgtggtgtgccaccgtgcacggctaatttttgtatttttagtagaaacagggttttgccatgttagccaggctggtcttcaacccctgacctcaagtgatctgcccacctcggcctcccaaagtgctgggattataggtgtgagccactgcgctcagccctcttctgaactttatgtaaccatgatcaaatgacaaacagcgtttccctcatcttcttggtttttcacatctatgtacaataaaatgtacttttttggcagacagtactgagttttgacaaatgcctaaagtaatgtaaccagcatcacaacagcttcttcaccccttgaagttaatccttttataatcaacccctctccccatctctagcaaccactgctgtgttccttgtccctcagttttgccttttctagaacatcgtatgtatggaatcatacagaagggtagccttctgaattcctgccccttctttctgcacaatcccttttataattggtgatcttacctctggccaggtctatcacagcataccctttatacttttgttctctttttatttttgagacagggtcttactctgttgcccaggctggagtgcactggtgtgatcacggctcactgcagccttgacccccagagctcaaacgattcccccacctcagcctccagattagctgggacaacatatgcacaccaccatgcctggttaatttttgtattttctatagagaatgggttttgccaggttgcccaggctggccttgaactcctggcctcaagcgatcctcctgccttggcctcctgaagtgttgagatttcgagcatgagccaccatgcccagctacttttgctctccaactgacctacacatagatcttttctgccttttcctagatcagtaatgtactgggattccaaagggccagcataaatgtccagaatcttagtgcttctggacataaaagtccagatgctgatgggccagtgtgaacctcttcttggggatctctttagaaacactagatgattttctacaacagtatttcttttttttttttttttttttaagacagagtcgcgctctgttgcccaggctggagtacagcggcatgatcttggctcactgcaagctccgcctcccaggttcacgccattctcctgcctcaccctcctgagtagctgagactacaggcgcccgccgccacacccggctaattttttgtatttttagtagagatggggtttcaccgtgttagccaggatggtctcgatctcctgacctcatgatccgcctgcctcggcctcccaaagtgctgggattacaggcgtgagccactgcgcccagccttctacaatagtatttctaatctgcttggtagacttgcttaagcacccagataccaccaggtaaacattaagaggaaaagaaagagcaactccaggtattaaaaagggggaccaggaatttaaacaagggacaagaaaaactctcatgagagcaaattccccagtacttcatgaaatgaacacatggatttcatactacaataatagaaattcctattcttatgcagcaacggtattttagaagtagggctctaaatttcacatgatactggcagcctttttctttctttctttctttttttttttgcttaaaaaatcagtttgctgctttatttatttatttttgaggcagggtctcattgcacttgctggagtgcagtagtgcaatctcggctcactgcaacctctgcctcccaggttccagcaattctcccacctcagcctcctgactatctgggactacaggtgcatgccaccacatccggctaatctttgtatttttagtagggacagggtttcatcatgttggccaggttggtctcgaattcctggccttaagtgatccgccagcctcagcctcccagagtgctgagattgcaagggtgagctgccgcactcagcctagtttgctgctttcttgaacaaacattacagagcaatcttctccccaatatgatgttcttttaatttaaaaaccaattcataggatattgtctcaaataggtagaaaccagatataaagatttttgaatgatgtgaacttacaaatacaaatatattggccgggagtggtggctcacgcttctaaatcccagctctctgggaggccgaggcaggtggatcacctgaggtcaggagttcaagaccagcctggccaacatggtgaaatcttgtctctactaacactacaaaaaaaaaaaaaaatagctgggtgtggtggcacacgcctgtgatcccagctactcaggaggctgaggtaggagaatcgcttgaacccaggaggtggagattgcagtgagccaagtcgtgccactgcactccagcctgggctacacagcaagactcaatctcaaaaaaagtaataataataaaataaaataaaataaattaaaaataaaatgtgctctataaataattataaagaaatataaaagcacgttttcacatccttcaaagattaaaaagaagcaaactcactttaaacaagcaaaataacaataccagtaaatgcaatttttcttgaaagataaaaacatatagtattaagtggcatttgcagatgtaagttgaagatgcttccaatttgtgtttactatatataaaaattcctaaaaattaagaaagcattaatggtggtttccctgagaaaatggtttaaagggatagaggggaaagacacacagctttctccatataatgtctatattgtgcttttctcttctgtattttttttttctttgagacagggtctcactttgtcactcaggctggagtgcagtggcgtgatcttggctcactgtagcctcgacctcccgggttcaagctatcctcctgtctcaacccctcccaagtagctgggactacaggtgcccagcaccacatccaactaatttttgtatttttttgtagagacagggtttcaccatgctgcccaggttggtcttgaatttctgagctcaagtgacctgcctgcctcagcttcccaaagtcctgggattataggcgtgaaccaccacacccagccatattccaataaaaatgaaagcacattttgtcaattagtttgaagtgttttacgtacactacatttagggatatctgtttaataatatcatgggctgggcacagtggctcatgcttgtaatccccagcatttgggaggccaaggaggcgggtggatcactgaggtcgggaaaccagactgaccaacatgcagaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttttgaaacagatctcgctccgtcgcccaggctggtagtgcagtggtgggatctcggctcactgcaagttccgcctcccgggttcacgccattctcctgcctcagcctcctgagtagctgggactacaggcgcccaccaccacgcccggctaattttttgtattttttagtagagacagggtttcaccatgttagccaggatggtctcgatctcctgacctcgtgattcgcccaccttggcctcccaaagttctgggattacaggcgtgagccaccgcgcccggcaatatgatcactgttatttacagactgtgcactacacctgtcagccactgacgatgcacagatgaacctggccctgacttcacgggagctcagtttgctggtgagggcagacagacaaacacgatcacaactcaaacagacaagctcttcaatgatgacacaaggaagtaggtagctgttgtggcatgggtaagggcagcctgggggcctgctctaacgaagtacctgttgagtggaagactggaaagaagaggagcagatggtcaggtagatacccatggaagggagattctaagcagaaccagtgaaggccaaagacacaagtgtgcaaacagcaccagcatttggaagcacagacccgggggagagaagaggttgacagacccatgccaagaagactcctgccttaaagcagcagctccctgactcccctccccaccaccacactccatccagccccagtaccccgtcttccacactgctgctccagagacctgttcccacacctttcatttccagaaacttcaaacccagaggagtttaaacatgacaagacttttctgccctgcatctagattttaaaaatgaacattttaccattaaaagtttttctctatatatatttgctttttaatttctttttttcttttttttttcagacagggccttgttctctcatgtcagctggagggcagtggcgcgatctcggctcacttcagcctccacctcctgcgctcgagcaattaccttgcttcagccacctgtatagctgggactacagccctgcaccaccacaccctgctaaatgttgtagttaccctgctaaatgttgtagttttagtagagacagggtttcatcatgttgtccacgctggtcttgagcttctggcctcatgtgatccgtgagccttggcctcctacagtgctaggattacaggtgtgaaccaccacacccggccctatatttgctttttaatttctactgaaccatttgaaagtagagttttgggctgggggcagtggctcacgcctataatcccaccactttgggagaccaaagcaggccaaggcgggcagatcacgaggtcaggagatcgagaccatcctggccaaatggtgaaaccccatctctattaaaaatacaaaaaaattagctggttgtggtggcgcacgcctgtagtcccagctaatcgggaggctgagacaggagaatcacttgaacccgggaggcagaggttgcagcgagccgagatcaccccactgcactccggcctgggtgacagagcgagactctgtctcaggaaaaaaaaaaaaaaaagaaagtagagtttggacataatgatacttctcccgtaaatccttcagcatgtacctccaaaacacaatgacagaactacaatgctatcatcacatctgagaaaaacaattattccatcatatctaatatccactccctattaaaatatccccagttctccccaaaatgtctttcattgctcttgtgggtaggggaatgggggcagacagggaggagggattaggaaccagtcaaggtttgtgtcatagagatctttctactaggaaaatgtccgcttagaattctttagacgtgtggctgggcacaatggctcacacctataatcctagaactttgggaggcggagggtgggaggactgcttgaggccaggagtttgagactagcctggggaacacagcaagacccccctctctacaaaaaaattaaaaattagcagccgggtgtggtgattcatccctgtaatgccagcactttgggaggccgtggtgggaggatcacttgaggccaggagtttgagaccagcctgggcaacatggagaaaccccatctctactaaaaatacaaaaattatccaggcgtggtggtgcacgcctgtaagtcccagctgttcaggtagctgagacaggagaactgcttgaacccaggaggtggaggttgcagggagccgagatcacgccactgaactccagcctgggcaacagagtgacactctgtctcaaataaataaataaataaataaataaataaataatagctgggcatggtggtgtgggcctgtagtcccagctacttgggaggctgaggtgggaagatcccttaagtccggaaggtcaaggctgcagtgagccgtggtcatgccattaaactccagcctgggcaacagggcaagactatctccaaggaaaaaaaaaaattctttagtcatccccttcactaacaggttcgagcccacactcttcgtaggaatccagacgagtattgctgagggttgagctagggcagtgaagatggagagggtggattcaagacatactagaggcagaactgacagatttggtaaatgatagatggcgggaaaaagagggatgggcttggggaagaccatctggtgtctggcctgggccaccacatggaaaatgtttcatgactggagaagaacaaccaaagaaaagcaggcttcacagaaggaagaggagttaaatcctgggtacagcagtgttttaagcacctgtgagacacttatgcaatgtccaggaagcggctgggaattccaagcttgctgctgagcagcactaagtgaaatacgctggctaatgtacaggcagggatgaggctcccaggaggacgcccttctcccttgctgaaactgattcagcaaatcctgttttcttctgtcattttacctaacactttggcagcggatggcactccctccctcctcctggccactgccacataacaatgagcttgccagctccccctcctacattcagcctatatacgctgcacatcccaggacttgctttgcagccccttctctctccacactctcgcctcaagcaatctcacacattcctatatttttttgtttgttttattttggagacagggtctggctctgtcacctaggctggaacgcagtggcatgatctcggctcactgcaacctccacctcccaggttcaagccatactcccacctcagcctaccaagtagctgggactacaggcgtgtgccaccatgccgggctaatttttgtattttttgtagagatgtgttttgtcatgttgcctgggatggtctcgaactcctgagctcaagcgatcagcccagctcggcctcccaaagtgctgggattacagcctgagccactgcacccggcttcctatggtttaaaaaaagtttcattatacaaatttttatttatgtacttatttattattagggacagagttccactatgttgcccaggctggtctcaaactcctgggctcaagcaatcctcctgccgcaaccttccaaagtgcagggattacaagtgtgagtcactgcgtccaggctttattatgaaaaacgtaaatcaaatacgaaacagtataatgaaatccatgtgtctattaacatttagcattcctatatactgacaactcctaaatgttacctgtagcccagacacctcctttgaggagtcatactgccaactgtctgtttgcgtttccacttgaatagcacacagccttcacaaactttaccaggtcctaaactgctctgaattcttcttccccagccctcctgaattactggtaagctccggatggccttggacgccttattcactgatgtctctcaacagtcaacagtgcctggcacgtggtaggcactcacattttggcagaacagctctctgcaaactctcaactctcagtgccagggtccactcagctggccactacccttaattctgccccctctcccaagtcagactcatctttttaaaaagatcaggccgcgcctggtgactcacgactgtaatccctgcactttgggaggccgcggcaggtggatcacctgaggtcaggagttcgagatcagcctgaccaacatggtgaaaccccgtctctactaaaaatacaaaaattagccgggtgtggtggtgcatgcctgtaatcccagctacttgggaggatgaggcaggagaattacttgaacccgggaggcggaggttgcagtgagacaagatcgtgccgttgcacttcagccggggcaacgagagcaaaactccgtctcaaaaatataaataaataaacaacaacaataataataataataaaccatgttactgaaacctccctggcccatggcgagtttaacacacagttccttaggtaatttaaactacccaaagcaatgaatacgagaaagcaactctgggtaaggcaggataggctttgctgtttgaatgtggaaaacagcacatgcaaatatcaaggtgatgaatttggacaaccaaacgtccaatccactgaagttagaaaaaaaaaaaagtttaaacaagagccccacgcctgaacttagtgctgataactctaagtacttttagatccacggccggctttaaatttcaactccaagacgttaagtgatttgacctcctccaagctctaacttcccctaccctccgcggagagctggcccgggacaatgctttactcttttattccctactcccggcacctcagagaccagggtcgccaacgtcctcggcagacgcagccactcaggcttggaacagcctccggcgaggacccagcagacggcgtccggggcctgcggcctcaggcgcgcgctgtccctgtccctggccacgggtcgcgccggtcagggccctgcaggccgggccagcgccgcggggaggatgtggcctccgggccaagcctcgggggccttcccgggcgagggtggagccgcagagcggcccgtcccctccgtgaccttgagcccgaggacgccccgaccccgccccagctccggccccaccccagctccggccccactgccccgaggccgggcagccacccgcgctggggacagggccggggcggagaccggcgccgggaaacccgcgccctccgcctcgcggcggcccctccccggcacctcccgggaagggcggcgctgctcaccggagcctgggcaggaggctgcagggggccgcccgctgcaggaggccgccggcccaggccgctccgcgggcgcgcagcactcgcgccgccatcttgctcggcgcctcggctcccaccgcccgggcgccgccgctgacgccgccgccgcgcgacccctcccccggccgggccccaacgcggccactgcagtgcggggcgcggccgccagggggagcagggcgcgcggccgcgggggtcggcggggcgtccaggcgccaaggcccggccgctgcgggaaagcgcgaagcccaagcgcagtcagtgcaagccgatcacttcagcgggaggagctcggtgcccagaagcgcgggtgcagaagggacaagggcataacttcaatgatcagggaaaactccaaaaggaaagagtaacactgtgcctaggggaatccagggcctggggcggggcagtggcagtgggtttacccccaccccaccccgccaatgtcttttaaattttgtagtatatgaatatattgtcatttcaaaaagccccacaacgctttaacaagtgcattctggggccggacgcaatagctcacgcctgtcatcccagcactttgggaggctgaggccggagatctcttgaggccaggagttcgagaccaacctgggcaacatagcgagccctcactgtgcaaaaacatttttaaattagccgggcatggaggagcacgtctgtgatgccagctacactggagactgaggcagaaggatcgcttgagttcaggaggtggaggctgtagtgaactatgatcgtgccactgcactccagcctgggcaaacacacgacgtcctgtagcgaaagaaagaaagagagaaagagagagaaagaaagggagggaaaggaaggaaggaaggagaaagaaaggaggaaggaagggaggcaggagaaagaaaggagggaaggaaggagaaagaaaggaagggagggaggcaggagaaagaaagaaagagagaaaggaaaagaaaagaaagcaagtgaggaaaaaattaaaaaacaccatacacacacaaaaaaaattaaggagaaaggactgggaaggttctcttgaggtcttgggactgcatcgttcccattcatttcagcaccggtgggcactggccatggggagtccttggtaccttaccctcaaggccgtctgggtctagtggggacagaatgtacaatgatgattggaccgagtgtgttaagtgtcaaaatggacaggttcatgagacacgaaagaggcacggaaagagagcatgtaaccgggggtggctgtgaattagaggatagatggggagaaagttctccaaggagctggcaggacatatcagtcccaggggaagaagggagggcatccctgtcttgaggaaataacttaagcaaaggcgtggatctgggtggctggcgctatagagggaaaaatgtgtcctccaggaagattttttaaaaagccacaaatgagccaggcacggtggctcacgtctgtaatcccagcacttcgggtggccgaggcgggcggatcacctgaggtcaggagtccgagaccagcctggccaatatggtgaaatcccatctctacaaaaatacaaaaattaggcaggcatgttgtcgggtgcctgtaatcccagctactcgagaggctgaagtgggagaattgcttgaacctgggaggtggagggtgcagtgagccgagattgtgcctctgcactccagcctgggcaacagagtgagactccatctcaaaaaaaaaaagaaaagaaaaagaaaaaagccacaaatataaccatgaaaactgcaaccaaggtgagggcaggaggaaggaagctggaccctgggggtgggggagaacctgggagaagtaggggctctggccaccaaagggagcatttccaggccagtgcggggctgcagaggcagagaggaaagtgccctcaggactgggttgcttggaggtcataaggtggacaaaaactgggaggttccctgaagctggtaatcttgggggccaagggagcatcagggctcaaggggtgcagttttctgactggggtagaatttgaacacgttaatatggcaaggagccaccagggaggacagaggtggaccctgtggatggaggagggctttgccccagagcagggaaaggcacctgtcccttggaggccagtgggatggaggccaagggacacaaggataggaggccagaggctgtgtggctgaggacctcctggcctcaactagtgtatgcttagtaaagctgtggagaaccctgtaagaagtactttttaagtggtccattttcagaaaacagacaagtctgggcagttcccttgtggatgtgacaagatgcacgggtacagacatctgggaagagtgataaaactcacagaagtcagaggggagggagaaaagtggcaggggtgtctaatccataaaaggaaagaaagcttagccattgggaaatcgaaacttcaagtagggaagaggacaagatgtaacctaataaggggataatggaacttaggtgatgtccaggaagactgcaaccccatattactcagcctgtgaggaactggggagggacctgtgctctaggggataaattgttgaaactgcactgggtgtgcctgcccatcacacatccgatcttgcaaaaccattattaaaaagtcttacttttgtccgggtgcggtggctcatgcctataatcccagcattttggggggctgaggctggtggatcacctgaggtcaggagttcaagaccagcctggccaacatggtgaaaccccatctctactaaaaatacaaaaattagccgggtgtggtggcgcatgcctgtaatcctagctactcgggaggctgaggcaggaaaatcacttgaacctgggagatggagattcacctgggaggtgatctcagctcagcaatgagctgagatcgcactgctgcactccagcctcagtgacagatcaagacagactctcaaaaaaaaaaaaagtctcactttcactgttcttcatgcctctaagtccattctttgggtttgaatgggtgagtgtgtttctcacactccaaagagaggcagaagtgagctctctccagggtatcaaggacttggcccagccctacagagcaggaggccaggcctctttaagggtggatgagctcctgtgactgtcacaaatgcccccaatttctcagctctgtttcatgagacacctgcttttaaatttattctgaaatataaactgtagctagacacttctttgctgaccttgcttttgtgtttagtattagcctgcttagcctgcattgcttttctccactatcattttgttgtggagttccattcactcaggactttttactggggaaaaagagggtactctgatttcacagctgtgtggcttcagatatttgaagccatagaataaacatagcaagtcttcctggagcataagttttatacaaagactctcaggaaaaagtatgtgttaaaatataaacaagtatcatttatatgttaacatttcagtggtacttaggtataatttatattttaatacttcgatggtacttaagtatcatttctattttaatacttgaatgatacttaggtatcacttatattttaatgcttcaatggtacttaggtatcattcatattttaatacttcaatggtacttatacatcatttatattttattttattttttatttttttgagatggagtctcactcttgtcacccagactggagtgcagtggcacgatcttggctgactgcaacctccgcctcccaggttcaagcgattctccttgagaatctgcctcagtctcctgagtagctgggattacatgtgtgcaccaccacaccccggctaacttttgtatttttagtagaaatggggtttcaccgtgttggtcaggctggtctccaactcctgatctcatgatccgcctgcctcagcctcccaaagtgctgggattacaggcgtgagccaccacgcctggccatcatcatttatattttaatcctttgatggtacttaggtactatttatattttcacatgcttttaattttatatttatactttaatacttcattggtacttaagcatcatttatattttaacatatttataaatgatgcttatttataaatgtttaaatatttaaacctttaaaatattttagagacggcttggactccatcccagagctggtgacacatgtgtcaccatatgctaggagca

SEQ ID NO: 12394 - DNA, 14007 bp, Human
  misc_feature (1)...(14007): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtgagctgagattgcaccactgcactgcagcctgggtgacagagcgagaccctgtctaaaaaaaaataataaaataaaaaaataaaaaattgagatatcacatgtaaagtgcttggcacagagtttatgctcaaaaatattagttgctccctgtttggtacacaaagggcccatcacaaatgcaggtgactgctgcatgcgaatctctgccctacttaaccatctccccaggagtatgggggtcacctctgcttaggaccaccttggactccacccaccaagttctcctacttatgacgttagcttattttttcttccttcttcaaaagaaaagttttaaacatacacaaaagaagagagaactatatgacaaaccctttacacccatcaccagctagtttcaattatcaagcaaaacaactagtctcgtgtcacctattctcccatctctttttttcgttgaatatatatatatgtatttttgagatggagtctcactctgtggcccaggctgggatgtagcggagtgatctcgactcactgcaacctccgcctcccaggttcaagcaattctcctgcctcagtccccccaagtagctgggattacaggcacacgccaccacacccggctaacttttgtatttttagtagagacagggtttcaccatgttagggaggctggtctcgaactcctgacctcaggtgatctgcctgcctcggcctcccaaagtgctgggattacaggtgtgagccaccccgcccggccacccatgtgtgtctttaacagatagagatgttaaaggacaaaaccacattttatcagacccaacaaaattaagaatgattcattaatacaatctactatgtagttcatatttaacttttcccaattgtctcaaaaacttttctttcctgttgatttgtttgaatcaggtttatccaaaggcctgtgttacattcaattgtaagatctcttgggtatttttctatcagcctgcttcaacatgttctgttttcagaggaaacgctagaatgaggaaagcattaccccttgaaagtctctccaactcactttcctgaacccttttcaataacacaaaaacaagcatctcctttttttttttaggttttttttttttttttccctctggaggcagggcccaggctggagtgcggtgcagtagctgggacaagaggcatgcgacattatgcctggctaaattttgtatttttagtagagatgggttttgccatgttgcccaggctggtcttgaactcctggactcaagcaatccatccggcctcccaaagtgctggaattacaggtgtgagccactgcgtcagcctgggggtgtttttaaatgataaaaggtgtttccctttccagaatctttaaaataaatggattcctctaatagctttcaaaatccaacaatcatcccagtgaagtcaaaaagcagggtttgtattatttcttgttttagagggtaaaaatttctgggattttgttcttttcaaaatgacttttttatgccctcccacctgctttttgaaatccaccaaccacaatatttaccccatcccccttttctctcccccccatctctctctctctcctttacacactccctctctctctctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttgggtaagttagacacatctgcatgctcccgagggttcagaagtgtagccgcaatgtgaagaggatgggggcaggggataggaaagaagacattgctagcgctttccctctgtgtccttgggaggggaggtgctggggactggaagggacgttgctggggagtgcagaaccctgggactacttagtcacagaaatgttgggtcaggggatctgagtgttgctgggggctgacaattgtcaagggaggtgaatcttctctggatttcccctaagtggacctacgtggcggtggggcagagagtggattgacctgcagtctcttcagggattattttttggagttgctgcaaatgcggggtcctgggacttaatgctcccttaaggggcttcttttcagaagcttgatcctggtggatttagggtattaggagagtgtgcaggggagctggtggcagaaagttgagtctgggtctggcttcttggcactcggtctcactgatctgttggaacgtgtgtgggagtaggtgggaagcgggcttggggaatgatgtctgggttgggaggagacctgctgaggcacgcactgatggagaaggcacctttggcttgggccggatggaatggaggaagggccaggtgtagagattcaggaaaaaaatggaacccacaggctgagcgaggttgcagccctttaaatccagcctcagaactgcccagcccagtcttgcagactgtcctgtcaagtgtttgtatttgaccactcagagacttcctggtggggaagtgggctagaaagttatttgcaagcctgctttgtagagtttcattcttgctcctaaacttacttattgctggagcagcaactgagagtcaagtccaaggactgttgatggaactattccccaccacaaaggctctctctctttctgtggtgtgatgtgctgggtttggagtaggagtgctaaacacagacagtgcagaggccctgccagcctgctttgctgagttacttggcatattaacatcagagcaggaatgctatggaatctctggcaggacctgggtttcaagccacctttgtcatttacgtaatgatcacaggcaagttactcaacccctctgagcttcagttccctcccgggtaaactaaagaatgcctactgcctgacgtgtttgtgatttggtgcatggcaggaactcaacgatggctaacataagaatgcttttcgtgagcccaggcactgtgtatcttgtttagccctcacagcaatcggaggtagattctattatactcaggttacagggaggaaacagatgactatggtaacgggagctgaaatttgaactccctgtgtctgacttcagcacattctcttaaacgttggattccactccccaatgttcaagaaatggcactgctatattaacagtacctaattgatcagagtctcaggacaggctgaaagaaggggagttgggtgagtggcctgttgtaaggaggcccagctggaggacaggaccctttcctcaggagttaggaagcacttcgtgcaggagagaagccgcctggtgagagccatggctaagtaaagatagaaagggggctcagtgaccaggacccagagctctgggctagggtgaggaagagggagtctgcgatgaagaggtctgagtgtttggggtggggagatggtagtgggaggaagctaaagcttctgcaaagctgagtgggagaggatgcaggaatggggaccttgaacttgaacttgattggtgctgtaatgaggcatgtccctggcactccaatgctgagggccgagttgacagtggaactttggtggtgttgcagtagcatcgatccccaggatggaggatgccacaagtgacgagggaggggactctgtcggggctgggcttgtggggatgactatggaggtggcaaagagaaagggcaggtgggcaaccagctctacccacggcagaagcatatgaggctagttttagccagaaacaattcaaatgactgggcttccctcaagtttttcttgagaccgttgactccacagtcactggcctgcttaccaatgtatggattatgttagtggaggcatagaaagtggagtctgggctgagcatggtggctcacgcctgtatcccagtgctttgggaggccgaggtgggaggatcgcttgaggccaggaattggagaccagcctggacaacatagcaagaccctgtctctacaaaaaaaaaaaaaaaaaaaaaaaaaaaagaaaagaaaaataagccaggcatggtggcatgtacctgtagtcctaactgttccaggaggctgaagaaggagtatcaagagttccaggctgcagtgagccgtgatcatgcctctgcactccagcgtgggcagcagaaccaaaccctgtctcttaaaaaaagaaagaaagaaagaaagaaagaaagtgaagtctagtcctcactctagcccactgcacatatctgctgcttgtggtggtggggacccagacatggagagaaagctgtctcttcttcctttagtagactttattgagtccccactctgccacacactgtcctgggtgccagggataccaagatgaataggagtcagttccccggagcctctagagggaaacaggcccatgaacaaataataacaagacaacattgtatgtatggcaacaataatagcaataatgctcatcatagtcgcagctgacttttgtccaggccatgtgctaggcactgtgctgagcttcatacaggtagtaagtcatttaatccttcgacagccctatgaagttgggcttattgtcccctatattacagatgaggaaactgaggcactgggaggttaactatcctgccattctgccctcaagtcatgtggaagagataggaacagggctggggtgaggacaaggacaatggggaaacagtcaccgaggctaatgccctgtaagctgggacctgaagaataagtaggaggggcccaggggcaggagggcaaatgagcttctcaacctgaagcaaaaatacgtgcaaaggcatggagaagggaaggaaggtggtgttttcagaaaaaatcagaactggggtcactggagtgaaggagacctggggggatgggggctggcaggggatgaggctagggtataggttggtcccagatgccaaagggcttggaagctgtgcccaggagcctggacttgatcctgaaagcagtgggtagccgttggaggtctggaggtgaggagtgatgagggtgggttgctcctggctgcacggggatggactggagtggccggggttggggaggcccttgagcaggaagggtctggatggtaaggcagtgcaggtgcggagatacgggctggatgccacactcacctgggaggcaggggctgccccgggagacagttcatctgtttagacacttaaaaaaaaaaaaaaaaaccaagaagaaaataattacctcataggttgctgtagggtggaaagaggagtgaagagattaacttccagtctctgcaagagacagcatttggcagatgagcaaatttttatagtctctgcaagatgggctagttagaacagtggatgacacgaggcctgagggcccagatgtgccttggagacagcgggtggcccgccactgctgaggttttggatctaagatcagaagcctcatcccgttgatgatcttttcccttctgtgagttgaaaatcaggagacacaggccccagacctggtctcaaatgggacaaccaggaagattgtgggccccccttgtatggaggttcctttaaatggtacaattccctgctggcgggcctgcctggagttggacctgccatatagtcggcaagagatcggatgccttggaatggggctcacttcaccactcagcttcaatgcctcaacccagtctggagccaggcaggctggcttcagattctagcttcgcctcttactagccgtgaacttgggctcgtctcttaacttctttgtgctccatcttcctcatccggaatgtgggagcgataacaggttttgttagtattaaatgaggtgatgtatgtagagtacgtagacagtgcctggctcgttgtaagcattttgtaagggtttgtggctgtgatgaagtcctttctgtggccttggccatgcattcgggtgctttcccgaagcaggagagttaatcaagagaccagagttttgctcacagctctgaccttgttgagccatggtcccctcgtctttaatgagggcccggactggcgggaggtctgaggccagcaccctagagctgctgggattctggtgaggccacaggcttacgtggagatattggattaggggctaggaaccatgattctggcctcagcttgtccctattctctgtgtgtggctctcatggcctttcctcaccggtaaaacaatggggctagatctacggtttctgatctcagctccagctgtggctccggatcccatgctcgctccgcaggatggaacttgacgtttgactctgtgaccactagagggcacgcgtgttccgcccggtaccttctgcagggccccgctgcagggtggggagggggagcccgcattgcacctctccggctgcccccgtcctgccggccagaaaaggcgcccccgcactcctctctaccctgccctcccccacggcagggtgctagctccttcgagatggtgaggttcaagttctaatctggagcactgccttgggcttggtggggggcagaggcccgcacagagtccgccgggcttcgcagaacgcagactttttggtctggggagcccctgggaagatgatcgaccttccaagggaagagctagagggataggacattcctgggatgggaggtaagctcaggacaagcactgtcagtgccttccctcagagctctgggcctctgcagatgaagatgctgttggcattttctgcacacctcctccttggctggtgcgctgccagatgctttcagaacggcgatgaaagtacaggagatggaattgggctttgttcttcctgacaggggcccactcagcctccccagtccttattcccctaatgagcacttaagctcacacctggaatcctcggccctggactcctcctctagaaaacgcagatggtgacacctgtctcccagcttggagaacagatgaggtccccatgcctacccctccatccagggctgctgccagttcagagaatctctggttcttaagtcctgccatttgccctggtcactcgggccaggggcggggctggcagaagggtgctccaggcagatgttgatttccctgcaggctgcagggcggctgcttctacggctttgtgaagaaaaaaaaaaagtttgaaaaataggagccctgcaggcctgggctgttcgccaattcctacggactggttggagtggggcagtctccaaggtgccctcaggccaggccagaggctcccctagaagcccttcctgtttgcaaggcagaacttggggagaattgaggataatagcagctaccatttgctgaatacttactgcttcttttcattatcgaaacaaccctgggagatcggtgtcaccaactgcgttttacaaaggagtagcccccactcttccagcttctgatgctggagctgggattgaacccaagtctagtctcatccccttgtctatgcgattcccacatcagcctctatcgggctcatctggacagcctcccagcagcccccatactccccaaccctgcagggacctcctatcacactccaaagaggaaactcctaattccatatcctagcccacaaagcctttgtgagctggtccctgcctaactcttggacctcaggtctcaccatgcaccccctcggtcattctgctccctctgcctcaggcacacgaaactccttccagccactgggacttggcccctgggagtacacttgcctgggaactcgactcgctcaaaacttcaacgggctcactctctcacttcaggtgggcgctgcctgtgtgtccccctcagagcagtcttccctgcccacccgacatcagacaatgcccctctaccttgccgagtgtctctacctacaactccatgatttttttccttgttgatgtctatccttctccccagaatataagcttcatgatgcagtgactctgcctgtcctgttcacagcagtaacccccagggcctagactaagtgcctggcacacagtaggtgatttataaatatttggtaaatgagtgaatgaatgatgctgaacactgctgtttatcctccataaagaaaaggaatcttctgagataaggttcttgaggatacgggcagagcatcttggaatgaaggccagggctcaggtgagtccagtgaggtgcctagggcgtgacatttaaggaggtatttccatgaccaggcagtggatgccccttaagtgtcttgccccaggcccctcgctcgcctccctgtaggctctgtcctgcttagaatgtcggagtgggacaggcctttctcagccccagcaccaaagtctcctggcctcagtctggtgttcctaataggactctgcagaaccagcagctcccaccctgcctgcctgtagcagctccttgctgtggtgtctccaggttgacatcttcaagagggactcctgtccctgcagacccatcagctggtccttggaatggtgcctcaccttctggggcacctcttccctcccacagcttgtctgccctctttcttgtctgttgcaagcctgaggaaggtagggggctgggctgggctgggacacagctttgctctgtccctggggtatggagagcgaggccttccaaatctccagctgttctcagtctgctgtcctgagaacagaacggcaggggagccctgcagtttcagctggaagggttttggcccagcaaagatggttagaagtggtgagaataagggggaaactgaggcaagcatagtgaagccccttgtctgtggtcttctgctggcatgtgacagaactggggcaagtgtggtgggggcaggggtgcctaacagtggttctagaaaaggcttgaggccgtttggctgcccctggcttgacagatatagatgatgtgacgatttggtttctctcctcccctacctgctctgtggccccgctttgccccaaagaccacatctggtgccccatatgtgcctgcccactccaggagtatggactggggaggctgagtgggcccctgccaggaagaacgaagtccaattccatgcggcttgcacctgtactcccagctacttgggaggctgaggtgagaggatcacctgagcccagcaggtctaggctgcagtgagtcatgattgcgccactgcactccagcttgggcaacagagaccctgttgcaaataacagtaactcccacctcctgattaactggagctgtcagggacccagtcccctccctgtggctctgctctgcctcatcccccaacactcccaggcacagagggcttgcccctccccagccctttcagccagactcctcaccagcttgtggcttcatctgcagtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatggtgagtcctgggctgaaggcaggggcaggggaggaggtaggagccccatggcatgaagcccctggtcccaccaccggccccggcactgcgctagggccccagaggaccctgggtgggctgcgtgctctggaggctcttgaaacaaggtgtgctgcgcatccaggtgcctcacagaggtaactgcctctcttccccaggaaaagggtggatgggaagagggggcatcctcactgtccttgtagttccttgctcatccagccacccatcctgtcccttgctccaaccccagttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaaggtgaaggctggggtgccagctgcggggccctgacctttcccacccacctactctctgcggcatttgctcagggcactttggggaggccaggccctcctgaggatgggagcaaccatttgtgctgcatagaaggaatccattttcttccctctagtcctcaagaacctgggaacatgtcccagagagtcctggtaatgatacagaatataatcccagtcttaataatggggcttggtgtgatggctcacacctgtaatcacagcgctttgggaggctgaggcaggcagatagcttgagctcaggagctcgagaccagcctgggcaacatggcaaaactccatctctacagaaaatgcaaaaattagctgggcatggtggcttgcacctatactcccagctacttgggaggctgaggtgagaggatcatctgagcccagcaggtagaggctgcagtgaatcatgattgtgccactgcactccagcttgggcaacagagcaagaccctgtttcaaatgacaacaacagcaataataatgatggtgatgatggcagctttcatttattgggcacctctatgtctcagtcatagggctaagctctgtttatgcattatctcatcctcatgaaaacctttgagggaggtactattattaagcccattttacatgttagaaaactgaggttagagaggataagttacttaaggtcacgcaattcgtaagttgtacaattaggactcaaatttgggtctgtttgatcttaaagttcatgctcttaaatacttcatcacactagctcctctgggggctttgggtgtcctgggatttggaggtggcggcgcttcagggtcagtcactggattgcttttcggctttgctaaagtcctgtctgtggaggagagtaaagtcaggatggttccacgcatgccacgggtagtggggtgatgggggaggcccctttcccagccctggtgctcagtggctctgcttcctttccagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggagggggccgctgtccacctgcccagtgcttggcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcccgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcggccacgctactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaaaaaaaaaaaaaaaaaggcaattgtgcggagccaaccatcactgccattacactcacattcaatggaaattgattaggcctgagagaaggagcaagaggcagaaacactgactctgagaccatgaccttggaagatcctcagagatcaactagccaagtcactcacttaaaatggggaaactgaggttccaactgacagaaactgagggtcctgccctcttctctggctcctcagtctccagtttgaagcaacagagccatcattttcccagtgggaggggcctctgtgtcctggtctatgatggggcgagttggaggggtgggcttctctagccctgccccctcccaggagcccagcccctctggccaggactgaggaggagtggagggaagcagggagggagggagcaagtgtgaagggcacagctgctggcaaatgccccattccctgccccagcacttcccagcctttccaggagctctgccccacccctactcaaggagtcaggtgcccagggtagggaataagtctaggaaagggggtggagacaggaccgtgacagtctcagggaccaatccctgcctctgcccatcagattgccaatttggggagacagcaatatcatctgggagattcagcttaatttgcttcaattcagcaaccatttattgagcatctattatgtgccaggcactgtgccgggcactggggatatacacaaagccataagcactggggactgccaggttggcactgtagggaccaagattaactttttggtgcatctaattccacctctgcaagacactgcttccaaggctacagttggggaagatgaagagattctagaatctgtgccctgggaagggagaaacagcagggaaga

SEQ ID NO: 12395 - DNA, 21180 bp, Human
agaaagaaaagaaaaatatctaacttggaaaacaaaacataaacctcatttggtgactttggtggtttcacagcagtaataaaagtgataaggtctataagggataacactgtaggcgccttctggcactaaagtttcatgggtccttgccatcaggctcaggtgttactagcaattcatccaaaatgcagttataaaacacctactttgagccaggaactatattttatatttattttatttattttttagaggcagagtcttgctttgttgcccagactggaaggcagtggcccgatcacagctcactgcagcttcaaactcctaggctccagtgacccactcacctcagcctcccaaagtgatgggattacaggcgtgagccaccacatctggccccaagaactgttttcaatgatagcattttatttaatattataaaattaatatgaagaagttgctactaaaagaagcactttagcaaataaaatttaatagatcaggtagaaacactgacttcaatcttaatttgggtggctgatcaggtaacctacaattgggcaatcagagatgaacaataattttgtatgctatctgcctgactacacaaggtacttttatgtctttttgtcaattacaagaaaaaattatccctgggcaaacaaatacacaaagataaaagagcaaaaatcctacccacaggcaactataagatagaaaaaaatagtttgattaacgacttgaagtgctgaacaaacatttaagaactttggcagaaatttctgaaaattctagtccaaccgcgaatcaagaaacacaggtaacactatgttccgttactgggttagagaacagaacagttggctagtttggctaactcatagaaaacaagcaaaccaaccatgctctggtccaacaatcatcagagcacgagtttctcctactcagagtcggtcccatgggggaaaaaaaagccacacaggagcgggatctgtagttaaggaagataattagaggacgattttcctttttttatttctctgtattttgtaaagcaaccaccgaggtaggggcggggagggagtggttaatattgcggatattaagatataaataaaggcagatgaaatgaagttagactttcacaaagaacgaaaaacctacgaatgctcttggcctcattaacaaggaacataagcagttccagatgaggaacccataacaaacttcaaataacgaaactgtagggagcaagggagtccgtgagagtattttaagaaactgggacccaggaagactaagttaacggatgggatatcatgctgtctatatttctttacacactgctatgctttattaattaggttacattataatgttaaataactagaagcgctgggcatttaaagttcttccagaccgccctaaccactcaaattatcctaattagcaattttttttaagttaaagactatttcaatcgcaatgggtcggtttctatttcaaagatgtaaaggagtcaacattctggcacttcctcttggccggcaggacgaggttgacaaagtcggccagacaaggtagggttatgggggctgcccagtcccgtgggtctctaggcagtgtgttctctcttccgaggtgggggtgtccccggcgcgaggagctagctgtggtcaccgaagcccacgaccaaagcggggcgcccccagcgcttggggccgccttgcctcggcccagccgcgcacctggacccctaaggcagcccccttcccggcgctccgctgtcccgcggccccgcagcaccgcccagcccgcgccagacccgcctccagccgcagggaactacctaccgtgcgccggcccctgggctgaaaggcctctgactacgggctatgtaacagcgccaccaacgagcgggacggacagagcgactccttccgacttccggaggaagcggaacgctaccggaaatcgcggggagggtcaaaggagacccggtctccgaggctcatggcgatgctggtcctagtacccggacgagttatgcggcctctgggtggccaactttggcgcttcttgcctcgcggactcgagttttggggcccagccgaggggactgcgagagtcttgctgaggcagttctgcgcgcggcaagcggaggcgtggcgtgcctcggggcgccctggctattgcctgggaacccggcccctcagcactgcgaggccgccacccccgtggtcgcagaagggccccggagactccacgcgcccctcgaagcccggggtgagtgcacacctggaacccttctggtgctcgtcgcggctgtcggccagcccagcggccacatcccacttggtcgtaacctcagacactactccgcctcccctaaagttgtccttagcttgcgcgccttacctgggtcatggaatttcatcctacatttcccgtgccttgcgggtagtcccagttctccacagagaacttgagactttacaccctctccacgtggctggatgccccgacttggattttatgttagcgtttccatcaaaaaaaaaaaaaaaattaagtttcaggttttcttaagggtatgaacctaaagtttaccgtgattgagaagtcagaggacttttataatttgtcacttgagccccatccagagttccatgtatacgttgaaattgaaacaaaaagtggaacttagttatgtgtggatctgcctttttcttggggttctctcgagttctaattctgacccagaaataacttgagagccactaccctgtggtaagagaagtgggtttttggagctacgggaaggttaatgagttaggcctagtctagttggccaacatcatcttcatttggggagttgaataagggtacaaagaaataatgggtgtaatttgcaagaagctccacttttagattcctcttctactttggcattgttacttctggaagccagagttaagttaacctcccaaatttcgtttggtctatttatctcagtatcagcataagcagataattgttttttgtgtgtgtgtttttggattttggtttttgttttgagacggagttttgctcttttgcccaggctggagtgcagtggccctatctcggcccactgcaacgtccgcctcccgggttcaagcgattctcctgcctcagcctcccgtgtagctgggtttagaggggtccgctaccacgcccggctaatttttgtattttcagtggagatggggtttcaccatgttggccatgctggtctcaaactcccgacctcaggtgatccacccgcctccgcctcccaaagtgctgggattacaggcgtgacccaccgcgcccggccataattggttttaaagtcattactggagctagggtcacacatagtaacaatcgtggtacttgagcttttttttttttttttttttttttttatttacatgaagagaactgacttagggaactttcccctggagatgaatgcctttgtagttcagatcccagacctaactgcatccacagaaactttgagcattttctcatccctgaaacattttgcacatttaacatcatggcctgtgtgtatgtatattaaaaactactttaataagtttgtatggttaaatgtttgcatcttactagaatttttatgtttgaaatccctgccccagtagcctgtttcctggaagtctttagcaatcacatttgctattggaggagctttactggctggaatgaagcacgtcaagaaagaaaaggcagagagtaagtagattatcatctgctcagccctgtataaaggtcttcctggctatggactagcaccttttttgttgttttttagctttttgttttgaaacaactttagatttaccaaaaaattgcaaagatagcataggttctacatacctttcacccagcttcccctaatattaacatcttgtataaccatgacacatttttcatgactaagaaattttaaatggcacacaactattaaattacagattgtatttggatttcacttgtttttctatcaatgtcttttatttgttccaggatccaagctaggataccactgcataacaatgttaaaagatatactgtggatagatttgactgggcaagatgaaatctggagggtacgaagatgagtaagatgtagtcgagcctttgaggtgcacacggaagggaaacagacacagaagtaaagtattttactagatgcgattctgccaggccagaaggaagcttaccatgttgtgagagcaaaagcaagtcccagccttgagatttgagaaggcttcctagagatcaggcaaggagcatagtgcgagtagatactgcatgccctctgtggatgagggggaggtgaaaagagcctggtcaggaaatgccaggaactgctctggattagcatcttgaaatatttagaaattatttataagaactttgcattttagtgaatatcctaggacttttaagatttggtttagaggttttaggtaaatctttaaagtattgcttaaatctttccattctttggagtctcttttgataacattatatacaaaggttaatgattaaatctgggaattcataggctttaggaacttagcagtgttaagttttgtactgacatacatatatatgagactctttggcataataagtagtattgggtaagattttcatagtctaataagcagtaagtttctttagtttcacaaagaaacagctaggaaagttgtggcgggaaaattctagaatatggaagctttttttgactttagtttggaatttcaagtgcaattctaacgtttgttttatttaaaaaatgtattattaaataatctgaaaagtcttcctaaataatttgagagtatttatttgctgacatgttgcgtcattagctccaaacactttttggtgtatttcctacaaacaaggaccttttctagcataaccacaatacaaccatcaaaattagaaaattgacgctgataattttgctgctgttcagtgttcagataatcttcagggtattgtttatttgtttgttttttgagacagagtttcactcctgttgcccaggctggattacagttcagtcttccaagttttgccacttgatgtctttcagagcaaaaggatctgtttcagaaccataccaccttgtatctagttgtttaccttagcctccttcatctgtaacagtttcccaggctttaactgactcccacaaccttgacagctttgacagttacaggagagttattttgtagaatgccccttagcttggatttgtctgatgtttcctcattcaggtcattcgggttgtgtacctttggcaggaatatcacaaaagtgatgctgtattctccgtgcatctggtcagataccacatagtaccagttgtcccattactgataatgtccagtttgatcacttgattaatgtgtgtctaacaggttttctactgaaaagttactcatgtaattaatggtgtttcatgatttgtattgacatacgtatacttacatattctgttccccatcccactatcaatgtattcatttatttatatctgtggacttgtttcctatatattcattcagtttaaatccatattctctttattttgatgcccaagttgtcccagattgatcagcgggagcccccttggagcaggcttctgtgtctttgacacgtctccaatattctctaagttctgctttccttctgccacaacaagaggttccagcctcattttacactttctttgccgcaaccctggtatcagccatttctccaaaaagctgtttccttttagtgaagaatgatatttagaagtcaggttctgggctcatggttcttggagtgtgtctgctccctggtcctctcagtggacatggtgagaaaatagatatatttatgtacatctatatttatttatatctatatagatagaagttcacactagtacctgcagtgtatttgcagtactgcagggttcagcctagctctctttctctccatagttgactcttgtttcctattgtaactctcttctctttaatatactcatttatttcatcaatttcctgtgtgtaactaaggtcccgtcaccactatcacctccccacccagctgccctccttagcaccctcaggatcagactccctatgccaggccacccaccgcaccccacttgtttagacattcagctctaggccactgcagcccctccctgcccccagcatggacacagctaatggcttaggactgaattgttcctgaaaaagaagaaatattttttccttttttacaacataccatagcatttcatttgattttgttttaatgttttgtgcttatttttctgaaaagatttttttagcttcttgaaaactgaaactgttttttccacattttgtgcccccaccatgagtagcatagtacgggccatatgtcaggtatttgagtacctctggttaaattgactttttttttggtgtcgatatgtttttgtctccttaagagttagagaaggaacggcagcgacacatcggcaagcctttacttgggggaccgttttccctcacaactcatactggggagcgtaaaactgacaaggactacttgggtcagtggttattgatttattttggcttcactcattgccctgatgtctgtccagaagaactagaaaagatgattcaagtcgtggatgaaataggtaagaaagccatcactaactaaacaaagtatatgtttacttcatgttaccaggtttttcacacccttgtattattgttaggtggggttttgcaattatgtgatttgtaagaacataaaatctcagcatttggcttgtttgttgctttgaatcttgtgaccttattctccactgaaagaagcttgttttgatgttaaatgttagatcacttaaaaatgtcagtgtggtctcccttaactctacttttgtgtcccttcctttgcatcactgatgctgccattgcctcttccccactgattgtgacaattaaattaggaaatctttgcaatggtctgcagtctgtggcattttactagtactagtaagaaggaagggtgcctcctccatacagtgaattatttcaggatattcagctcttattaacaatttaccttcttgcccttgagatatggtgggagtgaaaaaaactacagatactggagtggattcagagataagatagccacatgacattatccaggggaagaacatttatgtgctggtgcaggcatttgataggatatgtaaccttgtattatccaccacagataatactactgtatatgggtctcctcctcctaaaggccatcccttctccatccccttccccgtcctcttcctcttcacctgaatgttaagatgtccatctgcttccaaaacacctagctgtccagcacgtcctatactctcctgttattgctggttttctttgtcttttcccttagggtgtgaatacggactaattggaactctctttcagatagcattacaactctgccagatctaactccacttttcatcagcattgacccagagagggacacaaaagaagccatcgcaaattatgtgaaaggtatttttttaaataatactttacatttatttagccttaaagtttttggaatatcagttcatttgaaccttacagtgccttgtgaaataggacaaatggtattatcaccagttttatgggtgaataaaaaggtgaagctaggaattgttatggatagttagtgcgtaagtaagaaatgggtttctcaattcctgatgcagtgctctttatattttgtcacagagaaaggatttgaacttggccttcatgtatcaactaagttaatcgagccttgaattgagagtaaggacacattgcttctaactccagcgctgtaactcattctctgcattgtaaaatcagaacaaacatatattctggaagtatgttcattggtagattaaagatgaataattaaatacaaacatattttgaactcagtgcatgttttataaatttaaaacatttactgtaacaggccgggcatggtgggcctgtaatcccagcactttgggagaccaaagtgggtggatcacctgaggtcaggagtttgagaccagcctggccaacatggtgaagccccgtctctactaaaaatacaaaaattagccaggcacggtggtgcacacctataatcccagatattcgggaggctgaggcaggagaattcgcgtgaacctggcaggcggaggtagcagtgagctgacatcacgccactgatcttcagcctgggcaacagagctagactctgtcttaaagataaataaaacatttactatgacaaagtaactgttgtttaattgacacataacagttgtacatatttatggggtacagagtccctatcctccccaaccctttccagcctctagtatccacagttcttctctctacttctgtgagatcaacttttttagtttccacgtatgaatatgcagtatttatctttctgtgcctgacttttttcatttaacatattaatagtatcctccaggctcatctccattgccacaaatgacaggatttcattctttaatatggctgggtagtattccatgacgtatgtatactgcattttctttatccattcacctgttgatgagtactgttggatttcatatcttggctattgtgattagtgctgtggtaaacataggaatgcagacgcctcttcaatatactgttttcatctcctttggatatatacccagtagtgagattcctggattgtattgcagttctgtttttacttttctgaggaacctccatactgctatccacaatggttatactaatttacatttccatcaatggtgtgtgtgaggtatctttgttctgaatcattgtcagcatttgttatttttttgtatttttggtgatagtcattcaaattgggatgagatacctaattgtggttttgatttgcatttcccttgtgattggtgatgttgagcattttttcatatacttgttggccatctgtatgccttctattgagaaatgtctatttagatcatttgccctttttaaaaatgttatttgtctttttggtgttgagatgattgagtacattctggatattaactccctagtctgatgaatagtttgcacatattttctcccattctccaggttgtctcttcattctgtttattgtttcctgtgctgtgcagaagctttttattttgatataaccccatttgcctatttttgcttttgttgcctgtgctcttgaggccttatctatcaaattttttcccagactaatgtcctgaagtgtttcccctatgttttcttctactaattttatagttgcagatcttccatttgtctttcctacatttatatttgatttttgtatatgataaaaatagggatctagtttcattctactatgtagggatatcccgttttcctagtgccgtttcttgaggagactgtcctttccccagcgtatgtttttggtgtctttgtcagaaatcagttggcttaatttctcggtcctctattctgttccattggtctgtgtgtctgtttttatgccagtaccatgctgttgtggttactatggctttgtactatgttttgaagtcaggtagtgtgatcctaccagctttgttctttttgcttaagattgccttggctattaggggtctgttgtggtttcataggaattttaggattgttttttctgcttctaaggaaggtattactttcaatggaggaatttcaatcaaacacctctgtatgctagttaaaagctgttaggcacttttaaagactacagattatagtagaattgagagtggatgcttaggttctaattcatctgtgaaaatgggcaagtttaatttctctagactcaagtttcttcagcatatgtgcttaaaaatcaggaatctgaattttaattatggtaacattgatttaataactggttaaaagcactaaagaatagttttatatttatattatatgacacattcaaatacatatcttctaaactttgaggttatttaaaaatatgttttatgaaggatctgctgtatgtgtaattacttttaacacatttattaaggtataattgacatgcaataaagtatagatatttgaagtatataatttgttgccttttgtaactgaaaccatcccacagtcaagaaaatgaacatacctgttaccctgaaaagttttcctttgcctttgttagtccctccctttttccctccccaatctcccatctgcagaactgctttcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgctaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctgcagaactgctttctattgataaagattagtctgcactttctgtgtatcatagttcattcctttttgttgctgactaatagttcacctatagacatttgagttttttgcatttattggctgttacagataaagctgctaagaacatttatgtacatgtttttgtgtggacacatgctttcatttcttttgagtaaataggataggaatggttagatcatatagtaggtgtattttaactttctaagacactgagaacctgttttccaaaatggtatatttctgcattcctgccagcagtatatgagagtcccagctcctccacagcatcaccactcttggtgtggccagtctttttaattttagccactctagtaggtgcttagtgatatctcattgtggttttggcatacattttcttaatgactgttaatgttaagcttctttttatgctcttatttgccatctgtattacctttagtgaagtgtctgttcatatcttttgaccgctttttatggagttctttgttttcacattatgtgtatatgtattatttatattctggatacaagttaggtgtgtgatttgcaaatattttctgccagtctgtggctcgtcatttcagtctcttaacagtgcctttcaaacagcagttttcagttttaatgaagtccaaatttatcagtttgtccttttaatatagtgcttttggtttggtatataagaaatctttgactaacctaaggttacgaaggtttatgttttcttcttgaagtttagagtttttactacgtatacttaagcataatttatatctacagtttataggtttgtcagaaatttgggcaatagtatagtcatttcatgaagcaatgaaaaacagatatttatgaactcattgagttatgcacagtcttcaatttaaacatgtgttatattggcaaaaatcacatattactaaccaaaccataatatccccaaatgagtagacattcgagttgctgtacctaaccaaaacaccagactttatggtaattttcaacagaacatagcgattgatgatgtagtcattactagttgcattttggggagatttttaaaactttaatttggtatttagaaaaaaatgcagtttcagcaatttagttttaaaaaaagtttgaatgtgcagctaactcaggcttcattcacctttctctttatttactcagagtggaaaaagaaagcctgtcttttcagaatctgaacaatgtctcatttagaatgatgagttcatccaaggaacaaaaattggcttctgtacctttagaaaaaggaactgctgttaaatgttgggctgtcatttcagtagtttgatgaatccagttgttttaagtgacctctaccggttcacttacatgaattccaaaaacttaatagcagatacacgctgtgaatgatttgcccttatttcagaactttgttaagattgcgttttggggatgactagtattaattaaccagtttttttaaatcagaagtaaagagtagaacttgataccagtgttgaaattatttgcaggaaaataagacacaggtattttgacctgatatgaacttagttatgaagcaaatttttttccccatatgatgccatgaaaagttatagtatttaatttatgataataattttaagctttagtatatctgagaactacatgtgactactccttaaaaatcaatttaaaatgtgatacaagtgattagaaaatattccctccaggtctttactagatagtcataaaaagatttgacttatatattacaaaggagaattttcatttgttctttgtgaatttcttctccttttcctttgaatcgtgaagaaatgtttggagactcacaggaagaaagtggcagtagagctgctttacaactgatacattttttgaagtagagatggttgttttactggcttctcatttttcactgtctctctcattttttatttagaattttctcccaaactggttggcttgactggcacgagagaagaggtcgatcaagtggccagagcatacagagtgtattacagccctggccccaaggacgaagatgaagactacatagtgagtaaatgttccagttttaacccatggaccagctcccagatcccaaatagtcataaggctttcaatgactgactagcttctgagaagagagaatacctaagattattgcaaagtccttaggaatttttttttttttttttttgagatggagtctcattctgtcatccaggctggagtgcagtggcacaatcttcgctcactgcaacctccgcctcccagattcaagcaattctcctatgtcagcctcccgagtagctgggattacaggtgcgcgccaccacacctggctacttttttatattttttggtagagacggggtttcaccacgttggccaggctggtctcgaactcctgaccttacccgcctcagcctcccaaagtactgggattacagacgtgagccaccgcatccagcctccttaggaattttgaatatttgaaaggataatagaagcatgttttttactttttatttattttcgagacggagtctcactccgtcagccaggctggagtgcagtggtgcgatcttggctcacttcgacctccgcctcccggattcaagcaattctcctccctcagcctctcgcgtagctgggattacaggcatgtgctcccacgcctggctagtttttgtatttttagtagagaaggagttttgccatgttggccaggcgaggccagggggtctcgaattcctgacctcaggtggtctgccctgcccacctcagcctcccaaagtgctgggattacaggcctgagccactgcgcccagccagaagcagttttttaaaagatgattgtttgatttatattcactgttctcataattcaattgcctgtttttctcttatagtggcatataggattttagggcagtttaaaaccagatacttgggtgccatgttggaaataaagagaagccatcatttggaacaacacttattttaaaaagattgtgttggttctcactgtgtccccagtagaggtatcagaaattgctcttctggagaaccagttttaggccatggagaactgcatttttaggttgaatgagaattctgaaaagcaaaagatgaaaggtttatttgcccattgactatatgccttggacagttaggcgttaaatatgtgctttttaatgataaggaacagaaattctgttgtacttgtgtagctcttaaattaactatcttcatattcatcagcactgccccagaagccttaaggtcatgcccaagttactgtgtttcttttcttgtcagtggtttcacagtgaagcaccaaaaggcattagcaccaccactatccaccaattttcctctcaatttggacatttttctcctatcatatgaagagtcggcgttgtattttagcattatttcagtatttttcttagttgtcatactctgttttttctataatattgtttgggcagagtaatcctaagagcctttctagctgtgaagctgtctttgtagaaagaaagatggccaagaccctgagtcactgatccagcagctccccatggcccatcccaagagttgagatgcagaggggatgggatgtctcactgcagtgctttgtctcaacagccaactatgatttctttgtccctttgaacctggaacgtgtgtgcccctggagcctacagcctgaattaaaagcaaggttctggcctgtttgccttaattaagcctacacagtaatcctgtcttccagatgtggtgcctcgtagaattagggaaacttggattccttggagtaaaagatgagaaaaatgagcacttttctttaagccttaattgtaaggaaagtagagggaccctcctctgttttcctcttgctgcttctctagcagaatgagagaagagcagagagccacagtggccaaaagaggaaaccataggaaaaggactttccggacttctgtctttatagagagttgtattaactggttttgagtttatccgatgatgacagcaggaatagatgagctcatcagtctgatttccagcattaaatgagttatattaaattgtttaaatgtatacagtcctaaactaggtaacactccatagtcttgatgcttagaactcataactcagagtcagaaagtcaaatcagaaagcagttgtacaaataaacccaaacagcctgcaaaacttaaattgaaaacattcagttacattgacaagagattttgctgaaaccaaagtgctgctcagggcaagaagggagggggttttggtcagactgctatcacatacccaactctactcaactgcccctctgcattttctatttaaaatactttgaaacctttaatcgtgtagcctgccttgcctggttagtgttgatttggcaagaatgtatcatattcatgtctgcctgtaacagcagtgggcagctaggtgccagtgagatcatggagcaaacacaagcctgggcactgaaatttatactcacaacacagataatccagaatatggatattaatgtttttaattacaaatgaaaacaaaaatatgtaagtcttatggaaacttcttggaccttgtagaatgtatctttggccccattttgagaaatactggcctactgccataagaatttgacttttgatgagattcgatgaggaattcatgctgtacatttgctaaatcatccaatagggggagacattcttcagcttcttaggtttttcattagtatgacttcagtcccttgaggtcacagattttcatccataggatggtttgggaaacttctgttatcatttaaggacctgcaggaagtaagggggtacctttaaggttaatgttgagatgtaatggaatgaagttttcttaatcccaaacgacagcaacaacaggcaagcttctggcttttgagtggactcttcagagtgatcgaactgggtataccaaatatttggaattccatagaaagctggatctgcacattattgtattatatatatataatactatattattatatagatattagttagaaaatacttttgaaaaaagaatacaaatagctttcaaacctaaatgtgcagtttcataataaaagaaatgtgaattgtataatgaggtaacatttttctcttggctcagcagtggtcagaaaatctgaaaatatattgtcgaaattggaaaagcaggaaataaactgcaggagtgaatttggaacagcaggcacactcatgcattgttgataggaattaaactcatacaccctcttcagagggcagtttaacagtatttctcacatttaaagttatatactttttatgcaagagattctactttttggactttatcctataaatataccctatggcattgtttttaaagagaaaaaactgaaaatccagtaaccattttttaactactgtgtataatctaacgtagaacaatgtccaatatattgttaaatgagaaagcaagtactgtagaatatattgttacttgtgtataaaaaaaataagtggtagtggatatatacacatagtagatgcagagaatttcttcggaaggatacagaaggaactgatggcattggttcactctaaggggaactgaggcactctgggtgtgaagagggggagggacattttcattgtatacattaactggatattcgttttctatgtgcatatattaccttttcaaaaaataattcacactaaaacgtaacttgcacactagaaaaactgagttgctgctctccattagaattggagctagaggcaacgtggtgataaaagtttgtggactttgaaactggacagattctaggttttaaagttaggcctggcacttaccaattatataatttactctctccagcctgtgatatcatttgaagaggaggagaatacctgtttcatggcttaagatgacatgtgaaagaatttgtcagttaatgctagtgtcctttttctatacaaggaagtactagaacttggaagacctctgtagacctctgtattagaataaatgtcaatgtgctctgtcacaacccaaaggaatattgaggagtgacctctgacaagttcgacagatacagataaaataatatttttgttgtgtactacaaggtaatttatattaagaacactcagaaaataagtcccacatactgtagtttgttttttttaacagagaatagagaaaaggaagaaatagggagaaagagtgatgtaagctacagagtaaggcttgaagagagaactggagacttaattctgatttctgtatcaaatatgtggagaaacgtagccccccgtcttgctcctgcggtgaactatcccacagcacttggaatccagttgttggcgctcttttggtgtacattctttccttatgtgggtaggcaagtgctctttccatttgctatcttaagaatgtgtgtataaaaaataataccctcacagacatatagtgcgtgctggggtatgtttgggaggtgtctccagtttggtatttgtagtcacattcctgtctttctttgtcttgccaaatagcagtcaagcctgcaataaattccaaggactctaagtgccaaatctcacttaaaattggattttatggaagtgtctaactaaaaaatctgatgactaatctaagttaaagttagagctgggaccattttaggactttgctgggaaaatggatgctgagtttacgatgactctctggttaggggggcagcatttatgctcccgaggatttgctttccaggtgatggattgatttcagataggattattcagtggaggagacaaaaatttccttggggagaaaaatgtttcttttcctgtttctgtttgaattactaatattaaaactaaatattgttcaaatttatagattatttaaactaatgattagttttctgatttcttctcataaagcgtggtaagcagaattttggcagtaatgaatgacaaccagttctttctaaaacatgaataaacccaagaacttactaaagaaagcagtttttcaccaacacttaattccatgtgatgtctgtttgtaacatgtttagggtctgaggagatatcttactcaaaaatgaaggtatttttcaacaagcattgctattccacaaacattgactgctttatgaaagcctgcagcagctatttcttagaaggtgaattcttttctcagagtgtgtgggtaaatatgttaaggattaaaccaaaagaatttcaggttctagctgatgtgacaagcaataaccagtgcagatgtttaggacacaaaagattttagacaatttttgttaggaatttgctatgatagacttaagcctattccataaataatagatgctgtaaaggttatttaagcattaatgtaaagttctcttatcttgcagcatacattcagtaaaataagcagcttattttggtaatctttgtcacactctccccccttttctctgcaggtggatcacacaataataatgtacttgattggaccagatggtgagtttctagattattttggccagaacaagaggaagggagaaatagctgcttcaattgccacacacatgaggccatacagaaaaaagagctagccaaagcagtgttgctggatgcagtattctcttgctaagaggaaggaaactgtctcgcataggagcctatataaatataaacatatatacgtgcactctacagaatggccttcataccatgagaacatttctgttttggatggggatgttacccttgcgttcaaccaaaattgattcttggaactgtaaagattacaacccaaagtctcccaggaagctgtggggagaccagaggatcaagctgaagtgaagccagtgaagagcccacctgtggaaggacatggcggggcgaggcacagccagtgcattcctgcctgcgaacaggccctcccagcagctttgccgcctctccatcgtcttgggcccttgctcaaatagctgtgggactgaatttcacagaaaagaatataatttccatagtgctcttgcttgcctcttcttgagttctttgctcttctgagttcttggtggctaataacagtcagattagggtctctgccattcagagttgatgcttgaaaactttagttttccttattaatgaatatcactatcagatttgactaatgaagaggaaatctattgtttgggggaaaaaaaacatcagtttgatttctctaggggttcttttatgtgatttttagctaagtggtgtgccaggttttcagtgacataccaaatggaaataagaggatattgatcacgagtgtgatgctgagtacctttctgcatatactggattgtactttgtgtaaagtaaacatactcagttttgctgttcagacaagcgtgatctttttcatgggtgatgagtgggtacatagatggctgcacacagttctcaggaaagagacccacaggctccagcgggcaggtgggtgggacgcttgctgaagtgcagttccccagacccagagctgaattcactgaatctgcagtatgatgcagagacctgcttccatgacagataccccaggtgactcggatgctggcggactgggaccatcccttaagaaagtgttttttggggaaataacttgcctggcacaatggctaatgcctataatcccaaaactttgggaggccagggcctgaggattgctagaggttaggtattcaagacaagcctgggcaacatagtgagaccccccccccccgcccccatctctacagaagatttttttggcatggtggcacatgcctgtagtcctggctactcaggagactgaaatggagtatcacttgagcccaggaattcaaggcttcagtgagctataatcacaccactgcattccagcctgggcaacagagtgagaccctctagatatatctatgtagagatacagaaattaaaatgaatttaaaaataaataaatttgacccttcttttggtgtgtcagccattgaagaaaatgattattgagtgatagaatgaatcttggcttttgtttctaaatttaactgccctagaatcctgggtttggcctttttctgccagaagctgctgccctaggggcaaagttctccaaaagtttttcagtaaatcctaagatgcaacaaatataatgcctagatagacaacagattctttttacatgatatgtttctacacgcacatgatagaggtcttttggtttttaaattctcaatacttaaacctaaatatatcaaagtaaaagtatgtgaaaaaaaactatgctagttataggttgaataatgtcccccaaaatttatacattgaagccctaatctcagtacttcagaatgtgactgtaattggagatagggtctttagagagatagttaaattaaaatgaggctgctaggttggccctaattctatatgactggtgttcttaaaataatagattagctgggcacagtggcttatgcctgtaatcccagcactttgggaggccgaggcgtgcagatcacctaaggtcaggagttcgagaccagcctggccaacatggtgaaacgtcgtctctctcctaaaaatacaaaaattagccgggcatggtagcgggtgcctgtaatctcagttactccggaggctgaggcaggagaatcgcttgaacccaggaggcagaggtggcagtgaggcaagattgcgccatcgtactccagcctgggcgacagagcaagactccgtctcaaaaagaataggagacacagtgagacgaccatgagaagccagagagaaaacagccatcttacaagccaagagagaagttgtgagaaaaaaaaaaaaaaacaaaccctgctgactccttgatttttgccttccaagctccagaactgtgaggaaataaatgtctgttgttttagccaccaaacctggtaaggcagtcctagcaagctaatacaatagcctgttccttaataaacaactgcaagatttagtttatagaaaccagctcggaagcagttggtttagaatgactttcctaggaatctggtcaagaaaggaacttactaaaagactattctcatttaacaaaagagatattaagtatctcaaaggccaaatctttaaaaagattatctgttttaagccacaaaacatttgtgtggatccctttgcagcaagtttgctcttagataagattcagtcttcgttctcagctgttgcaggttaaggcttgtgaaatgatccaaaaagggaacagcagcttttggagaaaacttttatttgttcttcattctagtgtcaagtttaaaggcttgaagtcagaatgttagaagtggggaaggggaccttagaggtgacgtcttccagat

SEQ ID NO: 12396 - DNA, 78846 bp, Human
ctcaggaggttgaggctgcagttagctgtgctcatgccactgcactctagttaggtgacagagcgagaccctgtctcaagaaaaaaacaaaaaagatgcggaaggaggaaagagggaagaaaattgagactggaagtcatagacccaccacttttgtccctatgggtgatagcaaaatcacctttgacgagattgtctgattgtgcgcagctttgggtttagggagacctctctgcatctgctcctttacccaaggaggtatgggatccacactgcttggaagttagaaagaaaagatcacttttagcagagggctggacaatatctgaatgttgcttactactgtcttggatgggcactaaagggacggtgaaagtcctttgactatttttggtgttctgaaattcagtgtcattgcacttcacaagaagcaatgtaaggaggcaagtgtcctcccaggcttcgctaaggctccaaagccttgtttggaggggcctcttcagacacagcagctcgtattttgaatttatattccgttggcaagagagattgagcaattattagattgagagacatttaagagagagagaattatttttaaatagtggggcggcagtcccagagtgagcgggagagagaagctctgtgcacctgcagttccttcattcattctcagtttcttggacctctcacaacgcgagcataattttcgctgagtgtgcagaagttcaagattctttttttttttttttttttttttgagacagagtctcactctgttgcccaggttggagtgcaatggcgtgatctcggctcactgcaacctccgtctcccgggttcaagagattctcctgcctcagcctcccaagtagctgtgattacaggcgcccaccactgcatccggctagtagagacggggtttcaccatgttagtcaggctggtctcgaactcctgacctcaggtgatccgcccacctcggcctcccaaagtgccgggattacaggcgtgagccactgcgcctggccaagattctttactggccaccctctctccaacctcccatacaatacagctgctaaaaaccacttagtttatctagatctgggtgaaataaatagtaatctggcacttctcgtctttttttttttttttttttttttttgagaccagtgtctctttgtcgccaaggctggagtgcagcggcgcgatctcagctcactgcaatctccgcctcccgggttcaagcgattctcctgcctcagcctcccgagtagctgtttacctacaggcgcccgccaccacgcccggctaattttttgtattttcagtagagacgggggtttcaccgtggtagccaggatggtctcgatctcttgacctagtgatccgcccgcctcggcctcccaaagtgccgggattagaggcctgagccaacgcgcccgggccattgtcttttatctcactacacatttttctaattttatttattgtgtattttacttacacaagaatgtaagctccacgagggcagggatttttgtcagttcaccactacattcttagctcttggagcaatgccttgcatatggcaagcatttaatgaacatttacagatggaggaagaaacaactgcaggaaggagagaaaggaaggccagaggcaggacaagaggaagaagcgagagcaaggaaggaaaaaggaagtggaggaggaaagaaggtaggctgggttctcccagacccgcttcgagtccagcaggcagcgcgaaactcccaccagaactacaactcccggcaggccccgggactcagggcgggccgctgcggtccaggcgggacagggcgctcctcccgctgggcccccggcgtgccttgcgagcgcaggctccgccgcagtgccagccggaacttgtggttcggaccgtgggtgggggtggggccggggccgggcctggaggcgggcgggggccggggggcgggcgcctgcccctcccccgtcacttcctgccgggctgcgggcgcctgagcggctcttcagcgtttgcgccggcggctgccgcgtctctctcggctcccgcttcctttgaccgcctcccccccccggcccggcggcgcccgcctcctccacggccactccgcctcttccctcccttcgtcccttcttcctctcccttttttccttcttccttcccctcctcgccgccaccgcccaggaccgccggccgggggacgagctcggagcagcagccaggtgaggcggccgggccgggccgggcctggtggggccctcgcgggcgccgccgcggtggggaggtgggcggcgggtggggcctaggcctcggcgggcccgcgcacccctccgccttctcccgggcctctctctagcccgcggggccttcccggaggaggcgggtcctcttgcgttccctcgcctcggggcgccctgaggcctggccccgggcgcccccatcccctccagccctcaccggtgccacaaacaggtgctgcggccgcctttcctcgtcccgcatggcgcgcgcggggatgccgaagttattcccggggctggggcgcaggcgggggggaggggggggtccctgcttcaggtccccgagggctggagcctctcagtgtcgccggcccaggtctgtagcttagtggttaagagcacggcccaggtgtccaaaacgggtgccaaacccggctctgccccgttaggcaagacacttaaaaagtctttgtgtcttggttggaaaaggggctgctaataccgtccctgcctcttaaggttcagtgaaatggggcgtgtaaagcgcttatcagagtgccagacccacagcgtgtcccagtaaaccgtctgcataatttattagcgtgatatgaaggtataatttaatgggcagagtggatagaagttgacctacctatccgtttgggtttcttagaggctgcagtgttccgcgtgcccatgtccagagccagggcattgttttcagttgttaacatctgaaaggggcgtacgcttaattgggacactgtagttgacagtctgtaaacgatggatgctgtttctttccatctccgcttaggcaactgcaggatattcaccatctcccgcaggatgagcaacctgtccatttccccccgccccgccatcatccagcttcttcttgtcattccatttctgggaaagttgctggcagaagcttcccttgagttgagcaaacctatctagagcacttgctgtgtgttgggctctgaaggggggtgtacggagatggaaaaatttgtctgtcttgtcttgctctacacctcgataagttttttttcacggaagctttgcttatattcacccctccctgttggctgactttccttttaagcccttgccccgcctccgtgttgcagtattgcttgtgtggaagttttcttctgttccgcgaagatacgtgcttcagtctgttctgccactgttcttcggctgtgtggaagtttttaaggtcacacttctcttctgcttgtagctttcattgttaagagcgtggtggagttaaatcaggttcccggttgattttggcgtttcaggaatccgtgcttaccaagtgtaaattacattgctacttgttgaggtaaaaactaaaaatacagttggagtgtagagggagcagtttcggttatcctggtgacaggtgggatttttagaacagcaactttactaaaacatactgggtttttaaaaattctgtacttagttttataggtgtactctaaggaaatgcaacttatgggtgttcaattttatatgagtaaggagtgtgtgtttacctgagtgatcctcctgtatcttaggattgttttaggcattaaatttccttagtgaactgaaactattttgatttatacccatctcttaacacacatgcggcaaagtggcctccttgtttttgacattttcctagaattttctgacagtcttaccattgtttgtaatttaaaatgtttgtttgaatttttttttttttttgagacagtctcacgctgtcgcccaggctggagtgcagtggcgcgatttcggctcatttcaacctctgccaccctggttcaaaagattctcccgtctcagcctcccgagtagctgggattacagacgcccgccaccgcgccgtgttaatttttgtagttttcgtagagacggggttttgccatgttggccagactggtctcgaactcctaacctcgtgatccaccctcctaggcctccataagcaggttaggcgcggtggctcacgcctgtaatcccagaacttttgggaggccgaggcgggtggatcacgaggtcaggagatggagactatctcttgagcctggtgtggtggcgggcgcctgcagtcccagctactcccgaggctgagacaggagaatcgcttgaacccgggaggtggaggttgcctgggcgacagagagagactctctccaaaaaaacaaaacaaaaaaaacacataagcaaacaactatacaagcagtataaagcatgtctaatactgccatatcacaatggcatatttcaatagggaaatggtattttaaataccattttttaaaaaccttttattctggaaaacatgcgaaactcgaatagtatggagaaccccatgtgttagtcactcacttagctttgacaattattaactcatagccaaggtcggttttgtttcatgttgtatccccccacacaaactagattattttgaaacaaatcttaaacattgtgtcacaacattagcgattttgacttttaccagattgccccagattaaggtcacaaaatttacttttagtagaataatagttctcatttttgtttgttgggcttcccttctctgtttatacatgatttctgtacagcagaaaagaagaagaaaattaactcttgatccaatgccttcagctcctcaaaatcaaaatacaaccttgctgctttattgtgtacaaaagcaaaaattcttgagctattaatgactataattgaaaagcgaacaaatacagatttccccagtcctgttttggcagagacctgccttttaacccactttaatagagataactttgtgtcaaagttaaactacagttaataattcataatgaaaacttaaaatgtttctttacagtagttgtgtaaagatactgctgttaccttaggttaagaattaagcaaaagataatcttctaacatagaattgttttccaaagtgcccccgtctgccctatttccaaataacaaatttagcaaatatgaatgaaaccttaatttttgtgaatagtatgaaatcacagcataagtgttcacgtttttctttcttgtgtctaaaagatctctcttacaatggaagttgacaggaatattataaatattataaatgtctttgttgcataactttcaaatttctggtcgtgaatagttttcagcttttaggtctgttatttgagttttgtaggtgtactttgagcttgatcaggtacagtggaaatgttacatgttatgttttagttatgactacctggaagatggggaaagatacacctcttaaaattgatttaggaaagaaacgccaatttagtatctgggaaaggacacaacacatttttaaaaatgtgtagtgcttcccattaagcttaacgtaaaacttttaagcattgagaattgttaccataaatatagtttcttgagaataagttgctctcttttatgtttcagccagaaagtccatgtatatacagattacagcaggtccttgaataatgttgtttcaagataatgttgagaaaaaaaactgtctgtggagtttacacgttctccctatccctgcatgggttttctctgggtactcttgatttcctcccacatcccaaagctgtgcacgtgaggttcactggtgtgtggagctgtgtgtgtaagtgtgagtgctttctgcagtggatgtcctgtccaggactggttccggccttgcaccctaagctgctgagataggctccagccaccccaaccctgaactggaataagtggtaaaaaaaaaaatttttttttttgagatggagtttagctcttgtcacccaggctgcagtgcaatggtgcagtctcggcttactgcaaccccatgcctgtaatcccagcacttttggaggctgaggtgggcagatcacctgaggtcaggagttggagaccagcctggccagcatggcgaaaccccgtctctactaaaaataaaaaaaattagccgggctgggtggcgggcacctgtaatcccagctactcaggaggctgaggcaggagagttgcttgaacctgggaagcagaggttgcagtgagcggttatcgtgccattgcactccagccggggcaacaagagcaaaagtacttctcaaaaaaaaaaaaaaggcatgtatacttcacatttatttcagtgtttaatattcgaagtgtttggtctttatttaaaagtttggtgatatttttctgatgagaaatatgccctagaacctaactcttgtttgtatcaataagcgtgtgttagtcggaagtctcagtttccaagaacctaccccttatgttaagagaggatttactgtattttaagtttagaaatggccatgactcatggaactctcctccatccccattctaaagtccagatcattgatatcattctgggtgttatcaaaatggatactgcttcatccagtctctctccccaataccacaaggtagtctcagtttgtggggcaactttctttgagcctttttactggattgagtaagagtgtaattcagtataaagatgaaactttcatgaaaagggtatctttttgtgggattccacaagtcaatcccagagtttgtcgcccaggctggtcttgaactcctgagctcaagtcatcttcccacctcagcctccttagtagctgggattataggcagaggccttgttttcatgagcctctaaattggatcttcttatttgatgtgatacccagtgacacagaattgttcaatttgaggaaatataaattcctcccctctcaaataagagctttggagttgcttttctctcagaatgggattttagagctttcaaaaatgtttagagaattttatgacagatttgtttcacactagacctataacaggttattttacattgacttctggtgatggagacatttgtggttgaaatgcttctcgtgtaattttctacatgagcttttctttaaataaaacttcaccagagtcaaggctgtataccatttgtgctgttccaaaaaatataaattgccagttatcagttgaactatgagaggacatgttagttgctatggttatttacccccaccattttattatgaaaaatttcaaacatataacaaagtttatgaagttttattgtacatctctttagataccatctactttctatttttgcctccctgtttcatggtgctgaacaccgtctactttttttttttttttttttgagacggagtctggctctgttacccaggctggagtgcagtggtgtgatctcggctcactgcaagctccacctcctgggttcatgccattctcctgcctcagcctctcgagtagctgggactacaggtgcccgccaccatgcctggctaatttttttgtgtttttagtagagatggggtttcaccgtgttagctagaatggtctcgatctcctgaccttgtgatccgcccacctcggcctcccgaagtgctgggattacaggcgtgagccactgtgcccggcataccttctgctctttgtcatgaacattttaccatacagtattatgaagcttgaataatgttggccaaatccattgttctcacctgctaaggagataataggattataaatatatagctgtgttgatcttatcaaatgccacgggatggatgggcttggatatctgtcttgttgacagcttaatgctctgaactagaaaaccttactgcagagaaaagtaatatttttaaagtggtaaaatgggaattactgcaaatagcttaatttgttttttaagtgtttacattcccatactggtgaataaggttgatgtaacagtgatttatgtcaccagataaatggaagtagagaaaaatttctgcaggctgttaattgctgtatattttctgggattacatatgtttatttgttaaagaagtagactcagggaactccctcaaagtatatttactggaagcaaaagtggaaaaatctatttgagaaagtgtttgctttcgattaaaaattagtcttctgaatatcaaatctgtaacccatctggcatctgtttaatctggaatctaatttgggaaagaagtgtgatgactatgtgggtttataacagtaatggaagcaaaactggccattttattatgatagaaattttgtgtcatgtctcccagacaataaaggctaagaaaatctatttaaatacattggggtcttttcccctgaatgaacatgattgctgagggttaaaccttcattagattgcctctgctttttttttttttttttttttttttttgagatagtcttgctctgttgcccaggctggaatgcagaggtatcatctcggctcactgcaacctccacctcctgggttcaagcaattctcctgccttagcctcccgagtagctgagactacaattgagcaccaccacgcccggctaattttttgtatttttagcagagatggggttttgccatgttgcctaggctggtctcgaactcctgagctcaggcaatccgcctgccttagcctcgcaaagtgataggattacaggcttgagccactgttcccggccttgcccctatacttgatgtagctacagaactggttgctcagtgagtgggttggttttagtcagcatattctctgatcctatttaaaattttttacaagtggagtgttgctgtaagttttatagatgtttatgtgtaaggacaggtttagtgaatttgctggataataatatttactgctattgagctcttaccatgtgccaggttagaattacagggtgaaagttattttatgcagaaaaggaattaaaaggtcaggttgaatttacctaataatataaaagttgcagttcatttagctctttccttgaaccaaagaaaagggtttcttagaccctttatgttgtatttctaatactcataaacatctttgcagcgtaaagctcataataattgctgaggatgctgatgcgcttccgaggggccagataactggctcagagtcctgaggcaccaagtattagttctagagcacaggctggtctggctccaaagtcagtgttctttccactgaaccatgctttgtctctaaattatgcttaggtgctttttgtttaggataattgattctgcttgtcactggtggccctcccctgactctccccaccgcagcagctaggatgaattttgctcattagaaccctagatcaatttgaaagaaagtctggttaagtaatagtcttttagatggacccttgaaatagctttccagtttacttttatttgttatgtcaaattaagctaaaacttaaagctgatccacaggtttgtgtgtggggaggggctgtcttattaacctttgtgttaaaggaggccagctcctaaattactgctatcgtgtgtcatcaggtttgttaaaaattgctggcatggtggcccacgcctgtaattccgtcactttgggaggccaaggcaggcgcatcacctgaggtcaggagttcgagaccagcctggccaacatggtgaaaccccatctctactaaaaatacaaaaattagctgggtgtggtggtacgtgcctgtaatcccagctaccccgggggctgaggcaggagaatggcttgaacccgggaggtggagtttgcagtgacctgacatcgtgccgctgcacttcagcctgggcaacagagcaagactctgtatccaggggggggaaaaaaaaaaaaagaactgtagtccaggttgttgctaaaaaaaaaaattcatttcttctgaattctaacattctgctttagtggaaatgagttaactaagcttccaattaactttataggataggtgctggttgtcctctttgcttcctagccctttctaacatccctcttgtggctaatactgttgggagtatttagtacagcttcctgtttggaattgaactgcttcctgaacaattttgttttacttttgtttgaaacggtgatctgaatcagaagcttctttggtattccacctgggcagtcttctcttatggttagtcttgaaaggctggatcagtgaaattaaatctgcctttggatgtgagcttttagtgaaatggtgtctgaagttccattttgtgtttaacctcaactgaggctaccctgtagtctgtaatgacatagcatgtctcattaatcactaataggtgttggaaataccccttggcatgaagtgagcagataatgctgcttacattgtcactatattagctcccttcagagatgagctttaggatctaactagatcttgtctgattctctcctatctttgctgttttgaaatccatgccttctatagattacaattaactgaggcatgaattttctacccttgcagattccaccctgattcaaatagggccattgtctgctgaagccattgtgattttatgcagaatgctaggcagtcctttcctctgtcagaaagaacaatttatatgtaataataagtctcattatgcttggaagcttattttccttgttgcacaattgaaccaacctgctcatgaaagctccatgaccctttacctagatgacagtcaaatatagttaggcaaataagtttccttttggtttgtcattgagtaaacctttgcaacctgtaatgtttagcaagtgactacttctgtatagtaattttccttttagttgagaatttattcaagcaccaaacataaaaaagaataaaagtgaaataagctttcttttgcataagggactttctataatttgctactttttatcttcttttttttttttttgaggtggagttttgctcttgtcgcccaggctggagtgcagtggcgtgatctcggctcactgcaacctccacctcccaggttcaagcgattttcccacttcagcctcccgataagctgagattacaggtgcgtaccaccatgcctggctaattttttttttttttttttagatggagtcttgctctatcgcccaggctggagtgcagtggcgcgatcttgactcactgcaagctctgcctcccgggttcacgccattgtcctgcctcagcctctggagtagctgggactacaggtgcccgccaccatgcccagctagttgtttttttttttttttttttagtggagacggtgtttcaccgtgttagccaggatgattttgatctcctgaccttgtgatccactcgccttggcctcccaaagtgctgggattacaggcgtgagccaccgcgcccggccatgcctggctaatttttatatttttattttattttatttttgaagcagagtctcgctctgttactcaggctggagtgcagtgacccaatctcagttcactgcaacctctgcctcccgggttcaagtgattgttcagcctcagcctcccaagtagctgggattacaggcatgtgccaccatgccagactaatttttttttatttttagtagagacagtgtttcaccatgttagccaggctgatcttgaactcctgatctcaggtgatccacctgccttggcctcccaaagtgttgggattacaggtgtgagtcactgcgccggcctaatttttgtatttttagtagagatgggatttcaccatgttggccagcctagcctcaaactcctgacttcaggtgattggcccaccttggcctcccaaagtgctgggattacaggcgtgagccacggtgcctggtttagtatgcattcttgactggggaaaattgcagtggtaagtgtgcactatatagatatattgataatgatcatgatggctttggattatcttttgaaattggaggatttcaaaaaatagatttgcatatggaaatgtgcatttttgttggttttttgagatggagtcttgcttcattgcctaggctggagtgcagtggtgcactcagggctcactgcagcctcaatcttctggtctcaagcagtcctcccatctcagccttccaagtagctgagactacaggtgcatgccatcatgcctagctagttttaaactttttggagagatggggtcttcctctgtttcctaggctggccttgaactcctgggctcaagcagttctgtcttggcctcccaaagtgttgggattacaggcgtgagccaccacacctggccaaaacatgaatgtttgtatgaatctcagctatcactgtgtaaaagtatttgagatccaaatgactgctgtatttctcccctctctctctctcttctttctttgctaagttgatgatggttattttttagcattgtctttatgtctgactctaacagctcctttttccgttcttatatttagctttttttatgtgtgttttaaaattttttttttgtttttgagacggagtctcactctgtcatccaggctggagtgcagtggtgtgatctcggctcactgcaagctccgcctcctgaattcatgccagtctcctgcctcagcctcccgagtagctgagactacaggcgcccgccaccatgcctggctaattattttgtatttttagtagagacggggtttcactgtgttagccaggatggtctcgatctcctgacttcgggatctgccaccctcggcctcccaaagtgctgggattataggcgtgagtccacatgcccggcccttaaatttttaaattttattttaatagagacagggtcttgccatgttgcccaggctggtctcaaacacctgagctcaagcgatccacctgcctcggcctcccaaagtgctggggttacaagcatgagccatcacacctggcctttattttttacttctgctttgggctagaaaactgaacaccctgggccaggtgcggtggctcacgcctgtaatcgcagcactttgggaggccgaggtgggcggatcacgaggtcaggagatcgagaccagcctggctaacatggtgagacccatctctactaaaaatacaaaaaattagccgggcatggtggcatgcacctgtaatcccagctactcgggaggctgaggcaggagaatcgcttgaacccgggaggcggaggttgcagtgagcggagatcacgccattgcactccagcctgggcaacagagcgagactctgtctcaaaaaaaaaaaaaaaaactagacaccctgcttctcagaataggggatagggaatttggaaacaaaacaaaaactagacacccaaacttacaaaaattgttcaacatagaaaacttcttggctcaggtgaggcccctattggtaaaaggcatgggctatgttagaaggtctttggtatttgggctgctcagaggcctttttcagttcccattcatgccagtctttgaatagctgagatattagaacaactgagctctagactggaaagttgttagtataatatactatctacgaaaagaacctgagctgttaaaataccagaaaataaactagagctcatgatttatttctggaatcaatcagacaatgaacagcaattttttattgcctgttaagccatagtagcagtgagaaactgaaacaagcaaaaacacttagtgttgtaagaatgtataaaagcatctcaaggtaagaaattctgtgttactactgacaactaccatttaagttgaggaacctctagataaatcagaccgcagaatttgagaattaaactcaaattctgtaatgtaaagttcacttctaaaaatgattatgatttggacttattagagataatgtgcttttttcatattctgcaatttaatatgccactatttatgtacccaatgccttttggtaaaattttccataaaattgtatttgggtcaccaagcatatgccaacgacatttacgaataaagtggtaggtataaagggaaagaaaacacaggtttgaaaatcagtcttatgtgatcggacgatatgtaatgtacagttccttttaaaaagcattatcgccgggcgcggtggctcacgcctgtaatcccagcactttgggaggccgaggcgggcggatcacgaggtcaggagatcgagaccatcctggctaacacgatgaaaccccgtctctactaaaaatacaaaaaattagccgggcgaggtggcgggcgcctgtagtcccagctacttgggaggctgaggcaggagaatggcgtgaaccctggaggcggagcttgcagtgagccgagattgcgccactgcactccagcctggacgacagcgagactccgtctcaaaaaaaaaaaaaaaaaaaaggcattatgaggttgggtgtggtggctcatgcctgtaatcccagcactttgggaggctgaggtgggtggagcacctgaggtcaggtgttcgagaccagcctggacaacttggcaaaaccctgccatttctactaaaaataaaaataaaaaaattagccaggcgtggtagcgggcacctgtaaccccagctactcaggagtctgaggcaggagaattgcttgaacccgggaggcggaggttgcagggagccgacatcacgccactgcactccatcctgggggacagggtaagactccatctcaaaaaaaaacctgaacaaacaaagcctaaacattatgagatattcacattactctcatcagggaataattgggactggaaaaggaaagttctgctgtctcttataaatgtgtctctgcaaaatattcttcacccagcttccaggcaattgtgtcttttttttttttcccagaggagtctcactctgtggcccaggctggagggcagtggtgcgatcttggctcactgcaacctctgcctcctgcattcaagccatttttgtgccacagcctcccaagtagctgggattacaggcctgcgccaccatgcctggctaatttttgtattatttatttattttctttgagacggagtctcgctcttttgccaggctggagtgcagtggcgcgatcctgagtcactgcaacctccacctcccaggttcaagcgattctcctgcttcagcctgccaagtagctgggactacaggtgtgccatcacgcccagctaatttttgtatttttagtagagatgggtttccccatgttggccagggtggtctcaatctctttttttttttttttttgtgacggagtctcactctgtcacccaggctggagtgcagtggtgcgatctctgctcactgcaagctccgtctcccgggttcacaccattctgcctcagcctcccaagtagctgggactacaggcccccgccatcacgcctggctaattttttgtacatttagtagagacggagtttcaccgtgttagccaggatggtctcgatctcctgacctcgtgatccacccgcctcggcctcccaaagtgctgggattacaggcgtgcgccaccatgcccggcagtctcaatctcttaacctcgtaatttcccacctcggccttccaaagtgctgggattacaggcatgagccaccatgcccagcctaatttttgtatttttagtagagatggggtttcatcatgttggccaggctggtcttgaactccgggtctcaggtggtctgcccgcctcggcctcccaaagtgttgggattacaggccatgagccaccatgtctggccgcttgtgtcttttgaagactctactgcatgctgcctcaaaccatgacgtcatgccttcagtcttccctacttgtaaattataggtttccccaaaacttgagcagtatgtcttcagtttcagaaaaaagacctaccctactaaattattattattttttattttccagagtttattaaccacttaacctctcagaactgaacaaagacaacattgttcctggaacgccctctttttaaaaaaggtacatataatttggctttataatttctggcctgttgataatcagtggtacttttgaattctttaatgagttgtgtggagaatgatttttacttctggctataatattagagaaacaaattttatgcagtttgaatttcatctttactcttgatttaattagaaagtaagtacaggaaaagttattggcaagaatgtaaagcctatgttctttaaatatagagacatgagaattgatgactgaagctgtcattaaacatgactggctcaataagcttcttggtcatagtatcttttgtagtttgctttttttaaaaaaaccctttgatttctcagattgtttatgttaaacatgattttcaaactcatagaacgaatttagcattgttttctattgtgagatagggttacgaatcaagcttcgttgaccactagcagcttgtgaacattcagataaaaaaggagttttctaagagtgttcaagattttctggtcttttgtcagggcaatgcaaaatacactatgtgggttaatactgcttcctgcttttaacactttccctctagaagctgaaagcacattgctgtaccatatctctgaggtagtaattagtagacaagttaacctactttgaggatgaggaaatggaagcataaggaaattattgaagttgtacaaagctcagtgaatggttttaaactcaccacactggatttgtataatgcttttcttttctttctttctgaaacggagtttcgctcttgttgcccaggttggagtgcaatggcgccatgttggctcacctcggcctcctgggttcaagcagttctcctgcctcagcctcccaagtagctgggattacaggcgtgtgccaccacacctggctaattttgtatttttagtagagacagggtttcaccgtgttggtcaggctggtctcgaactcctgacatgaggtgatccacccaccttggcctcccaaagtgttgggattacaggcgtgagccactgtgcccggcctaatgcttttctttttaaagaattgtattatcggctgggcgcagtggctcacgcctgtaatcccagcactttgggaggccaaggtgggcggatcaagaggtcaggagatcgagaccctcctggctaacacggtgaaaccccgtctttactaaaaatacaaaaaacattagccaggtgttggggggcgggagaatggcgtgaacccgggaggcagagcttgcagtgagccgagattgtttcactgcactctagcctgggcaacacagcgagactccatctcaaaaaaaaaaaaaatgtattatcatgcctcaggattcctttagtgttttgactcagtgattgctacaagtgaggctttgtcaaatatcctattataaagtgttttggggaaactgaggcacaggggagtgggttgccaagagctgggagtggaattgaaagctacatctcagaagtttgatctgatttaacattgttggttgctacttagcagcaagggtggtttcttagaaactgagtcttggcactggtctgttttgcatgaagatggtggtaaatgcagtcgtgtttctaggtagatggcacatggttacagattacagtttcccttttctgaaaggaaaagcctgttaaccattatgttgaaccaagccccttcatagtcaagaaaatatcacacagaactacttttaaaagtctccagcagatcatgaacaggtattcatttttattgtgttaaaagttttctatgtttgtataagtttagattaaaaactgtttacaaatgtatgtgcttgaattttgttatttttgagaatgtctcctagagaaggagagacggaagcttgataaagttttaaaactagaaaagaaaataaggcttatagttttttaggctatagaggtaaattgtttttcactttagcatggtgtgatgggttttctaggatgaaaataatgaaaatctcttttaggaagtgtttctttaagcagaccatctgacctcccaactgttacatttgtgtggaaagaaagtcctccattgcccatggcattgggccaagtgtgagacagggaccacattcagtctcacttgtattgcaagtgcaaagatcctgaacagcctgggttgtttccaggcattatttttggttaattttactgtcttgcaagtgagtgtgcctcctcagggctaatctctgtctttgtcttgagcatcaggtacttagtgatttgtttctttttttttttttttttaaagtagtttggtcatatttcttttaaaaaacgttttattattgggtgatttagtatatataggcctgctattggacattatttgcttgacattgaccttaaagcggtcattttggaaatgatcctataagacgatagtgattgacatgcttctgtactagcgtctgccctgcctgcaggtatttggataatgtttggagtcaatgaattactattttggggggctgggagggagaagtaatggtggagagtgagtttactttcagaaaacattcaaccatattgcagcaagaaagatgtgtcagaaaagaatcttagaaataactggtataggctgggtgcggtggctcacgcttgtaatcccagcacttcgggaggccgaggcaggcggatcacaaggtcaggagatagagaccacggtgaaaccccgtctctactaaaaatacaaaaaaaaaattagccgggcgtggtggcgggcacctgtagtcccagctacttggagaggctgaggcaggagaatggtgtgaacctggcaggcggaacttgcagtgagctgagatcgtgccactgcactccagcctgggcaacagagcgagactccgtctcaataaaaataaataaataaataactggtataaggaatgatgtgggtattttaggtgtatttaaaggctattgaaaaggactttattttgtagaaaaagtggtttattccttgatgttttttaattgaccaagtttctctgggagtggagcctctcaacaaactaaagagaacagaataatagatttacatgtgattgctgaaagatgtcgtcttgtgtctttgaggaagagtttaacacacagatcctttccagcatttaagaatgtgcaatctgccatttatgggttcacatgtaatagatgcttaataagtttttgtagactattgagtgaatatattttagaattgctattgctttataacagcgaggcacaggagtgctcctttgtatctgtatatccatcttacatcagatttaccaaaggacttgcaaggggagacatttagtgaaatgtttgtgacgatctgaaaaggaggcttctccagaattgggatgacttctttccttctttttttttttttttttcccagacacatcttgtttggaaatatcacttattatgaaggagactgatatgttgattaaacaaaagtatagctactgcattataagttgtgttaatccggtttaaaaattacttattaaaaatgtttttctggctgggcacggtggctcatgtctataatcccagcactttgttgaggccaagacaggcggatcacttgaggccaggagttaaagaccagcctgaccaacatggtgaaaccccatttctactaaaaacacaaaataattagccaggtgtggtggtacacacctgtagttcccgctactcgggaggctgacacaggagaatcacttgaacctgggaggcagaggttacggtgagccaagatcgtgccactgcactccaacctggacgacagagtgagactgtctccagaaaaaaaatgtttttccataattgcttaagtatttcatagtacaaagatttaacagtctgtaagttgaaagtggataagactaaccatgtattagtagcacaagataattaaaagactaagcacgattgcagatagttctgtaaaccatttctagaagggtctgccttcttgtatattaaatcactcggactgtgctcagtatggtctagtcttggtaggttcactgctgagtgctgaatacacattttgtgaccactttttagtacatcatgtataatttaaaaaaaactttcgtagcgctcatgtgcccagattctccttcaccacaacccatagaaactatttggcacttgtaaaacggtaactgccagccaaggcaagattctgtttttatgagaagatttttgtgttaccaagccaatcttaagaaccaggaggacatggaattaaggaatcttttaaaagaaacacctataactctatcattttgcagcttgtattatggtgcttatgtatgctatgtaaaattagggcttgagcctaagatgagtatgttttgttgatctggtgtctaaagcccttcaaatagggaaagaaccaggagatgaaaggtcctcatctgtgtgggaggcagaaaggcaggaaaatggcagcacaacacaattcacagtaagaggtgttttccagcaccagcgagatctgaagaatctttgcgtttcaaacttctcaacctaattttactgtgtataaaatagtgtttgtctctaagaagactctaacaaaacattttgatctctcaagtccttaatttacctggtggaaaacaatccttaaagacaggtttaaaggaaaagacttatttgcatttaaggacttagtcttcaggacagtactgttgagcaacaggtttagaatttacacagaagttctatttccaaagttccacagttccttgaaggctgctatgaactatatctatatcagtaatgaaaaacttaatttgttccttgagttatgtgggcaaatgatatattttcccccattcatcactgtgatgtctgttccggcttctctttgggagaggagcatctgtttgggtgctaaaacattagcatcaggccaggcgcagtggctcatgcctgtaatcctagcacttagggaggctgaggcaggaggatcacttgagatcaggagttcaagatcagcctggccagcatggtgaaacgctgtctctactaaaaatacaaaattagccgggtgtggtggtacacgcctgtaatcctaagtactcgggagactaaggcaggaaaatcgcttgaacccagaaggcggagtttgcagtgagcggagatcacaccactgcactccaccctaggcaacagagcgagactgtctcaaaaaaaaaaaaaaaattagcatctattttttagggcctttcgagatagaaaggggattttcttttcctgtctaagaatataagctacttgttacattagtaagattgtattgtgtgggttagtatatgtgtgcttgtaacagtatccctggctcctctatccactaaatatcagtaggttccccattctgcacactggttgtgacaaccaaaaaatgtctccagacattggcagatgtctcctgggggaacaaaattgctcccttttgagaatcactgccttagatgctctgttcaggcttaaataagacacataaaaattttaaactagcaggtgactaataatttgtgagtattgtttgttgcattttcatatttatcatgttggaaatttaaatttacctagtcttatttggagagtttaactttttttttttggtttgttttgttttgaactacatatttcaaccaactgttagatgttaagtcctttaagtgaatttaagggtaacatttttgaggcagtcttaatttaaaaagcctattcctttctcagcttctagaaaacttacatatttatgactgacttgagcagagtgcggtgcctcacacttgtaatcccaggactttgggaggctgaagtgggcagatcacctgaggtcaggagtttgagagcagcctggccaacctggcgaaatgctgtctctgctaaaaatacaaaaactagccaggcatggtggctcatgcctgtaatcctagctacttgggagactgaggcaggaaaattgcttgagcccaggaggcagaggttgcagtgagctaagtttgcaacactgcactccagcctgggcgacaaagctctgtctcggaaaaaaaaaaaaaaaattaaaaatttatcactgacttgaaatcctggcagtcagcctgctttagagaacattaaccaaaaatcccttggtccacaccctttctaaatttaggcattcattcagagtcttaaactctaagagccactcaggacacagttgggttgctctttctgggatgggggtagattctggagcagatactttactcctagctcattttttgaccttgagacctgtggttggtgttgtgaagtcgtacatacacaagtgacttttttgttttaaaaagtgctctcaagatagtttacaaaaagcaggaaaaggaggagtgagtgaataaatgaagagaggggaagagaggaggaaaaaagtgtttctattttagcagctgacggaaaaaaaacccaatgaaataaggtcatagctgacttctgaatggttctggacttgtttcttgacactggcgacttgtcttctaagaccattatgtagatcttcaatggaacgcctctgttattttgttctgattctgaaagtaaaaaggaacaactgcactcttggggaattttgttgaataaggtaatacttatgcctctgctatccagagtcacatttcgcttgagtttcttttgagttttgcagtcctttttgctctcagtaagagagaatgtgttaggactcctcaagtagcttaattgctctggtcattcatctctttcttgaggaccagctttaaaaatcattttgatacttaaaaaaaattaaagtaactgtttctttataatagaacttctaattagttggtttgctggtttctgcattggttggctatttcctgagagacctgtcatttctgttctttgttgccactggttatttttaagtactttgactcattaaaaacattttcagcttttaaaggatggccatgaaaatgaacacaactgtccttatttttgtctcgtgaagaaatttaatgtatttagaagtaatgccttcattattctcttaatttacaatatgaagtaaacaagctccagtgctcccccacccaaccacaccagtaaaattgccagtctaaaatccattcctgtcttcttcatctccacttttgcttttaatagtataaattctctagtatggtctttgttactcacatcacttctcaggatctgtgagcctgggtagggttgtgatagtttccttgtttgggttctataattaaatgagacctcaaacaagccttttaggaaaacaatacatctctcatcaccataaagaaaaagaaacagcagaagtatcctaccttccttctgtcaacttaaggccctaaggttgtcagtctgagccttggtccttaagaggaagcagtgttcacattcacctgttcctggtatgataaacctagtttgctttcagtttcttgtaattttgagaccagaaagaaaccttactgtgccccaattactatggaaacctctccatactttcaaatttgcatttttgaatgtaagctatagtttgcaattcttaatactcaccaataaatattataccctactgattctctttgtataatgaatatgcagagcacacaggtattgtaaatcacttaaaaaacactgtgggaaagtcacaaggccaagaaacttactgtataccaaggagaaacatatttcgaataaatcaacatagctacatgctaaatggagctattttcataagtcagtaggtgacaccattttgactgaatattggcaattacatatctcctctataatttacctttttattttctttcccttacaacttttaggtagaactttagacttcatagcactgaattaacctgcactgaaagctgtttacctgcatttgttcacttttgttgaaagtgaccatgtctcaagttcaagtgcaagttcagaacccatctgctgctctctcagggagccaaatactgaacaagaaccagtctcttctctcacagcctttgatgagtattccttctactactagctctctgccctctgaaaatgcaggtagacccattcaaaactctgctttaccctctgcatctattacatccaccagtgcagctgcaggtaagcatatgaatccaagtgtcttctatttcaaatgttttcttaccctgttttctgatctgataggttgcagatttagggagctctcacatttaccttcaaaaagcaaaagaaagtatcaccacccacacttctttatcccagatatagaacactggttgtgtaaggggttgacaggggcctcagttgacagacgattgtaggttgtgagaaagagaattgaaagctgaaaactactcacactataaagcctcatctgttaaagagcggtggctggcagaaagaattgagcagtaaataccaccttggatattcatcgttgtatgggataattctgcatttaaaattatttcccagaacaagccaggtgccgtggctcacgcctgtaatcccagcactttgggaggttgaggcaggtggatcagcagaggtcaggagtttgagaccagcctggccaacatggtgaaaccctgcctctacaaaaaatacacaaactagctgggcttggtgatgcacgcccataacagctactcaggaggctgaggcaggataattgcctgaaccctggaggtggaggttgcagtgagctgagactgtgccacttcactccagcctgggcaagagggagacactgtctcaaaaaaagaaaaaataggccgggcgcggtggctcacgcctgtaatcccagcactttgggaggccaaggcgggcagatcacgaggtcatgagttcgagaccagcctggccaatatggtgagactccgtctctactaaaaatacaaaaaatagctgggcatggtggtgcgtgcctgtagtcccagctattcgggaggctgatatagaagaatcacttgaacccaggaggcagaggttgtagtgagctgagatcatggcactgcactccagcctgggcaacaaggcaagactccgtctcaaaaataaataaaaaataaataaataaaattcccacaactgacgaagagctcttaaatctacataagccttctttttgaatgtccgtaagattttatcccaagcaagggggcagccagatttactagaaagcaaaaaagtacattgacatttatttatttttatttttgttttgaacaagtaagtttaagtctggaaggttccagaagtagtttagaaatcataatgaggatcaattagaaatggaataaagaagcagagttttttttctcttctttcctttcttatctctcgtttgtttcacggggtctctattgcctaggctggagtacggtagtgtgagattatggttcactgcagcatcaacctcctgggctcaagtggatcctcctgcctcagcctcctgaatagctggattataggtgtgagctacaatgcccaaatttattttcttgttaaaattttctgcgtcatggccaggcgtggtggttcacacctgtaatcccagtactttgggaggccgagtggggagattgcttgagcccaggagttggagaccagcctgggcaacatggtgaaatcccatctatacaaaaaaaaaaatacaaaaattggctgagctgtggtcccagctactccagaggctgaggcaggagggtcacttgagtccaggaggtcgaggctgccatgagctgtaattataccactgtattccatccagcctgggagacagagcgagaccctgtctcaaaagaaaaaaagtctccttcttggctggcaaggtggttcacacctgtaatttcagtgttttgggatgcctatttatttatttatgagacagagtctcactttgttgcttaggctggagtgcagtggtgtgatcttggctcactgcaacctctggctcctgggttcaagcgattctcctgcctcagcctcccgagtagctgggattacaggtgcctgccactacgctcggctgttttgtatttttagtagagatggggtttcactgtgttgcccaggctcatctccaactcctgatctcaagtgatcagcttgccttggcctcccaaattgctggaattacaggtgtgagtcattgtgccaggctgcgaggccaatttaaaaattagctgggcttgatggtgtgcacctgttgtcccagctacttgggaggctgaggcaggaggattgcttgagcccagaagtttgaggctgcaatgaactgtgatcgtgctgtcttactccagcctgggcaacagactgagactgactcaaaacaaaaagtatagaaacattcaaatctgataattaggaaaatgaactaaaggtaccttgccggttgcagtggctcatgcccataatcccagcacttgggaggccaaggcaggtggatcacctgaggtctggagtttgagaccagcctggccaacatggtgaaaccctgtctctattaaaaatacaaaaattagccaggtgtagcggtgtgtgcctatattcccagctacttgggagggtgaggcaggaaaatcgcttgaacctgggaggcagaggctgcagcaagccaagatcatgtcaccgcactccagtctgggcaacagagcgagattccatctcaaaaaaaaaaaaaaaaaaaaaaaggtttaaacacttgaaaaatacctaaaaatattatagacaagaaactaaggctaaagaaagaaaacctaaaaccaatattcttatgaataggagacagggtctgactagaaaaaaaaagggagtggggataataaataaaaacaatattctgcttcccaacaccctccctgcaacatggcaagaccagtgaaataaatggggtgtcagtgtcaatttttttttttttttgaaatggagtctcgctctgtcgccgggctagagtgcagtggcacaatcttggctcactgcaacttcctcctcccgggttcaagcaattctcctgcctcagcctcctgagtagctgggactataggcacacgccaccatgcccagctaatttttgtatttttagtagagatggggtttcaccatgttggccaggatggtttcaatctcttgacctcgtgatccgcctaccttggcctcctaaagtgctgggattataggcgtgagccaccacatccagcctagtatgtgggtatttctataccagagttaccttataacaaagtcttttcatccccttccttgtgcctgtttcctttcagtttcctcctttgtcttctcatttcctttactttataaatctgttttttttttttttgagacggagtctcgctctgtcgcccaggctggagtgcagtggcatggtctcggctcactgcaagctctgcctcccgggttcacgccattctcctgcctcagtctcctgagtagctgggactacaggcgcccgccaccatgcccggctaatttttttggtatttttagtagagatggggtttcaccttgttagccaggatggttttgatcttctgacctcgtgatccgcctgcctcggcctcccaaagtgttgggattacaggcgtgagccaccatgtctggcctataaatctgttcttagagtgtttgcttctcccactcagctgcgtggcatcttccatgccacccccacaattccttggactggttcaccagatagcattcttgattttttgtagtcctggagagatgttattttccccatatttgccatgtgagactctcttaaaaggaaaaggcacagactgtttccgtcctctgggatttattgctttttcttctaatgaattctggtgtccaaatcctattgactttgtaaaactcctgcccaccaacatcattttattttatttatataattgttagaaatagataaggtctgaggatggcagcctttggagaaaagactagaggatgcccaggaatgagagtttcactgtatggaagatgacaagtgttgtttgagagatggtagtggcatgttgagtttagcgaaataatgggcggggtacagctggcggctgtttcagtaaccagtgtctgctcagaagaccttgtattccagttggttttaatagcagtgattcatctgatttcaaatcttgcttgcctgccatgggttagttactcccctgacttcactctcttttgaagacacaccctctcctagattacctggcttcaactggttcagaaaagaccctagttgcgtcttctctgggagtgtactcctggaatgatttgcagttttgtatcatggctgcctacatttgtagaccttccatttgtttttcctctattttcatatccctaggagaatagtagtcttatatactgctagttgacttcagtgctcttaacgttttcacttccttctcatgtggcgaaccccatagagaaaaatcccagttgtgtcttgtgaatgagttagtttgtttcagcaagatccagcttgagtataggcttttgtgtgagcaaggtccagctcactgtaaggtaaatattgtccatactgcttgtgcatttataacccacctggaatgttctctattttttatactcttgaaagtggtgctgtaattcaaaatacatgttttcaaactgatgaggttgtcttaaacaaaaactatacttagacaagattatagatttttgaagttgcttcttttttcatccttgccaatgggtcaaagaaaatatgtgttgctttttggaatatttgggttttagtttttttagagtctttctttgccgcctaggctggagtgagtggtgtgatcatgtctcactgcagcctcgacctcccaggcttaagcaatcctcccaccttggcctcctgagtagctgggacctcaggtgcatgccaccacgcccagctagttttttttttttttaattctttgtggagatgaagtctcactatgttgcccaggcttgttttgagttgctgggctcaaacaatctgcctgccttggcctcccaaaatgctgggattacaggtgttagccaccccgcctggccatattttgcttttaaaactccaaatagtgtatggttgtttgggattctgaacagagacaattctcaagcacctgtgattgattgcccgtaagttttccagctttgggccacctcttgtctgcagcttacttctggctcctctcctgcttgtttgcacaaggaccttagggcagggagaagaggtgatgggaaaacagttttttcacttgttagcaatctgggcaaaaggtttgaagatgcaattgcctggctaattttgcattttagtagagacggggtttcaccatgtagtctcaaagtgagtattttgtattgtctttggtttcagttatccttgtcattccccttatcttagagaatgaaagtctgactataattttaaaatttgctaatcattattcaagaattcagtctttttagaacatggaaaggaaaaaaataattcagtctttgaaacttgtttgttatctgtattaacagcacattctggaacttaattcttgcatatctggagttaacttttttcccaaccatctaaggacacggagatacggagttgtcttttgcagctgtagcgtaagatgatatagtatgagagataaggaattgacgctgtctgtttctgatcctaaccttgcagcaaagataatataaataaggatgagttatttatctcattttgcctcattttccttcacacgcaaacctcaagccttgaataaaatcaagtgtttcttttcatttgactgaaagtaacataaggcacaaacatgaatagtcaccgtagcataatacggttcagttgcctttgaagtcagacacatctaggtttgagtctcagcttgttactagctgtgtgatcttgtgcaagttactacttttttgttgtcgttgtttcctcatgtgtaaaacagggataatacccaccaaataggtttattgtgagaattaaatgagagcatatatgttaacctgtggagcacaatgcctagtaaatgcttgagaaatggtagctgtaattctggctacttgggtagctgaggcaggattaagcatttaattaagcatttaagaaaaacagtatttaccactcacacaaaactagcttaaaaatgttgttttaaaacataattctatttgaaatgtgtctttatagacacatttaggcaactagggactgggagcagtggctcatgcttgtattcacagcactttggaaggccaaggccgacagatcacttgaggtcaggagtttgagaccagactggccaacatggtgaaaccctgtatctaccaagaaacacaaaaattagctggatgtggtggtgcgcacctgtagtcccagctactcaggaggctgaggcaggagaatcacctgaacctgggaggtgggggctgtgatgagctgagatggcaccactgcattccagcctgggtgacagagtgagaccctttatcaaaaaataattaattaaaataaaaatagaagtcagtcatttttctataactgttgtatttcctctccaggatttttttgcagaccttaacttcgggattccctttattaactttttattatattttggctaatgcactttctcacttgaacttttaataatttaggtagtttggctgtgtgttcatctctaaccacatatattctttttacccacaagttgttcaaagaggagaagttgttctctcttgggtgatttagattatttgaaaaatcaagagatgtggtatgcttttggttctatcaaaaccaagattctagccttgctacaccaacagaatgcagcagagtggcaggtagcaccggatggggaaagtcctagagaaaggcaagacggttcacgagaataactttgtgtgtttttttttttttagctttttccccttcagcatttatccatgagacaatcaccaagatgacccagggattgtactgcgttgcaggcttctgccatttgaccttcctgcctgccagggttttgagttcatgctgttgtttgtacttaaatgagtagcctgatggactgcagaacatataataaaggagacccctgatgtcctgatgtgtgaagtgtcaaggggggtaaaggattatttatttatttatttatttatttttgagatggagtctcattctgtggcccaggctggagtgcagtggcgcgatctgctgggattacaggcatgagccaccgcgcccggcttttttttattttgaaatggagtctctgttgcccatactggagtgcagtggtgcaatcttggctcactgcaacctctgcctcccgggttcaagtgattctcctgcctcagctacccaagtagctggaattacaggtgcatgccaccacgcctggctaatttttgcatttttagtagagatggggtttcactatgtaggccaggctggtctcgaactcctgacctcaagtgatctgcctgccttggcctcccaaagtgctaggattacaggcatgagccactgcacctggccaataaaggattctttgtttttttcctttagtggaagccgtgcactgagggaatcctaaaagtaagacctacaagaaaaatcagctatgaaggcaagttgcctcaccccttaaggcaccaaatttaaatgacctagacatactgaaatccaggtttcccttgtaaattatttgtaagtgagataaagtgatattcagtgattacatcagaagaataaaagcttcaattaattttttctttttttgagacggagttttactctgtcatcacccaggctggagtgccatagcgtgttctcggctcactgcaaccgcaacctcccgggttcaagtgattctcttgcctcagcctcctgagtagctgggattacagacacgtactaccacacgtggctaatttttgtatttttagtagaggcagggtctcaccatgttggccaggcgggtcttgaactcctgacctcaggtgatctgcccgcctctgcctcccaaagtgctgggattacagttgtgagccaccacacccggccgcttcaattgatttgttaaattccaaagtagtgaatctcaaatctttggggtgcatcagaattactttgagaacttaataaaaatagaaacgctcatgccttaaatcctatcactttggaaggctgaggcgagaggatcactggagcccaggagtttaagaccagcctaggcaacatagggagaccctgcctccgcaaaaattaaaaaattacccaggtatgggccgggcatggtggctcacgcctgtaatcccagcactttgagagtccaaggcgggcagatcacaaggtcaagagaccaagaccatcctggccaacatggtgaaaccccatccctactaaaaattcaaaaattagctgggcgtggtggtgcatgcctgtagtcccagctactcaggaggctgaggcaggagaatcgcttgaacctgggaggcggaggttgcagtgagctgagatcatgccactacactccagcctggcgacagagcaagactgtctcaaaaaaataaaaaaaaaaaattagccaagtatggtggtgtgtgcctgtagtcccagctactcaggaggttgaggtgggaggattatttcaacccaggaggctgcagtgagctatgattgtgccatttgagctccagcctggacagcagagcaagaccccatttcaaaaactgaaaaaaagggtggttatgttttcaaacaagagcccacaaacacattgcagcatcaaaacaaacattgtcttaatttgtgtgaagtactgctgtgtgtttaaatcaagtttgcaaaatatctttcatgagaagtaattggaagagaattttgaggctggacgtggtgggtcatgcctgtaatcccagcactttgggagactgaggcaggtggatcacttgaggtcaggagttcgagaccagcctggccaacatggtgaaaccctgtctctactaaaagtacagaaattagccgggcatggtggcaggtgcctgtaatcccagctactcgggagactgaggcaggagaatttcttgaacccaggaggtggaggttgcattgagccaagatcacaccactgcactctaacctggggacagagtgagactgtgtctcttaaaaaaaaaaaaaatttcagtgcatacacacacaatctcttttttttgttgttgtttataaaaaacaacaaaaaaggataagaaggggatgacaggatgaattatcaagataagaccaggcctcttaaaccatgaccatagaaagtgttcaaggttcaagtgacatattacagtcaatgtcaggtttcatgaatttgagagctcacacttttcatttctaggaatttacagtactgctgacacttggaaatcagcaatggggagctgagtgaactggtattaaaaaggtcaaacacacagctgctgctaaagctttggagggaacaaaatttcctaagcccatagtcagcccttttggtagcgaaggaaggaatccaggtcttatgcatgggccaaacaggtacctttcaaaagtgtgtctagaggtaccatgtagtatgtatatgaatggtttcttaacttgttgattttgaaagcacagattctacactaccagtgacaaatgcttattttttaggaatccttaacctcattgtaaagcagtggtttccaatctatgatgccttaacgcctgacaatctggaaaggcggtcataggaaggatggcgggtgaccagataatttcaaagatttccgaagtttaatgaaaatatatttttgataagagtgtatagattagcaagaatataagtttaatttagagtcacatcaagtcagtgtggtaatattgattgtaattttgttggtcagaagtgcttattgccagttgtatgtctcttagttattaaaaagaatgagaaaaatgtaaatattacttaaatacaagccagcaggtagtatctcctcagacaaggagcccattcagggagcatactaatcaagaaggcatggctggtgaagggttggggatcagtgacctggaggctgtgtcattaatggctgttttagcagagaccccctcacatgcatgaagtcatcccaggtcttcgtatgtaggaaggaatctgggaagttaccagtcacatctttcttgttacttttgatttctttgcagtatactttcttcatgtttattctctattgcagacaaattctgtggatcagagctgctcttaaaatgattcagactgtacttaaaatgcaattatatgaattttgtaaaaaatataattctaatgcaaggaagagagagatctgtaattcatgtggccctctgtgcaaaccccaaagatattcttatagatttgattcatgcattaaatttagttgaaccagttatagtacagaatcaggtcttttttatttctctctatatacatcctaaagaggcattttaaagtggatttttatgtgcatttagattttgccatttctagtgttctgtttttgatatgaaagtgttgtttttaaatattgtgcactgacactaatctttccaggctggttttctttttaaatggtttttaaaggtttatggattggatgaactgaaagaaaaaaaaattggaaaatgaatagcatgtattttctgaagttgataattttgagataacttgttgtgtatgaaaatggaactcattttcgtagcaagtatgaccacaggtcaaattcattagaaatgtcaagaatggaaatacctgaatattttgtgggccttgtgtgacttctgtgaagagaattgggttgccaccttctcactgatttttcacctttaagttgcacatcatgttgtattgtaactctttgagtgtgctttgtgttttttgaactcctctggggcaggaattgtgtttctttttttttttaagacagagttttgctcttgtttcctcatctggagtacagtgacgcaatctcgactcactgcaacctctgcttcctgggttcaggcgattctcctgcctcagcctcctgagtagatgggattacaggcatgcgccaccatgcctggctaattttttgtatttttagtagaaacggggtttcaccgtgttagccaggctggtctcgaactcctgacctcaggtgatccacccgcctcggccttccaaagtgctgggattacaggtgtgagccaccctcactgcaaggtccgcctcccaggttcacaccattcttctgcctcagcctcctgagtagctgggactgcaggcacccgccaccatgcctggctaattttttgtattttttagtagagatagggtttcaccatgttagccaagatggtctcgataccctgaccttgtgatcctcctgccttggcctcccaaagtgctgggattacaggcgtgagccaccacgcctggccaggaattgtgtttcttaagcttagcacagtgctttgcatccagttagtaatgtaataaatgcatcgttcaatactgtgtacggacatacttctgagtgcaagccaataatcctgtaaatcagtacaaccaaggttatattgattaagtattctcaaacagtaaaacaatttggacatttacatgggattttttaatcgtgaaatttgatgtgttttggaacttatttctgacagctgtaccatatagctttcactgataatgtcttgggttaaattgtggctcctctggtaaccctcagagtagattttgtgctgtcgactgtgtataaatatctagaaatcacagcatattcttggatttccttgtctgatgcctagcagtgagccacccaggtccttttatgtaaagtatcatgaatccaattagcagaaagcatgctattacattttattttagtgagtatcattctcataccagaaaaaaacagttctttgtcgattctttcttgcagaaagcataacccctactgtagaactaaatgcactgtgcatgaaacttggaaaaaaaccaatgtataagcctgttgacccttactctcggatgcagtccacctataactacaacatgagaggaggtgcttatcccccgaggtatgtgtttttttttttttttttttgtaaaatacaggagaaaacgtgtctgatcttttacataaaccagtacctctagattgtggagggagtaatgatttggtttgggcctgccaagtgttgaagttggtcttaattactcttgtgcctttgtgcccctcccccgccttttcttttttttctttctttctttttttttttttttttttttttttgagacagagtcttgctctgtcacccaggctggagtgcagtggtgcagtctcggctcactgtatcctctgcctcctgggttcaagtgaggaggctgtctcagcctcccgaatagctgggattacaggcacctgccaccacgcctggctgatttttttttgtattttttagtagagacggggttttgccatgttggctggggtggtcttgaactccggacctcagatgatctgcccaccttggcctcccaaagtgctgggattacaggcgtgagccaccacacctggctgcgcctcttttttttttttttaattcattgagacagggtctccgtatgttgcccagactggtcttgaacttctgggctcaaggagtcctcctgtcttggcctcccgcagtgctaggattaaagtgtgagccaccacacccggccctttgtgcttctttttttttttttttttctgagacggagtctcgctctgttgcccaggctggagtgcagtggcatgatctcggctcactgcaagctctgcctcccgggttcatgctattctcctgcctcagcctcccaagtagctgggactacaggcgcctgccaccacacccggctaattttttgtatttttagtagagacggggtttcaccttgttagccaggatagtctcaatctcctgacctcatgatccgcccacctcggcctcccaaagtgctgggattacaggcatgagccaccacgcccggctcctttgtgcttctttaactactgctcttgggtagggcctgagcatatttcttgctggcagtgtggcttgtgccctcaagcagcctggctaaagataacccttgtaactgctttgtgtaactgaatcatatttaaacatgattcccatagcatcatgattcctgcaagacaatgattcccagcatttgtagattacctgattattgggtactttttgacttttgaacttgtgcgttttgtaaatagctttggtgcaataaaatattaattgaaacctgaaaatgccatggattaaaaatcttctgctggcagtaataagacattagtggaggccaggtgtggtggctcacgcctgtaatcccagctctttgggaggccaaggcaggcggatcatgaggtcaggagtttgagaccagcctggccaacatggtgaaaccctgtctctactaaaaatactaaaaatacaggcatggtggcaggtgcctgtaatcccagctactcgggaggctgaggcaggaaaatcgcttgaacccaggaagcggaggttgcagtgagccgagatcgcaccactgcactccagcctgggcaacaagagaaactccatctcacaaaaaaaaaaaaaaaaaaaaagacattagtggatagatgatgagcaaaatggaattcttcatttccctgctctctgttgggggatagtcattttaaaaatataagctatgaaatggataagaaactgggttctgctagggaaatggataagaaactgggttctgctaggtaggctacagcttattgggatttcttgaaatgagggtccttttgaaagacttgtgcattaaaattcccagcctcctattggagacatgcaaatttaaagctaaggtttgagaaggcagagcaagccaagtttttgtctcagccaaagcctaattcattttagattttgtcagtgcaggttagtgtgataaactcataatttataagccattgtattttgtgagatgtaagtttggattgctaaacactctttgcttatactgtgtagcaattctaatccagtttaagcttttatgaaatctctggatatattgatgaagagtgattagcatcaaacactaatgtgagtaggatcgtgatgaaggaaatacttgcatttgccagagagtgtataggtgacttatcaacttgagactgtaatttgcctaacctccttttatttctaggtacttttacccatttccagttccacctttactttatcaagtggaactttctgtgggaggacagcaatttaatggcaaaggaaagacaagacaggctgcgaaacacgatgctgctgccaaagcgttgaggatcctgcagaatgagcccctgccagagaggctggaggtgaggagttgagcccaggctccctgacgcttcgacagggtaggagggtagtggggagatgtcaccgcacattatcttttctaagaaggcacattgacagctgtccataatttttatttgaatgcctccaagattttatgctctgtagctttcttgctttttactccttttttccttttaaaatttcttaacaagaaagtcagttgccttctttttcagtctgtagcatggttttgagtgacatgatacggtgtgaacacgttagaaagtttgtgattcagttgagttgtgaagaacatgtatggatgaagtcttcggtgctcaagattatgcttgccagaatctactgtgatatatgggtaccaggttagaggattttctgaagctgttttttaccagccactcttgattatatagaagcgccagttaccttttgcctcataacagaccatcatagaatttagtgatggtttaaacatctccaggcatttattttgcttatgagtctgtgattgaggctgggcttggcaagggtgtagcttgtcttcgttccacacagctttggttgaagtggatctgcacggggccggaggatctgcttttaaggtggctcactcacgtggctggtaagttggtgcttgctgtcagctaggagctcagctgggggttctggccccaggacctcagttcatccctgggtgacctatggaaggattgcttatacttcttcatgttatggtggctggttgccaagagtaagcatcctagaagatgggaaatggaagcagctgccagtttcttaaggcttaggctcagaaatcacagcatcgtgtctgccatattctacaggtcaagcagtcatggagcccagattcaaaggaaggagatatagaatgtcacttagaaaaaaaaaattgaggtggctgggcgcagtggctcacgcctgtaatcccagcactttgggaggccaaggcgggtggatcatgaggtcaggagattgagaccatcctggctaagatggtgaaaccccatctctactaaaaatacaaaaaattcgccgggcgtggtggtgggcgcctgtagtcccagctattcgagaggctgaggcaggagaatggcatgaacccgggaggcggagcttgcggtgagccgagattgtgccactgcactccagcctcagggacagagcgagactctgtctcaaaaaaaaaaaaatggaggtaaaaattatataacctaaattgactattgtaagtgtacaattcagtggattttagtacgttcacaatatggagaatcccatttccagatgatgaaaggattgtcaaagaattaggggccatgttttaaaaccaccatgataggaaaaggattttaacatttttgtgactaaatagcaatataattcttagggaatcagtaactccatgccattgaggggtcaaagcattagtgaatatctttggccaggcagaatcttatcacagatagagtcacaaagtctagaagaagtccagtgaattgaaaacattgagatttcataattctgtttaatcacaacaggaaatgccacctgaaaatatctctgggtagcatttgacttttcttcaccaggaaacatgttcacaaagaacaggaggatcctgcacagaacagtgggctatgtgatgagaggtgtagacccgagtggaccttgggcagggtgcctgctgagtctgttgtatccagctgccacccagggtgacccaacttgggcttcatggctggccgcacaggagcgatttgtttttcttttgttacgctgcatttccattttccgctataatcacctattctaacagatgatctgtttccagggctcactaaggaccaaatcaaagaaaatgaggctgtaactaaaagaggaggatttagtgaagttaaaagaatgagcttttcagtggtgagatttgttaaaacaccaaaaaggtagtgtaatttgagttattttggaggcttttcagctttttacttgactgttgctaatctaattggagtcagatggagtaggtatttctagtccttccagccaatagttgatgaacaattgctggacactgctatatggcttttctgcatcacaatcacttgagaagttaaaaaaataaattctaggcccaaccccgggattctaatgcaataggtgtagggtgagacccaggaatctggcttttgcttttgttgtacttgcttgggggtgtgtgtgtgtgtgttttgagacagtctctccctgcttttgttgttcttgctggtgtgtgtgtgtgtgtgtgtgtgtgtgtgtgtgtgtgtgtgtgttttgagacagtctctccctgtcacccaggctggagtgtagtggcatgatcttggttcactgcaacctccacctcctgggttcaagcaattcttgtgcttcagcttcctgagtagctgggactacaggtgctcaccaccacgcccagctaatttttgtatttttagtagagatggggtttcactgtactgcccaggctggtctcaagctcctgagctcaggtgatctgaccaccttggccttccaaagtgctgggattatgggcatgagccaccatacctggccatgttgttgttaatgagctcttggagtgattctgaggtatggtcaaggttggggaaccacagatctaagagctgtcagcacttccccagcagttcctccccttgagtcctccatgagagtgatcacagtattgctacaaaggataagtgcctgttggtgtttctgagtctcccgccttcactcactagagcagcgttggttggcacagtcctgagggcagcggctgttgtagacatgttcttctgggctgagttttcaccgggtcctatgaaatctctgaggagctttgctgggagtggtgtttaaatctacttgtgccctttggcgtttcttctctatgccccttttctagctctgtagagttggaagtagagaccgtgcctgtcagaaatggcttaaagactggccttagccagtgaagtgaagagtcattaattcagaaaagacttatttgaagtactagatgaatatcccttaccctaaacgcttgcgactagaagtgttttggatttcagagctttttttgattttggaatatttccatcatacgtaatgggatatcttgggaatgggacccaagtctaaacatgaaatttatttgtgtttcgtatacaccttatacagaaagcctgaatgtaattttatttttttcttgggggtattgaataaactgttttgactgcgacacgttgcatgaggtcatgtacggaatttccacttgtggcattgtgttggtgttcaaaaagtttgatttttggagcattttaggttttggatttttgaattaggaatgctcagcctgcaataagtgaaacacttggcctctttcgtaaatgtgctgcccttgattttaccaggctctctgatagcaggcagtaggggaataaagagagacagttttaaaagataactttttttttcttaaaaatagtgcatatggactataaaaaattttaaattcaaaaacaaggaacaatgaatgatttataaatttaccacttgcggataatcactgtaaccatttggtgtatattcactgacaagcacatatacaagtaaatacagatgcctatctatttcataaaaatggcatgacagtgtacagtaaccaccttttttcactgatgtgtatatcttgaatatgttacgtcatttacttaaaattccttggaggacccaaattcagcacacacctaagcactttctaatggctacaaaatgttccactatgtgaatgcactgctttattttccaacagggacttgattatttaggttgtttgcattttccctcttataaaatgggtcgggaagaacatcgttgcagttaaagtctttgtccacggtcctagaagtggaattgctgaaccagcgggtatgcatggtggtacatatggccaagttctccacagaaagagggtgccattttacaacctgctgacaggccataagcagcccgtctgtccacagcctgccagcattggaaatgatcattttaaacaaattgtcagtttagctgtggcatatttgtggagcatgtgattgtgtggtggatcagtgcatcttctctagaagatatgcagtaaagccagcgcttgctgtctacagggcaggcatagtctgggccctccatgccaggcgctgtgctagaccctgagttgaaacagtcagcgccatcccttttcctgtgaacttagtcaaatggagctgccagacattaacattaatatcagcaaaaagtgcatttagtgcaaggatggaaaaatgacaaggattagaagaacgtaaagtatctcatttaggttggaataatggtggtgagttcagagcagtcttttcagaggaagagacatttcggctgatactaaagatcagcaaagggcagggacagtgtatgcccagagagggagtggcagttgcaaaggccccaagttaagaaagtgcatggtttatttgtttatttaatctaaggtttgtgctaatgaagtatgagttttactcagtgtctgagctattaggagcagtatggtcatagctgcagtatctgtaatagagaaaaacgggggctagcttaaatgtctgttactaggaaagtggttaaaaacttggctacgtttatcccctgagtaccagagtgagatatctcgtataggcaggcatgaaaagggatgaagatgcagagctgttactgtgcatacagtgtgatcctgttggtgtttcagtgtgtatgtatttttgtttctttctttcctttttttttttttggagatagggtctcactctgttgcccaggctggagtgcggaggccctccatgcaggctcactgcagccttgacctccctgggcttaggtgatcctcccatctcagcctcctaagtagctgggactatagattcatgccaccactccctgttaatttttgtattttttgtagagatggggttttgccatgttgccctggctggtcttaaactcctagtcttaaatgatctgcccagcttggcctcccagaatcctgggattacaggcatgagccaccgtaaacatcctgaagtttttaaaatacttttttatacttttgtaaaaatgaataaatgcagctctttctggttttgagtctttatcttcacttgggataggtgcatacttaattaggagtaaagttaaaattagagacccatttgtttatttatttattttcttgagatggtgtctcactctgtcactcaggctggagtgtagtggtgtgattttggctcactgcaacctccgcctcctggactcaagcagtccttccacctcagcctcccaagtagctaggaccacaggtgcatgccaccacacctaatttttgtatctttggtagagacgaggtttcaccatgtttcccaggctggtgtcgaactcctgagctcaagtgaccaccacctgcctcggcctcccaaaatgctgggattactggcatgagccatagcgcctggcctgaaattggagactttaacccttcttgtttcctcagtgttcattggacctagttttctttttcttttttatttttttctaacagagacaggtctcactattgttgcccaggctggagtgcagtggctatacacagacatgatcatagtaccctgtggccttgaagtcctggattcaagtgatccttttgcctcttgattatctgggactgcaggcatgcttgtgcctggctcaggttttcttttcttttttttttttaagacggagtctcgctctgttgccaggctgcagtgcagtggtgcgatctcggctcactgcaacctccgactccctgattcaagctattctcctgccatagcctcccgagtagctgggattacaggcatgtgccaccacacccagctaattttgtatttttagtagagacggggtttcaccatgttggccaggatggtctcaatctcctgaccttgtgatccacctgcctcggcctcccaaagtgctgggattacagacgtgagccaccacgcttggtctttttttttttttttttttttttttgagacggagtctcgctttgttgcccaggctggagtgcagtggtgtaatctcggctcactgcaacctccgcctcccagcttcaagcaattcttctgcctcagcctcccaagtagctgggactacaggtgcgtgccactaccgccggctaatttttgtatttttagtagagatggggtttcaccatgttggccaggctcatctcgaactcctgacctcgtgatccacccgcctcagcctcccaaagtgctgggattacaggcgtgagccaccacgcccagccaggttttcattttttaagctgctttttcaagctctttaaggaatgatattgcatgagttgtattcttttttagaggtattacaaagaactgagagaaagtatacttatattttaaaatagtgcaaaactctttctgtcttacaattatcataggggtcttttggatccttttgtaagtctttacatgatgggatcttagggatcttaattttcctgtgttttgaacgttttgctatttgttattccacataattatttcaatactattcatcatctactcccaaatatgccagatgagatgaaaatcataagaaaatggaagaatgataaagcctctggggtggatatacaatagtgaagtaattgtcatgatgacaccttcttttattgtcctatggccttgcctaggctattgcattgtcttccaagaggttaaaaaaagaagactagagacaccatcttttgagtctcctttttgctttcattgaacccaggtgagaatccagaatttttctatttttcatctgtaatgtcaaggagaagagaattgacagaggaagacatttctgatgattaacaaatcagaagatgaacacaaaaagacagatagatggcagcactccagactgtaatgatgatggtgagattgtctaagcaaaatcgcagactgtgagtcttcagatgctagcatagatgaatttccccaaactcaagaatcagctagtgattatttatctgatgtatggaaaggaaatgtggtatattctcatctagtcattcaacagaaaggacttcatcatgcaacatttttcgacaagaacctctcccatcctgtttgcatttaaaaaaaaaaagtacgtgtgacaacattcttttatcttttatgtttggccgccaacatttatttcttaccacttattgtcaacaaaataactggacaaatgcacaaggaggtgtgtgtccaaaggtgattggaagaaaatagatataaaaatgacaaaaataactggattgatccttctgttggtgtttataatccaaaaatgaaagcattttgcacttaatggagcaaggaaatggctgctttctcttcaacagaattatgagtctgtttcaaaagtagtgtgtttgacagtgccagtacacgaagaatctgaagtcctgttaagttagaacctgttggagatggacttggaatctgacatcgctacaggtgggctgtgccccagctgcaggtgcatcaggtgatgagcagttagttgcatatagaggaccttgctttttttcaggtatatatgccttccaaattagaaacattgggataagaagctgggtttgctgtgtttaagttcttattaaaatgtctaataaaatggcttttgtcatccttttatttggtaaattatttgtaaaatgactttagatatagaaaaacagaagagtctgttggagccagataataaatggtgatggctaattttcctagcatactgtgagggttaagtgtggttcagagcatttctttcttttctgttgttttgttttgttttgaaatagggtcttcctctgtcgccctagctggagtgcagtggcacgattgtggcttactacagccttgacctcttggcctcaagtgatcttcccatctcagtctccctcgtagctgggactacaggtgtatgccaccacacctggctagtttttgtattttttgtagagatgcgggttttgccatgttgcccaggctggttttgaactcctgggctcaagtgatccgcccaccgtggcctctcaaagtgcagagattatagggatgagctatcacacctggcctctttcttaatgttgcctagattttattgctgaactatacactatggaatcagtgttaacagtaattcctacattgtgaagataagactaagtgcccactaaaccttcctcattttactgggaatggtttttgtagattagttttgaaccatttgctgcctccctacttggaacattttgtcagtctggataataggaaatttttaatgagccaggcacggtggctcactcctataattccagtactttgggaggctgaggtgggaggatcacttgagcctaggagtttgagaccatcctggacaagatggagagacctcatctctaccaaaaatatttgaaaaaacgaaatggtggcatgtacctgtagtctcagctaatgaggaggctgaggcaggagaattgcttgagcctgggagatcaaggccgcagtgagctctgattatgccattgcactgcagctgagggcacagagctgaggccctgtctcaaaagaaaaaaattgtgtaaaagagcaaaataatttcattttcaaatatgtttttttgcatttttattttactggctgctttgttcctaatgatactcctctggaagcaatggcttagagcagtgaatcgcaactccagtcacctggggacttatttaaaaaataaacaaatactataaataaaactgctatccaggccatgccctcaaaaatttgagttcagttgtctggagcgggctccagaatctgaacttgtgaagctcccaagtgattgtagtgctgctgtggttgagaaccactggcttagggtgtagaacggagcagtagacccattgttttctatcagtcttacgtggaaccttgatacatgtatataaaatagaaaaggagcatttcgttagtataaattgttatttaaaaaaatttttttttggctgggcacggtggctcacgcctgtaattccagcactttgggaggccgaggtgggtggatcacctgaggtcaggagttcgagatcagcctggccagcatgacgaaaccccatctctactaaaaatacaaaaaattagccaggcatggtggcttgtgcctgtagtcccagctccttgggaggctgaggcaggagaatcactggaacccaggaggcggaggttgcagtgagccaagattgcaccactgcactccagtctgggcaacagagcgagacttcatctcaaaaacaaaataaaaaataaatatttgttgttgttgttgttcttgttgagatgaggtcttattatgttgcccaggctggtctcaaactccaggcctcaagtgaccctcccgccttgacctcccaaagtgctggaattacagttattagtataaacttataagtttggatttataataatggtaaaggcaatttctgagaatgaggtatatgagttttcaaaaacaccaaattatattcatttaaaaacacggctgggaaagatacagtcccactttaggatagtgattaactgccctgggaatgatagtgagatggccttcattgcctctttttttgagacagagtctcacccggctactttctgtatttttagtagagatggggtttcgtcatgttggccaggctggtctcgaactcctgacctcaagtgatccgcctgccttggccttccagagtgctgggattacaggcatgagccacctcgcctggcccgttgccttgtgttttgagatggagtcttgctctgccacccaggctggagtgcagtggcacgatcatagctcactgcagccttaaactcctgggcaatcaatcaagtgatctttttgcttcagccaccccagtagctgggactataggcacactccactgcacctgggtaatcttaaaatttttttgtagagattaaggtctcactttgttgcctagactgatcttgaactcctgacttcaaacaaaccatccatctcagcctccagaagtgttgggactacaggcgtgagccaccatgcgtggctcattgtttttcttaaaacagaaaaaaacagtccgacgtcagtagtacttaactattgacattggataaatccaggaaattgcctgttatgttattatctgtacttttctgtatgtttgaaataggttgtaaataaaaataaaagttaaacctaattgggctgatacaatgaacaaaacattgaaaattggggcatgtacgtggcattcaaagtcttacgacagtctgagcacctagtttatttccaagttgtgttctggctgctcataaagagcattctcattggcacagttcttagcatgtggaccttttttttttttttttaaacagatcatctattaaaaaaaactctggatgctcttcagggaaacagctgtcaagctttattctgttgtgcacaaaaatgagttaatctggggttagcacaagttactgtgttgatgatttctggtatcttaatatttggtgtgaaacatttttgttgctgctttttaaaaaattcaggcaaaatatacatctaaaattattaaacatttttaagtgcaccagtggcattaaaatacattcttggttttgcacaactgtcactactaattttcagaacctttccatcattccaaatagaaattctggactcattgaagagttactccccactcccttgctcgtggcccttggtaacctctactttactttctgtttctatgcatttgcctagcctaggcacttcataaaaatggattttttttttaatgtgtggcttatgttacttactgtaatgttttcaaggttcgtctctgttatagcatgtttcagaatttcatttcttttttaagggtgaatgttttatggtatgaatagtaaatatttgtttttccagtcatctgttgatggacatttgggttgtttttaccttctggctattgtgaatgctgctgtgaaccctggtgtataaaaatgtgttcaagttgctactttcaggtcttttgggtgtatatctagaagtggaattcctggatcatataataattatatgtttaattttttgaggaactaccaagctgttttccatagcaactgtaccattttacattttctattaaattaattaacttactttttttttttttgagacggagtctcactggactggaatgcagtggcgtgatctcggctcactgcaacctccgcctcctgggttcaagcgattctcctgcctcagcctcccgagtagctgggactacaggtgcgcgtcaccacgctcagctaatttttgtatttttagtagagatggtgtttcaccatgttggccaggctggtctcgaactcctgacctcaggtgatccgcctgcctcggcctcccaaagtgctgggattacaggtgtgagccaccgcacgccctgcccattttctattttatttttaataaaatccaaatctggtacaaccattttacattttcataagtgactggaagcttctcatttctccatatccaaaaacttgttatttccatttcttttgatagcagccatccttatgggtgtgagtggtatcttactgtggatttttttttttttgaaacagagtttcgctcttgttgcccaagctggagtgcagtggcataatctcagctcactgcaatctctgcctcctgggttcaagtgattctcctgcctcagcctcccaagtagctgggattacagacgtctgctaccacacccggctagttttttgtatttttagtggagatggtatttcaccatgttggccaggctggtctcgaacctctgacctcaggtgacccacctgcttcggcctcccaaagtgctgggattacgggcatgagccactgtgcccagccgactatttgtatttctttagagaaatgcctgtgtaagtgctttgcccattttctaattgggttgttttattgttgagttgtagttctttatatattctggatattaatcccttatgagataaatgatttgcaaatcccattctgtgggttttcttcactctcttgatagtgtcctttgatgcatgaatgttttaaattttgatgaagtctaatattaatgtttcttttgttgtctgcggttttcatgtcatatgtaagaaatcaccagatggtgtcataacacttttcccctatgttttcatctaggaactttactgttttagctcttatgtttaagtatttgatccattttgagtttttagtggtgtggggtaagggtcctgccttattattttgcatgtggatatctagttttcctagcaccatttgttgaacaagcttacagtattttttttttaagtttaatatctatttaactattagattggtaattacttttgcaccaacctgtaaatttcaagccaaacctctgtagaactccagcctttaaggtaccttgcttgcaaattgccagttttaaggattcactcataaaaaagtagaccctttttctgcttaggatttaaacaaaaatacaagtgtgggctgggtatggtggctcacacctataaatcccaacactttgggaggttgaggtgggagggttgcttgagcccagttcaagaccagcctggacaacatagtgagaccccatctctacaaaacattaaaaaaaatagctgggagtggtgcctatgccagtagtcccagctactcaggagggtgagatgggaatattgcttgaggtcaggagtttgaagctgcagtgagctatgtttgtaccactgtccttcagactgggcaacagtgtgagacactgtctccaaaaaacaaaaaaaagtatgtgtaggttaataaaccaccacaagtgctatgaaagtagttttgactcaggtgagatacactgaaaccagattggaaagaaaagattatggaaggatagaaggaattacaaagagcatctggaataaatttatttgtccaggattatacccttggttatatatatatttttttaacctagagtttgttttattttaattatagctttttttggtgggtgtgacacggtctcacactgtcactgaggctagaatgcagtggcgtgatcatagccacctcagcctcaacaccctaggctcaggtgatcctctcccctcagcctcccaagtagctgggaccacagatgtgcgacaccgcacctgctaatatttgtattttttttataaagatggggttttgccatgttgcccacgctggtctcaaactgggcataagcaatccacccaccttgtccttaaaaagttttgggatcacaggcgctagccaccatgcccagccaattacagcttttaatattcagtggccagacgcggtggctcatgtctgtaatcccagcacttcaggaggccaaggtgggcggatcacctgaagtcaggagttcgagaatagcctggccaagatggtgaaaccccatctgtgctaaagatacaaaaaaaaaaaaaaaaaaattagccgggtgtggtggtgggtgcctgtaatcccacctacttgggaggctgaggcaggagaatcgcttgaacccaggaggcagacgttgcagtgatccaaggtcatgccattggactccagcctgggcgacacgagcaaaactccatctcaaaaaaaaaaaagttgagtgtaggtggaatatacctgataaacataaggaaatgcacaacagataaaatcttggatagtcctataccttgcctatttagcagtttcagccatgggttccttttcagatagttctaatctcagaagcaggactttataaattctttgacaaaataagcaataatgtgaagaaaaacagctctttttgttttgggggactttgctagataagctttgagcttatctagttcctcttattatcactacagcacagtataaaatccatgttatcagcacgcagaagtaagatccttgctcctctttaatctcatccctgattggacgactcttaagtgaaccttgttccaaagatggaatctctgcctttgttgaggagactttattagtttgcgccttgtatttttttgccaacagccgttgagtatgagatacatggcagttttgtaatgtgtttcatcgcatccttatttatttctttatttttaattatagagatagagagtctttgttgcccatgctggagttcagtggctgtttacaggcatgatcacagctcactgtagccttgaactattgggctcaactgatcctcaactgtcaccttgctgagtactggggcaatagtcgtgtactgccatgcgcatggctgcattctcttaaagtggtttcccgccgggcgtggtggctcacgccttaatcccagcactttgggagccgaggtgggtggatcatgaggtcaggagttcgagaccagcctgaccaacatggtgaaaccccgtatctactaaaaatacaaaaattagctgggtgtggtggcgcatgcctgcaatcccagctactcaggaggctgaggcaggagaatcgcttgaacctgggaggtggaggtagcagtgagccaaaatcgcgccactgcactccatcctgggcaacagagcgagactccatctcaaaaaaaaaaagtggtttccagggaatttatgttcaaataagcctgcatactcatgtggacagacttaatctgaatttgccacgtcccacatatatctgtctgtattttgacttttccaaaatgtggcttcccactacttgagaaggacttttggaagtcactgttccgagcagcagtgacatcttgctgaaccacagtcaggctgacacatatccaaaggtctattatgtgcggattgtttttggtgaacttatgaggtacaatttgactcaaacttgacaggacatgtatctttttaacctcttaaattcagtgacacttggtatgtgtgtggttaaattcataaagccaaagctcagtgcttttaaggtttaccattgcagctaggatgttgatgggtgtttttttgtgggggacagcgtctcgctgtgtcacccaggctggagtgcagtggcgcatgatcatggcttactgcagcctcgatctcctgggctcaagcaatgctcctgcctcagccctccaagtagttggaactacaggcatgtaccaccaccacatccacctaagttttgtttttttgtttttgtttttgtttttgttttagagacaaggttgctcaggctggtctcaaactgccatgttgctcaggctggtctcagactcctgggctcaagctatcctcctgccttagccttcaaagtgctgggattacaagcatgaaccaactcacctggccattgactattttaataagagctaactactaaacaattattcttacaggtgaatggaagagaatccgaagaagaaaatctcaataaatctgaaataagtcaagtgtttgagattgcacttaaacggaacttgcctgtgaatttcgaggtaagctaattttacatgtaggactttgtattctaaaatcctgttagcattcatcataagagttattttttcccctaaatatcattggaataatcttcacataatgtgaacctccaaatttaagattcatactttatatttagtgaagcagtgtttattctcttcttctgggagtccgtaactaaggggcattcatggatgtgtagagagttcatgatggcttcagttggtgtgtggacctcctgaagcagtctgaagatggttgtgttagtgttcatatgtgtattcttctggatagggaagggtggaggggctagttcatcacttagatcagtctcaaaagcatttgtggtccctaaaggtctcttcagagtaattttgaaaaggactcagtttttgtcattgtctagcgtctgccctcaattcctgtttaataacttcatttgttgttgagaccttgtgttctaaaaacaataatcaatgaattgtctgatcaaagtgggaaataaggtacattttaatatatgttgccttaaaagacatatagttcatccaaatggacgagggaggtaagggagaattttttttgttacttatttttattaagcgccagcttaatgctgcagaaaatttcacatcacccttgataacccactttcttttctcccacccaaattcttgatcaagagtttttcaagtaaagacatgctcttctctcttctatataaaacgttacgaataaaggcaaaagattgtgtacatcttgctggaaaatgctgcccagggctctggagatggcggctgcccgggctcccttcgctgtccaggtcctgaaagactcttgttcatgaactgtctcttcacaaagcaagtccaccacgtgctgggtttatcattcttagggtcgaaaacttcctcacaaagtctcagtccagtctcttgccttagctgttgtaaataggctctcatcacttcatcttcctgtttgtttgcaggtttggtataaattgcgtgaagtggaaaaccaggctctccaggaatgggaaaactaatgattcccagtgtatacatttctttctcaccttgacttttggaattgcacttttggagttttttcagacattcagaaatgtagagagttaaatatatcaaggtcctatcagcttcattcttaatttcatagtttttgaagaagacattggccttgaagtaatagttggcttcatccacaatatctgtatcttttgtctctctgggggcaggtcctttgaattgacttctgataggtaacagtgctatgtttccgatgagtttggtgtcaggatccatgagagaagagtaatgagccggcatcttggcggcgcccgggtttcaacccagagcttttttttttttttccctgagatgagtttcactcttgtcgcccaggctgtagtgcaatggtgtgttctcggctcactgcaacctccacctcccagattcaagcgattctcctgcctcagcctcctgagtagctgggattacaggcatacgccaccatgccgagctaattttgtatttttagtagaaacggggtttctccatattggtcaggctggtctcgaactcctaacctcaggtgatccacccatctcggcctcccaaagtgctgggattacaggcgtgagccaccttgcccggcccagtaagggagaatttttaatgtttaccttagaaataaggtctgacccacagcagattctttgcagattcttttgatttacgtgcttgattatggcttatttcttaaaaagcctatctgaagcttatattcctgtaaaatatctttgaagtattctttacagttacaggtgatgtataccttctcctcctatgtgctagcaccctaaacttaacccagcttcagtgctccatcctttggccgagtgatgatgatttctcacctcaccctgctgatgcctctctgcctgccatgggccagaggtgggattgtagttgccagggctccctactgtggcccacctgggtacgagggcttgtttgttcctctccattcctctgacactcattcctgcccctccaccctcagtgggtaagagcaggtttacactgttctcttggagtccagagcaccgacatggatctagggctggaatcttctcacctggccctacattccctccctggcctttctccctccatcagtggaggctgggatgcacttggggagggaatgagacaggggacattcagaatggctgtttgggctcacagttgagtgggaaaaagatgggagctgcatcccaaggagtcatgaggtctcccccggcacctgtttcaggaaaggggagaagtgttgcttttctcccctgctgacagattagtctgtcatgagagtggatttttgcaggttgtgggggaggggtaccaagaccgtggggagtgggagatgcctggctggcttcccgggtcacctcatgtgcagagttgacggcttgggccagagccttggattcctgagaagcttaccacctgctcactcttgctgctacccagagtcactgagatttctggaaacttagagattgctattttatgtttttgttctgtgggatttggggtcagattgcttcctttcctccttcacttttgttaaggtttcagatctggctctcaactctgtgttcaggaatcttgacagtagtcacataaaagaattgtaggagtgccctctcgtggtgatcttttaaagtaatttatcacagcttgcatgtagttggtggcgtgagtgcttatattcattaactcaaatatcaggaattttttactagcttgcattattatgttgagcaaggtctttcctttcttttgccgctggaaggttgcctggcatgtattagatgtttaggaaatagttactgaataaatgaacagaataatttttgattaagtttttggtaattaaatctgtcacataggaagcttcgttaggtgttttaataggggaagacaggaacagttttttggaaaaatatatacagcttgacttttgttttgttttgttttgttttggagatggagttttgctcttgttgcgcaggctggagtacaatggcacgatctcagcttatggcaacctccacctcctggcttcaagcaattctcctgcctcagccccctgagtagctgggattacaggtgcacaccaccatgcctcactaatttttgtatttttagtagagacagggtttcaccacgttagccagtctggtcttgaactcctgacctcaggtgatccactcaccttgatctcctaaagtgatgggattataggcatgagccaccgtgcccagccagtttgacttctgataaaacatacagttttagttagaaaatgtgatggtgctgatggatacggtcatcgggagacaattgtgacatgctcacaccacatgcaatccaggtgatcctccagatttagattggggggatcttgatgtgggcagacaatgcaagccgttggagagggccagggtgggctgtgcatttgaagtgagccatcagggtggctgacctgtccctccaaagtctaacctgaggacagggaaagcactgttgtgggaagaagtgtttcagaatctctgcccttgggtgtgggcggcacctatgggagttctttaaaatcagtccacgggtgcctaagcaggccaggtccttcccacacctctgctcctggccactgtgctgaattcctaccccccattctccgctacctccttcccctacaccaaaaaaaaaaagagtgcatccattttggaggctcacttttcttacctagacattttttcaattttttacttcaaaaatttcaaatctatctaaaagttacaagaataggacaatgaatataactttcacttagattaaccagtggttaacattttaccatatttgcttgctccttccttccttttgttttttttttttttgtgacggagcctaactctgttgcccaggctagagaacagtggcatgatctcggctcactgcaacctctgcctcctggattcaagcaattctcctgcctcagcctcctgagtagctgggattacaggtgcacgccaccacactcggctaatttttgtatttttagtagagatgggatttcaccatgttggccaggctggtcttgaactcctgacctcaagcgatctgcctgccttggcctcccaaagtgctgggattacaggtgtgagccactgcacccagcctgctttttctttttccataaatatacatattattttctgttttttactttgctggattatttgacagaaagtggtagatatcataccctttaactcctaatatttcagcatgtatctcttaagagcaaggacattctcttaaataaccacaatctattaagtagaggaaatttagcattgctatagtactgttacctaatacacatcctacattcacatttcaccagttgtctcaatgatgtcctttatagaaatgtttcttccgctctagtgtctgatgcagactcacaccttacatttagctgacctttctctttagtctctgcagtatctttagtatctgcagtacattctcagcctttctctgtgtttcatgacattgacatgtttaaaggtcagttatttttgtacagtggccctcaatttgggtatttctgatggattacttatgattaggtctggttatgtgttttttggcaggatcaccatgggagtgatattgatccttctcagagcatcatttcatgtcactttgtaattaactcctaacctctgaggagatgtttgaaggctgggccttcacaggtctccccggtggttccagcaatcttttttttttttttgagacggagtctcgctctgttgcccaggctggggtgcagtgatgtgatctcagctcactgcaacctctggctcccgggttcaaatgattctcctgcctcagcctcccaagtagctaggattaggcatgcaccttggcctcccagagtgctgggattacaggcgtgagccaccacacccacccctcagggatcttgatgattcttgctggcattgattatcactgtggtagatgtcaaaattatgatttttggcatttccaagctggcattctacagtaaagaaaaagtttccttcctcccctcttatagtaattatatcggtatagatgcattgctgcttttttttaaacccaaagtattactccattgttatcgtcacccattttgatgtccaaattgtcctttaaattggcccttgtgccctttaacatgcccccatcagttattttttggatgaaggggtggtcaggcttcttgaggtataatttacagtgaaagtcaccctgtgtaagtgcacagttcgatgtgttttgataagtgtatatggttctgtaaccagcaccatagtcaaaacagaacatctcccacccagtaaagttccctgtgtccctttgcagtcagtctctcccctctgtcctcaggctctggcaagcattgatctcattctgtccctatagtgttgcctttttaagaatattacataaatggaaaatagagtatattgccttttgtctgacttctttaacttagcttggagtcattattcatgctgttgtgtgtttcagtagtttgttcctttttatcaccaagagtgttacatagtgtgtacacactacagtgtatctatttaccagttgaagatttgtattgttgtgagtttttggtgattattaataaatctactgtaaacatttatatacatctgtggagacatgttttcatttttcttgaataaatacttgagtggatttgctgagttgcatgataaataaataactttataagaagttggctgggctcatgggctcatgcctgtaatcccaacacttcaggaaaccaaggtgggcggatcacttgaggtcaggagttagagaccagcctggccaacatggtgaaacctcgtctctactaaaaatacaaaaaattagccaggcatgtgcctgtaatcccagctactcattagactgaggcatgagaatcgcttgaacctgggagtcagaggttgcagtgagccgagatcatgctactgcactccaacctgggcgacagggcgagactgtctcaaaaaaaaaaaaaaaaaaaaaaaagttgccaaactgttttctaaaccagatgtatcattgtgcatttcacctgcaatatatgagagaggcttagttgctctacatcctctccaacacttgggtattgtcagcttttaaaattttagttattccagcctggccaacatagcgtaaccccttctctactaaaaatacaaaaattaggtgggcatggttgtgtgcacctgtagtcccaggtactcagggggctgagggaggagaaacgcttgaacccaggaggcagaggttgcagtgagccaagatcgcgccactgcgttccaccctgggtgacagagtgagactccgtctcaaaaaaaaaaaaaaaaaaaaaaaaaatttttttttaaagtcattctagcaggtagtcagtagtatcttgttgtggttttaatttatatatctccatgaagactagcaatactgagcttcttttcgtgtttttattttactattttctttgatgaaatataggtttatatcttgccagtttttttgagtgtctttttattattgagttttggaggttctatatatattctgaattcaagttttttctcagataagtattttgcagatattttctcttaagtctgtggcttgtcgtttgattttaagtgactttcaaaaagcagaagtattgaattttggtgaggtgtagtttgttaaattttttatagttaataatttttgtgtatgctgagatacatttggctaacctaaagtcattttccttagaaattttagttttagctcttacatttaggtttataattcatttcgagttagttttcatatatactgtgacataagggatgtttttgtcttttttttttttttttttttggatttggatgtctaattgtgcctgcactgtttgttgaagagacagtcctttattttttgagacagagttttgctcttgtcgcccaggctgggattacaggcttgagccaccatgcctggctgagacagtcctttattaaataacctttgcacctcccctcttcacattttgagaacttccatgctttctgatacaacaaaatgttttagcctcactttgaacttcccctgctctagctttagccccagtggaaacataaatttctaatagaaatggtcttggccattcctccaagaagatccggttccttctaattgggagtggtgtgtagagacaggacagggtgctagcatgcttgttcctgctggagagccatggctctcggttaggagatagagctaggaaatatgtatattttgaaataacaagtttattttatttgattttagagaaaagaactcacttggtacccgggctgtagtgcagtggcatgatctcacctcactgcaacctcgacctcctgagctcaagtgatcctgctgtctcagcctcccaagtagctggggctacaggcacacgccaccacacactgggctaatttttgtattttttttttttcctctgagacagagtttcgctcttgttgcccaggctggagtgcaatggcgtgatctcagcttaccgcaacctctgcctcctgggttcaagcgattctcctgcctcagcctcccgagtagctgggattatgggcatgcgctaccacgcccaggtaattttgtatttttagtagagatggggtttctccatgttggtcaggctggtctcaaactcctggcctcaggtgatccgcctgcctcggcctcccaaagtgctgggattacaggcgtgagccaccgagcccagccaatttttgtattttttttgtagagacggggttttgccatgttgcccaggctggtctcaaactcctggactgaagccatccacccgccttggccttctcaaagtgctgggattacaagagtgagccaatgtgcctggccccttttttagttttttttgttttttagacaaagtcttgctctgtcatccgggctggaatgcaatggcgcgatctcagctcactgcaacctccgcctctggggttcaagcatttctcctgtgttagcctcttaagtaactgggattacagtcatgtgtcaccacactcagctaatttttgtatttttagtagagacagggtttcaccctgttggccaagctggtctcaaactcctgacctcaggtgatccacccgcctcggcctaccacagtgttggtattacaggcgtgagccactgcacctggcccccttttttactttttaaatgtcttttgatgagcagtttattttttattttattcatttatttatttttgagatggtgtttcgctcttgttgtccaggctggagtgcagtggtgccatctcggctcactgcaacctccgtctcctgggttcaagcaattctcctgtctcagcctcctaagtagctgggattacaggtgcccgccaccacgcccagctaattttttatatttttagtagagacggggtttcactatgttggccaggctgatctcgaactcctgacctcgtgatctgcccacctcggcctcccaaagtgctgggattacaggcgtgagccaccgcgcccggccagtggtttttaattttgaggaatttcttttttctttatggtggatatcttttgtgttcaactctttgccagccttacagtcttgaggctttctcctgttataaagtctttgtaattttagtttagatcacatttaagtgatcctaggtctaatttttgttgtggtatgagttagagatcatggtttgatttttttttcttccccccaccccgctccatgcagatacctagttagttgctctggtactatttttttaagagatttttaatttgttttggtgtgtttgccaaaaatcgagtgaccttatatgtgcaggtctttttcgtgctgttctgttgatctatttatccttacacaaaaccatatcctagttgttgtgactttataggaagttttaaaatctggtagtgtaagtcttctatttttctttttgagtgtcttggctaatatcggttagatttttaagtttttttgtttttttttttttttttttgttttttttgttttttttttttttgctttttgagacgaggttttgctctgttgcccaggctggggtgcagttgtgtgatcatagctccctgtagccttgatctcctgggcttaagtgatcctcctgttttagcctcccacatagctaggactacatacaggggcacactaccacacctggctaattttgtttttatttttgtagagtcaaggtcttgctgtattggccaggctggtcttgaacttctgagctcaagtgatcctcccaccctggcctcccagagcgttgggattacaggcatgagccaccctgcccagcctgattttctatctgtgttattgtaatcactttcttgataatgtccatgatacacaaaagttttaaagtttgattaagtgtgacttttttttttccctcttgttgattgtgcttttagtttcatatcttaaaaaccaattgccaaacccaaagtcatgaagactcgcctgtttttgcttctgagagttgtgcatgttagcgcctctgtgtaggtctttggtccatttggagattgtaatcactttaatatgcagctaactttctgttcatgtttaattttagattctttccccatctttgttgacttagttttatttctttaatatgtaaaacagtaaatgcttccagaagtcaaaactatcattcccgtctcatcccgtctgtctaccctaatccctcacacctgttgtaggtaactaatttcattgcttgctttttgagacggagtcccactctgtcacccaggctggagtggcgcaatctcagctcactgcaagctccgcctcccaggttcacgccattctcctgcttcagcctcccgagtagctgggactacaggcgcctgccaccacgcccggctaattttttttgtatttttagtagagacggggtttcaccatgttagccaggatggtctcgatctcctgacctcgtgatccacctgcctcggcctcccaaagtgctgggattacaggcgtgagccaccgcgcctggcccattgcttgcttttttttttttttttttttcctttgagacagggtcttactctatcgcttaggctggagtgcagttttgtgatcttggatcactgcaacctccgtctctcaggttcaaggggtttttgtgcctcagcctcccaagtagctgggattacaggtgtgcaccaccacccctagctaatttttgtatttttagtagagatgggggtttcaccatgttggccaggctggtcttgaactcctgacctcaagtgatccacccgctttggtctcccaaattgctgggattacaggtgtgagccaccatgtccagcccattgattttttttatccttcgttttttttttttttttttttttttttgcaaaaatgagcttataaatgtgtgtctgtttatatatgtgtagatatttgtataaaatcctatttttcttaaactaaagctaccataccatatactcttttgtgggtttttttttttttttttttacttaatgtgtgcggggaatccctctttatcagtgcttaagagatttgtctcgttctcttttgtggccacatagcaaccagtatttagtaggcctagtcctggctggaggctcagagcagatactaaacttgagcatttgtactgcatttatttctggactttgctgggctagcttcctttttgccagttgcagtggaccacactaaactcaggacagcctgtgagccaggggcatgggagtaaaaaggtctccctatttcatgcctgactgtttgggactcaccagactcaagagcataaaccagtttgagaagtaagaagaaaggcgagaaagcatttgaaatgatccccgcttcctttcatttagtaggtcttgtccttggttccccttccctgtgtctgtgtgaagtgtgccagccagtgtgccttggagcttttaataagtgtctgtccgctttcactcagtctttccctctgaaacaggtggcccgggagagtggcccaccccacatgaagaactttgtgaccaaggtttcggttggggagtttgtgggggaaggtgaagggaaaagcaagaagatttcaaagaaaaatgccgccatagctgttcttgaggagctgaagaagttaccgcccctgcctgcagttgaacgagtaaagcctagaatcaaaaagaaaacaaaacccatagtcaaggtgagaacttttctgaacacagaaggtgttttcattacttatagatgggtggggggtttagaaggctggtcgctgtccccaaggtgaaaggggatgagaccaacgtgccacaccccaggcctgccagaccccttagaggtgctgcaagagccacctgttaggtaagataaggacattgtgtcagttcagtagaggtacccgcagacgggcacacacatctgtgcaggagggcgctcatcacagccctggcgatcacagtggggtattgggcaggaacgccatgccggtctgtggggcgcgtggtgaaataacagtgcctgtgtctcagtgaccatgttgctgttctgaaggtggaggagatttgtgccaggcaggaggcccatagtgggagggtaggagtgagacattttgctgtgtgccttttcttttggatttttgagccacactaatggatctatcaaagcattatattgaccccttccccaaccccagaaaggggacataattccatggggaactttgtgattttcagtatatgtagtttcatgctgtatcaagatccaaatttttcttacataaaagcatactatgtataccttttgtttcccttttttgcttaatatagcctggaagtcacttctgatcagcagagtgagggttccttggcacaaaaggtggcctcaaggaagtaactgggattctgaggttcttcttgccatgtggcatcagcttgagcttttttaaaaaagtggttcctggattttgagttcttttcaagaaaattgggaacccatcatagctcagacttttggggagttgtaggaatagtgttttatgttttttctgcccatttactgtcatatgttgaaatatgttaaaaaacagccgtcgcagtcatagtgacgcttcgttatagtgaaatgttgatgttggtttgctaagaccttaaaatcacctagaacaatcataaaaaaaataaagcatcttttcattgttaaaatgttaaattaaaaaaaatcgaattctgagccattaggtcaacccaaaatctcttatctcctctcatatcctgatctctgagttgaccaagttcatgcagtgaataacattacagagtttctgccttgtttgttcctcagccacagacaagcccagaatatggccaggggatcaatccgattagccgactggcccagatccagcaggcaaaaaaggagaaggagccagagtacacgctcctcacagagcgaggcctcccgcgccgcagggagtttgtgatgcaggtgggtccgcatggatgatgggcgccccttcctctgaccacgtccagccttgggggctgatggcggttcaaggcctggacaccttcctgaggaggctggatcctgtgggccatgttctgccagcgactgtgatccttatttatttatttatttatttatttatttatttttgagatggagtctcactctgtcgcccaggctggagtgcagtggtgctgtctcagctcactacaacctccgactccctgattgaagcgattctcctgcctcagcctcccgagtagctgggattacaggcacgtgccaccatgcccagctaattttttgtatttttagcagagacggagtttcgccatgttggccaggatggttttgatctcctgaccttgtgatcctcccacctcagcctcccaaagtgctgggattacaggcgtgagccacctcgcccagccaactgtgatccttattaagaccttgtggcttgcaataatttgatagcttaaacataccacagaaatctgtaaaggctacatatcaaagattaagttgtttatcttaatgcttaaaaaaatgaatgtaatgtctgcacaccagcactactgctgggtgcactggtgggaatgtgggtgtgttgcactgaaatttggaagaaagagtcctggggtggtgggtgctgggagaagtttttcttcattacatctccttgaaggtttatgacattgctctttaccaaaggtaaattttgtaagtagtatcaagagatctgttcctcttcctcctaattcttatggagtctggaatctagggttacctcttccttagattgggtgacacttcagattagtatggaacatttctttgtacttagctgattaagttcaaagctaagtggtcatttcacataggcagcttaacttaattgtgatttgaatttaagtgctttctgatgtaagacagaatccttatctcttgtatagcaatttataacttagaaagttgacctcgtatattttacctatgcagtcagaaggtaggaaaagaatgatcctttcattccacaaaaggaagttgcagtttgctgagaggatcagtagtttgcccaagatgaaatggctggtagatggccaggttggaatttagtcccaggccagggaatggtttctttgactctctgagtcttgtgacctgggcttttggttttagcagccaggtgcctgttattacaatcaacttggaagggggttgtaagtagtgatgtgctggaacatgtttaacaaccaactcttcttcggggagggtggtttggtggaatgagctgaatatgtatgttatagatatatacatgggtgttatatacatgtgtgttataaattttactgacacaaaggatgtgtgttataaattatactgacatatatgtgtgttttataaattttactgacagaaaggatgtgtagtacaatttataaataatatacactttattgtaaatttcatacatatttcagtgtgacagttaccaacgatagtgttataaaatcagacaacacataatggtttattactatccagttcagcaaaggtgttgctcatgtcactgacaaatacatactgtagatttgagattttggttgtagcatgaatactggttgagatacattttttttggggtagaggggaatggagtcaacttgctctgttgtccaggctgcagggcagtggtgtgatctcggctcactgcaacctctgcctcccaggttcaagtgattctcctgcctcagcctcccgagtagctgggattcacgggtgcccaccatcacgcccagctactttttgtatttttagtagagatggggtttcaccatgttggccagactggtctcgaactcctgacctcaggtgatccacccacctcagcctcccaaagtgctgggattacaggcgtgagccaccacgcccggctggttgatgttttttatttatgttaataggtaagatgaaagtaaaacaggctgggcttgatggcttacgcctgtaatcccagcatgacggatcacttgaggtcaggggttcgagaccagcctgaccaacatggtgaaccctcatttctgctaaaaatagaaaagttagccaggcatggtggcacacgcctgtaatcccagctactcgggtggctgaggcaggagaatcgcttgaacctgggaagtggaggttgcagtgagctgagatcatgccattgcactccatcctgggtgaagaagtgagaccctgtctatcccaaaaaagaaaaaagaaaaagtgaaacaatgaagacatgtaacatcactcatttgtaaatgatatgagtggcttctctgcaaaattagataattttcaaagacgggaagatatttcagttttttgtgctagttacaatgtaatggctgcagacttctcatgcttttaagattaacctgctttattaaccttttcatcattgtaggtttagagttagacaataaacagcttatgatctttgatacgtagcatttgtatatttctgtggtataaatagtcccaccatggctgatttcaagctctcaaagtgatacttccaatggcaatgctgggaatagatgtacagtagttcaccatcacagactgtttccattgtacaaatgcaatagctgggcagaccctcagaacacagatgattataaaatgcagtcaaaaattacctctgttaaaataattatcagcttatataattaaatgtttaatactggctgtgtttaacagccagcttcccaaactcctgactatttaataattagctctcagagacaaggaggccaggttcggggcactgctgttatcttgcttctgaccatagttggttattttgctgacacaccaattcctgcctggttgttattctgaaggtttaagcactggtctgtgttttgacttctttgtgcaggtgaaggttggaaaccacactgcagaaggaacgggcaccaacaagaaggtggccaagcgcaatgcagccgagaacatgctggagatccttggtttcaaagtcccgcaggcgcagcccaccaaacccgcactcaagtcagaggagaaggtgagtgctgtgggctctctgattgcaagatggtctctcgcctcaccctagggaactggggcacctccaggggcaggcttcaaggcaaggctttatctgcctgacagttcaaggagtcctgctgaggagtgtctcatccatttggaccataatgtgctcagaggggcctcgcatgtccactggccccaggaggctctgggttagatcgttgattgtgtcagtatctttgtggtctggggacgctttgtggagggcagcttgctcctctctatttgtaggatgaggatgaagggtaattaggactgaaattactaagtgtgatttgcactctagaaatgaagcctgtgtgaaagatttataactgttaggctttcgttaattgtggaataggctttgatttttctggcaaaataagacagtgtgacagtagagacaggccaaatccaaagtttaggtttgggatttcttttttcctatgtgagttaaacatcagatgaaaataatcccctgttgaaaaattcacggccaggtgtggtggctcaaacttgtaatttgggaggctgaggccttgaatccaggagttcaagaccagtctgagcaacatgatgaaaccctgtctctacaaaaaattaaaatatcagccaggtatggtggcttgtacctgtagcccgagctacaaggctgagatgggaggattgagccttggaaggtcaaggctgcagtgagctgtgatcatgccactgcactcagcctgggcgacagaccctgtctcaacaacaacaaaaaaggaacgtaaaaagaaaaattcgtgtctgccagaagtggtaagcaggacctcagcaaaagccatggctgaccttcttctttcccatcactgaatggtcctggtgagataaacttgaaatcaggcctgattcattcatgtctgccagtcatattgacagaaacagcatcagtcatggccagttaataactgactgggaccccagataccaccagtatagatcttagacttggctttagggtttttcatttcagaatcttgtaggacattcagagtgtcctttgttacttcttagaaaggtgatgttgtgttagacaaaattcttaggtaataacattttccccgtaagggtgttaattttggaatgtcaccttattttttaattggatatcagctccaggaaatattcttgatttatttgtttagcttcagtctgaaagcttctttccccaccttggtgggctctaccgtctagcatctctgctctttctggttaaatgcttcccgtcttcctgtgggtgcagagtgcagctcagcattcacaggttagtgcactttgttagatgctctttgtgggcaggggtgtgggcaggagggtgcattaggagaaggaggcaggctctgcccaggtgtctgtcagggtgccagtggtcaggtggggcagggtttttctgccgattgccacagttattgctgactggactttgtgtagatttagacagcaggagctaatttttcagtgatctgatttatgctcatggccttttttttttcttcttcttttttaagacacccataaagaaaccaggggatggaagaaaagtaaccttttttgaacctggctctggggatgaaaatgggactagtaagtgtgatcttaatatcgtcttcctctgaacgtgattctgggatttgcatgggtcctgaataacagcaggagcccagccagtgaggtcccgcatgcaaagtgtctttatcattccctgattccctgcgctgccatgcgtgccaaggggagggccagcgtggggtttgatggtgtcattgcgtttttccaggctgtggatgtggattcgtgtttaccgtgtatgtccctcccaggtaataaagaggatgagttcaggatgccttatctaagtcatcagcagctgcctgctggaattcttcccatggtgcccgaggtcgcccaggctgtaggagttagtcaaggacatcacaccaaagattttaccagggcagctccgaatcctgccaaggccacggtaactgccatgatagcccgagagttgttgtatgggggcacctcgcccacagccgagaccattttaaagaataacatctcttcaggccacgtaccccatggacctctcacgagaccctctgagcaactggactatctttccagagtccagggattccaggtaactgtctggcctgagctgtgatggctgtgcctcaggacagtcatcttttggcttctctcagaaaatgaactttgaactttgtacttttttcttaaatcaagttctgtccagggatgggctggggagcagtgatggaagggtaggaggtatagaagtattgtaagcatatgtggtaagagaaatatctttatcctttggtagtaagatttcaacatgcaagccaaccctaaaagcttctaaccactagcagtggttgtaaatttggatttcaaagaacagactcatcgtgctgacactttctgtctggtaggaaaggatatggcttctcccagtcttgggcttctgagcagacacctaggttcctggaaggttctgggctgacagggcaggtgttagtatggccacagtggggctgagttggaaaaaagagctggtgatcttgcttgtggggcctggagctgcagccctccagcccactcatacttgctgttccctacctagcctcagctctcttttcccccttaggttgaatacaaagacttccccaaaaacaacaagaacgaatttgtatctcttatcaattgctcctctcagccacctctgatcagccatggtatcggcaaggatgtggagtcctgccatgatatggtacgtcacaccttgggtgagggattggggtgttgtgtgtttatgtggagcctgccttggttcagcttgttactagcctgaggaagatgggagaaagattgtcccatagaccttgagagcaatgaatcgtttgatagtgttcatatttttgaagactttttgtcatagctgattggatcgatttctcactcttgatcagaactcatcagctttagcccacctttcccttccttttccctgctggcctggaggggcaactgggatcctgcagctcacccagagactgcactcacttcatctctcaccagaacaaggaattgcaggtccacgttctggcagctgtaaaaaccacttgctttggtcttctgttcagatgaaattattgttataagaaaactgagaaaaggaattgatcagatcaacaaatctaagtaaactgtgatgtattcacttgatgggatgtcatgcatgcatgaaattaatgtctctgggtggggtgtggtggctcacactaatcccagcactgcgggaggctgaggcaggcggatcacctgagctcaggagttcaagaccagcctggccaacgtggtgaaaccccatctctactaaaaatacaaaaaaaaattagccaggtgtggtggtgggtgcctgtaatcccagctacttgggaggccaaggcaggagaatcgcttgaacccgggaggtggaggttgcagtgagccaagattgcactactgcactccagcctgggcagctgggtgagactgcgtttcaaaacaaaacagtgtctccgaagataatgtaataagaagaaaaatacatgataggccgggtgtggaggctcacacctgtaattccagcactttgggaggccaaggtggaaggatcgcttgagcctaggagtttgagaccagcctgggcaacttagtgagaccctgtctctatagaaagaaaaatacatgatagatttttgttagaaagcaggatataacatttatacagtctggttaccacatggttaaaaatactagaaggaaaaatataacattttcagaggttatgattcagtgaggtaactgaatattttttaatttgtattttaaattaaaaattcaaagttttatttagtagtaccagagttgaagaagttgccacctgtttgctgggcagcaggaactctcttgcctgcctgaccagtgtattatgctgtggtcccaagcggtggctgtggctttacccttctttccatccccactaggctgcgctgaacatcttaaagttgctgtctgagttggaccaacaaagtacagagatgccaagaacaggaaacggaccaatgtctgtgtgagtgcactgatgaaggggaaggcgctgatgatggggaggctgcccctcgtttgtgttgagtttacactatctgctgactcagcggggaaatatttgcctgagttactttctggcccttttgcctgaaagttttccagattctctgggcagaaagctctacttttaaaagacattttgaggctgggaacagcggctcacacctgtaatcccagcactttgggtggccaaggcaggtggatcatgaggtgtcaggtgtttaagaccagcctggccaagatggtgaaaccctgtctctactaaaaatacaaaaattagccaggtgtggtggcaggcacctgtaatcccagctacttgggaggccgaggcagagaactgcttaaaacctgggaggcggaggttgcagtgagccgacatagcgccactgcactccagcctgggcgacagagcaagactccgtcccaaaaaaaaacaaaaaaacctttttgagttggtcataccttcacatggtcagaactctgcattattttacaaggtacaatcttcccctcggacagcccccatcccatccctcctattctccccaccgcctcccccatagatcacatttttactagtttctcctgtatctttcctgtatgtttctttatacaaatatagacatatatttcttccctcattttcttcctttccccccacagagataagtacacacactctccttgcgtattttacttactggcataccctgggaaaacttttgttatcataaactggggcttttagtattgtacttcctgatgtttgccaatttcttttcatttttaacagtactttaattctcttacatttcaaaactagtgtcattttcatttttcttccttaaaggtgtgggaggtgctgaaccttttctggccatgaaccattataaaatcccaacatatatactgaaaatactgaaactgctttgaaaatttggaatttctgatacctccagtgggccgagagacacggtgggtaaaggatgtgggcagcagcagggaagacaacagaaacacaaggaggcggctgtggccgggctggactgtgctggggtttgttgtgatggccactcggtgacctggcggtccctacgcaatagcagctgcctgtggggaagaagggctgcccagccagctggttctcccgggacaccagcagatccacaccctgggcacctccgtgtttggtcttttttttcccctgtgtgaaagaagaaacggcacgaccccttctcaagctggctcactcagacacattgggacaaaccctggacagccatgccagagagaggcctttgaccggccccagagctaaaagcaccagagaaaatcaaatgcttcctactcagcgtgacccaacttttctagtgtgccacggccccaccacctcctgcagtacccacaccatcaccactgctttctcttccaacagtgatctgtattcttagtttcattattttcttttgattgatatgacactatataaaattttcatttgagaatttctcaattgtatctagttaaatagcacagtttggaaacttgtctgagactgactttatcaataatctaaccgacaaagatcatatccatgtgtatgtggttagacatttttatttcattgactaacccaggacagtttcagtgatgcaaattgtgtgccctctggttcagctgaaacagtcctggactttcaaaaaccttgaataagtctcccacagttgtataaattggacaatttaggaattttaaactttagatgatcatttggttccatttttatttcatttttatttttgttaatgcaaacaggacttaaatgaactttgatctctgttttaaagattattaaaaaacattgtgtatctatacatatggctcttgaggacttagctttcactacactacaggatatgatctccatgtagtccatataaacctgcagagtgattttccagagtgctcgatactgttaattacatctccattagggctgaaaagaatgacctacgtttctgtatacagctgtgttgcttttgatgttgtgttactgtacacagaagtgtgtgcactgaggctctgcgtgtggtccgtatggaaagcctggtagccctgcgagttaagtactgcttccattcattgtttacgctggaatttttctccccatggaatgtaagtaaaacttaagtgtttgtcatcaataaatggtaatactaaatttttttgttaatttattctcaaatgccactactgctaggttggtcccctcccaacttgcccctatcctttttttatttttaagaaaaaactttgtaatgcttgtgattccatctgggcaaaagtctgaagatctgaaataactttatatcaaaccattgatcaataaacagctactaatgaagtgtttggtcctgttgagcagtaactaaaataagggaagatgtgagtaaggggatggaagctcgtcgtggggggaccagggccagcccctctgggaagcgttgctgcctcagaggcatgttgggtacctggatgtagggacttgtgccccgtccagacctgacattgctacccaaagaaatgaccccaaggagctgagaggagactgccggacacttcccagggcatcctcatctctcaccataactgagcactgaggaggacatgcgttccagcctggttgagggttgggctagttggttttcattttttaattttagaagaagtggaagaagattataaaggcttcactgtaaagccagcctatgattgtactgccggaataactgaaagtgatcagaaggttatggaaaacactaagggcagaaggaaatgcaacattttgaggagaaaagcagtgaaaggagaaaaagtgtctttacgtctttaaaaacaacaaaaaaagaattcatggacctgtgactcacatcacaaccctcccccagactgaaggttcttagagaagctgagcctggggccctgacttgatgcactttcgcagggagcgtacttgctggcggcgacactggaagccgaccagtgtgatcttttgtgtcttcgactatttataaaaattcattctgggccgggcgcagtggctcacacctgtaatcccagcactttggggggccgaggcaggtggatcatgaggtcaggagatcgagaccatcctggctaacacggtgaaaccccacctctactaaaaatacaaaaaaattagccgggcatggtggcaggtgcctgtagtcccagctactcgggaggctgaggcaggagaatggtgtgaacccgggaggcggagcttgccgtgagcagagatcgcgccactgcactccagcctgggcgacagagcgagactccgtctcaaaaaaaaaaaaaaaactcattctgggtacttcattgaagaaggggtgccctggggtaactttggtaatacactcaagtaagcattaagtgttaaaaatattacaataaaaaattatagttcaaaaacagtagtaagtttttcttctttttatttttatttttttgagatggagtctggctctgtcacccaggctggagtgcagtggtgcaatctggaatcactgcaacctcctcttcccgggttcaggcaattctcttgtctcagcctccctcctgagtagctgggatcataggcacgtgccagtgcgcttggccaatttttgtatttttagtagagatgggatttcaccatgttggccaggctggtctcgaactgacctcaagtgatctggccacctcggcctcccaaagtgctgggattacaggtgtgagccactgcgcctggcttaagtttttcatgagtagctttgcatagtaagacattacaatatagctttttttttcctttttgagacagtagcttgctctgttacccaggctgggttgcagtggcctcaagcgatcctcctgccttgacttcccagagtgttgggattacaggtgtgagccactgcacccagcagtatatagcctttctttactacttttttttttaaagacagtgtcctgctctgtcacccacactggagtgtagtggcatgatcacagctcactgcagccttgactgggctcaggtgattctcccacctcagtttcctgagtagctgggactacaggcacatgacaccattcctggctaatgatatttttttttttttaagagagagggtctcactacattgcccaggc

SEQ ID NO: 12397 - DNA, 27908 bp, Human
ggctctgcgctcaggcccagagagtggcagggtcgggggacatttccaggagcgggaacagcagctccaggggcccagaggtaggactactgctcggtgcatttggaggtcttggctggactgtggcgttcatggggaaggagggactgagtctacagggctgagaggccaccacagcttgggttcaaatcccagctctgttcagctcttgtgtggccacagtcaaatcgcttccctccttgaagctccatgtcctctctgtagcaatggaagctacagcggagcccaattctaccccacccactgcacgacaattggtttgtttctatgtttgttactagagtcagggtctcactctgtcacccaggctggagtgcagtggcgcaatctcagctcactgcagcctcaaactcctggctcaattgatcctcccgcctcagactcccaagtagctgggactacacgtgtatgctaccacagtcggctaattttttatttttaaacagagacagtgttctcgctatgttgctcatgctggtctcgaactcctggcctcaagtaatcctcctgtcttggcctcccaaagtgctgggactacaggtgcaagccactgcgcccagcccttgaggagttttcaaagtatccacagcacccagggctgagaactgctacagcagctgaaagccataagtgtctttgactttccttttgtcctggtaaaccccttcattccttccttccttccttcctacactcattcaatcaaacactggttgaacaccaacaagtcccagcactgtgggctccaccctggcctctggggagtgggggagggacccccgatttggagattgtaggtgccaagaggaacgggcaagatgccctcctattcattcatttattccttcagggcctctccaagggcacagggtcttttcttgttggcatctgggttttcctctcctgtaagctgggaaggagatttctccctcaaggagctgttggccagatcaaagactaaaataatgctaaacagagcttccgtttcctgataaatgtatcaggagccaagcacttaaaatatattatcccgttgaatccccaagtaggattaaaacctcaaagcagagattgctcttatcctcacatgacagatgaggaaactgaggatcaaagaagtgaagtccgctgcccaaggcacagaaaggacaagtaggacctatggaagcccagccaaggcccagcaggcgctcagtggctaatcctcctgaaaactaattacctcactgcgcctgcccactggactaaatttgcctggtaaccgatgacatcatcactaattccgcgcccacgctcaacctatgggataactgatgacatcactgaacaaacaaagtaactgcagtttattgaaggcctactgtgtgcgcaaggctgtgctaggcaggcctcctctgagttcacataaggccccgtggtgcctgctactgcatgaaatagccataataattttaactcaaagttatggaatgcagactatgagctactctctgttttaaccttttttttttttttttttttttttttgagacagagtctcgctctgtcccctgggctggagtgcaatggcacagtctcggctcattgcaacctccacttcttggattcaagcaattatcctgcctcagcctcccgagtagctgggattgcaggtgcccaccaccacacctggctaatttttgtttttgtttttgagatgaagtctcactctgttgcccaagctggagtgcagtggcgcgatctcagctcactgaaacctccacctcctgacctcgtgatccacccgccttgacctcccaaagtgctgggacaacaggtgtgagccaccgcgcctgggatctttattaactttttaaaattaaaaatatatatatatatatatttatatatattttgagatggagtttcactcttgtcgcccaaactggagtgcaatggtgccgtgatctcggctcactgcaacctccgcctcctgggttcaaacgattctcctgcctcagcctccggagtaactgggagtacaggcatgcgccaccacgcctggctgatttttgtctttttagtaggggcggggtttcaccatgttggccaggctggtctcaaactcctgacctcaggtgatccacccacctctgtctcccaaagtgctgggattacaggagtgtgccactgcgcctgaccagctttataaagtttatagggacagtgtcaccactttacagaagagggactgaggctctgaggaggaagttccttgccagggtccgagtgtcgccaccctgagaactccagcacccacctccctactctccctcatggcgtctcccccacctttccacagccagaagttgccaggtgaatacttccggtacaagggcgtccccttccccgtcggcctgtactcgctcgagagcatcagcttggcggagaacacccaagatgtgcgggacgacgacatctttatcatcacctaccccaagtcaggtacctgccgggctgcgggcgtcgggggctggggagagtggggagggggtgcggcagaggacaggaaaggcacatagagaaggaggggaggaggaaaagtggggccgggtctgttcagagcggtgcccctgccagaagtagcctcccagggatacccacccggtgcccagcctctcccctccaggtcagttctcaacacttcaccttccctgacctccctggctgaaatagcgtcctcgttctgttcctccctttcccctttaccctctacttctctttttttttttttttttttttttttttttgtagagatggggtctcgctacattgcccaggctggtcttgaactcctgatctcaagtgatccttctgccttggcctcccaaagtgctgggattacaggcgtgaaccaccacacctgaccatttttatttttatttttcgagacaaggtcttgctctgtcactcaggctggggtgcagtggtgcaatatcagctcatcaaacctcccaccttggcctcccaaagtgctgggactacaggtgctggtcaccaccaaattgtatactttttttttttttttttttttggaggtcttgctctgctgcccaggcttcagtgtgatggtacaatctcggctcatttcagccttgacctcctggactcacatgatccgcccaacctcagcctcctgagtagctggaaccacacgtgtgcaccaccatgcctggctaacttttgtgttttttgtagggacagggtttcatcatgttgcccaggctggtcttgaactcctgggctcaagcgatcttcctgcctcagcctcccaaagtgctgggattacaggcatgagccaccgcgcctggctaaattgtatactttaaagtggtgaattacacacaatttgagtgtttgagtttgagaccaacctgggcaaaatggcaaacccccctctatttttttttttttttttttttttttgtgacggagtctctctgtcgcccaggctggagtatagtggcatgatctcagctcactgtaacctctgcctcctgggttcaagcaattctctgcctcagcctcctgagtagctgggatcacaggtgcccgccaccatgcgcggctacttctttttattttattttattttatttttgtatttttagtagagacagggtttcaccatcttggccaggctggtcttgaactcctgacctcatgatccaccagccttggcctcccaaagtgttgggattacaggtgtgagccactgagccgtcttttttttttttttttttttttttttttttagagacagagtcttgctctgttgcccgggctggagtgcagtggcgtgatctcggctcactgcaatctctgcctcctgggttcaagcgattctcctgcctcagcctcctgagtagctgggattacaggcgtgtgccactacacccagctaatttttgtatttttagtagagatgaggtttcaccgtactggccaggatggtcttgatctcttgacctcttgatctgcccacctcggcctcccaaagtgctgcgattacaggtgtgagcccggtcaataagtagcatttaaatgaccaaagggaaataacaaaaactcttccttcccttttttctcctctcttccccacctcctccaacaagtatttattaaacacatattatgtgccaggcagtgttctaagtacaaagaaggctgcaactctccagacagactgaaatgtctccctttatggagctcacattgtactggggcaacccagaaaataaatcaacaaataaaaatatgacactatgattggtggcaataaatgctgtgaagaaaagtagagggtaggcggggcatagtggctcatgcctgtaatctcagcactttgggaggctgaagtaggaggatcacttgaggccaagagttcaagcccagcctgggcaacatagcaagaccccatctctaaaaaaaaaaaattagccaggcgtggtggtgtgcgcctgtagtcccagccacttgggaggctgaggcaggaggatcactttagctagagaggtcgaggctccagtgagctgcgatcacaccactgcacttcagcctgggcaacagagtgagaccctgtctcaacaaatagaaaaacgtacaattcaatgactttgccatgtgcgtggagctggtcatccatcaccacaatcaattttagaatattttcagccgagcacagtggctcacacccataatcccaacattttgggaggccgaggcaggaggatctcttgagcctaggcgttcgagagcagcctggccaacatggtgagacctcatctctacaaaacatacaaaaattagccaggcacgatagtgtatgcctgtagttccagctacttgggaggctgagatgcgaggattgcttcagtctgggaggtggaggttgcagtgagacgcgttcaccccaccgcactccagcttgggtggcagagactgtctcaaaaacaaaaaactgagtgggccaggcacggtggctcatgcctgcaatcccagcagtttgggaggctgaggcgggtggatcatttgaggtcaggagttcgagaccagtctggccaacatggtgaaaccccgtgtctactaaaaatgcaaaaactatccaggcgtggtggtgcgtgcctgtaatcccagtattcggcaggctgaggcaggagaattgcttggaaccggggggtagaggttgcagtgagccaagagtgcaccactgaactccagccttggcgatagggcaagaccctgtctcaaaaaccaaaaacaaataaaaataaaaataaagaacattatcatcatccaacaagaaactctggacctataagccatcacctcccaatcctcatatcccctcccccctgggccctggtaaccaccaatctccgttctgtttctatggatttttctattttgggcatttcatggaaatggaatctacactatgtggcctcttgtgtctggtttcttcctgagcatcacgttgtcaaggttcaaccacattgtagcatgtgtcagagtctcattcatttttatggtccaataatattttatgttatgtataaactatattttatttattcatcagttgataagcatttggattatttccactctggggcttattatgaatgaagctgctacgaacattgcatgcaagttctttttttttttttttttgagacggagtctcgctctgtcgcccaggctggagtgcagtggagtgaccttggctcactgcaaactccgcctcccgagttcacgccattctcttgcctcagcctcccaattagctgggactacaggcgcccaccaccatacccagctaattttttgtatttttagtagagacggggtttcaccgtgttagccaggatgctctccatctcctgacctcatgatccacccgtcttggcctcccaaagtgctgggattacaggcacgagccaccgcgcccggcctttttcttttcttttctttctttctttctttctttttttttttttttttttttgagacgaagtctcgctcttgtcccccaggctggaatgcaatggcgcagtctcggctcactgcaacctctgcctcctaggttcaagcgattctcctgcctcagcctcctgagtagttggaattacaggcacctgccaccacgcccagctaatttttgtatttttagtagagacggggtttcaccatgttggccaggctggtctcgaactcctgacctcaggtgatccacctgcctcagcttcccgaagtgctgggattacaggcgtgagccactgctctcggccttgcatgcaagttcttgtttctatttttattttttgaggcagggtctcgatctttcgctcaggctggagtgcagtggtgcagtctcagctcactgcagccttgacctcctgggctcaagctatcctcccacctgagcctcctgagtagctgggacgacaagtgcacaccaccacgcccagctaattaaaaaaactttttttttttttcacagacgagatctcactgtgttgcccagactggtttcaaactcccgagctcaagcaattctccctccttggcctcccaaagtgttaggattataggagtgagcctctgcactgggccctgcacacaagttcttacgtggacatatgttttctttgttttttatggagacaggttctcactgttgcccaggctggagtgcagtggcgagatctctgttcactgcaacctctgcctccacaggttcaaacaattctcctgcctcagcctccggagtagctgggaccacagacatgcaccaccacgcccagctaatttttgtatttttagtagagacggggtttcaccatgttggccaggctggtttcaaactcctcacctcagtcaatctacccacctcagcctcccaaagtgctgggattataggcgtgagccaccgtgccagcccgaagtggctttatcttttttcattcttcccagcaatagatgatcctctattgccccacatcttctccagtgattagcatcaacagagatttacttattggagacaaggtcttgctcggttgcccaggctgaagtgtagtgggaagatcatggctcactgcaacctcgaactcctgggcacaagtgatgctcccaccccagcctccctaatagccaccacacccagctaatttttgtagcgataagggtctctggttggtctcgaatgcctgggctcaagcgatcttcctgcctcagcctcccaaagtgctgggattacaggcatgagccactgtgcctggccagtttttttctaaagctattttgataggtgcctactggtgtttcactgtagtattaatttgcatttccctaacagctaatggtgtttgagcatcttttcatgtgctcattagccatcatatatattccttttttttttttttttttttttttgagatggagtttcactcttatttcccaggctggagtgcaatggcgcgatctcagctcactgtaacctccacctcccaggttcaagtgattctcctgcctcagcctccctagtagctgggattacaggcatgtgccaccatgcctggtttttgcatttttttttttttttagtagatcgggggtttctccatgttggtcaggctggtctcgaactcccaatctcaggtgatccgcccaactcggcctcccaaagtgctgggattacaggcatgagccaccgcacccggccatatattcctttttgtttgttctattacttgccactgacttgaagctcacaaatatattatttggtaaagtgttgaaatatttttcctcttttgaattggattgttttcttatcattgagatttgagagttttttttttttttttttgagacagagtctcgctctgtcacctaggctggagtgcagtggcgcgatctcagctgcctcccaggttcacgccattctcctgcctcagcctcccgagtagctgggactacaggcgcccaccaccacgcccggctaattttttgtatttttagtagagacggggtttcaccgtgttagccaggatggtctcgatctcctgaccttgtgatccacccgcctcggcctcccaaagtgctgggattacaggcgtgagccaccgtgcccggccgagagttctttatatgatgtgagtacagatccttgatcagatacttgttttgcaaatattttctcccaatctatggcttgtcttttcattttcatatcagcgtcttctcagagtatgttttattattattattatattattattattattattattattattagagatgaagtctcgctctgtcgcccaggctggagtgtagtggtgccatcttggcttactgcaacctccgcctcctgggttcaagcgattctcctgcctcaacctcccgagtagctgggattacaggtgcccgccaccatgcctggctaatttttgaattattagtagagacggggttttgccatgtgggccaggctggtctcgaacccctgacctcaggagatccacctgcctcggcctcccaaagtgcagggattacaggcgtgagccactgtgaccagccttgattttgcttatgtttttctttctccttataccttgacattgtcccatcttggaactttaaacaaataagtttctggtttttttaaatagttccgtggtatttcataacataggatatacaataattcttgcttaaccagtttcctagtgactgatattaatgttcaatcttttgcctatgtatatacaatgtaaactttaaacacaatgccttgtacatgcagtacttggcattgaacacacttacctctaggacaaatatctggacaaagaattgcttggtcagagtctgtacatttgtaattttgatatgtaatggctacatttccctctatagaaattgtggaagcttgttctctgagccgggggtgtggttaacacctgaaatcccagcactttgggaggtcgaggcaggcggatcacttgaggccagcaataggagaccagactggcctacatgaccccatatctactaaaaatacaaaaattagctgggcatggtggtgcgcgcctgtggtcccaactactcggaaggctgaggcatgagaattgcttgaactggggaggcagaggttgtagtgagccaagatcgtaccaatgcactccagtctgggcaacagagcgagaccctgtctcaaaataaaatgaaaaaagaattatttgcagtcaggcacggtggctcatgcctgtaatcccagcacttgggaggccaaggcaagtggatagcttaagcccaggagttcaagaccagcctgggcaacatggcaaaatcctatctctacaaaaaaaaaaaattagccaggcgtggtcgtgcatgcctgtagtcccagctacttgggaggctgaggcaggagaatcgcttgaaccctggaggtggaggttgcagtgagccgagatcactccattgcactccagcctaggcaacaagagcaaaactctgtctcaaaaataaaaaataaaagaaaaaacagaagaaaataccaagtgtggcaaggatgttgagaaaatggggcccttgtgcactgttggtgagcatgtagaatggtacagctgctatggaaaacagtttggcagttcctcaaaaaattaaagatagaattaccatattaactcagcagttccacttccaggaatatgcccaaaagaactaaatactaggtgggggcactctgacagatatttgtacaccaatgttcatagccacattatttgcaatgaccaaaagctgaaactatccaaatatctgccgttcatgaatgaatggataaacaaattatgctatattcatacaatggaatattattcagctgtaaaaaggaaggaaattcgtccgggtgcagtggctcatgcctgtaatcccagcactctgggaggccgaggcgggcggatcacctgaggtcaggagttcaagaccagcctggccaaaatggccaaaccccgtctctactaaaaatacaaaaattagccgggcctggtggtgcgcgcctgtagtcccagctgcttgggaagctgaggcatgagaatggctggaacccaggaggcggaggttgcagtgagtggagattgcgccactgcactccagcctgggcgacagagccagactgtctcaaacaaacaaacaaaaggccaggcacagtggcttacgcctgtaatcccagcactttgggaggctgaggcaggcagatcacgaggtgaagagattgagatcatcctgaccaacatggtgaaaccctgtctctactaaaaatacaaaaattagctgggcatgctggcgtgcgcctgtagtcacagctattcgggaagctgaggcaggagaatcacttgaacccgggaggtggaggttgcagtgagctgagatcgcgccactgcactccagcctggaaacacagcaagactccgtctcaaacaaacaaaaaacaccacacacaggaatagctaaaatagggtgcagccacttcctctagggctgaagccaaactcccaagaaagaaagaaattgggaagaaggacttccctgcccaaccggctccccacacaagattagagtttcgctgcagaggtatggtcatgacccactgggtgactgagaagttcactgaagtgcaacaggccactgaaatttgctagggggaggggtaaacgtcactgcgtgtctagtgcagggctggcccctgtccatcacaagatcccgctaagaggagcccgtgagaatcaggaagagccccatcctcattcagtgttcctccagcgccctctgctgacaaggtttaacactgagctagctggcagaggagaaatgtttacagggtccagctccaatatcacaaaaacggcagagaggcatgaagttggagccaccagcctgtaaactgataactggtacaaggtggttgttagaatgaaatccagtgaatggattggatgtggtggcttacgcctgtaatcccagcactttgggaggccaaggcaggaggatcgctagaggccaggagctccagaccagcctgggcaacacagtgagaccccatctctacaaaaattttaaaaattaggtgggcgcaggctgggcatggtggctcatgcctataatcccagcactttgggaggccaaggcaggtggatcacctgaggtcaggagtttgagaccaacctggccaacatggcaaaaccccatctctactaaaaatacaaaaactagccaggcgtggtggcacacttctagtcccagctacttgggaggctgaggcaggagaattgcttgaatccaggaggcagaggtttcagtgagccgagatagagccactgcactccagcctgggcaacagagtgagactccttctcaaaaaaaaaaaaaaaaaaaaaaaagctgggtacatgtggtctagctactccagaggctgaggtgggaggatcacttgagcctgggagttggaggctgaagctgaagtaagctgtgactgcaacagtgcacaccagcccaggtcacagagcggaatcctgtctcaaaaagaattaaatgcaatgaatactaacagaaagtaattttgaacgtaattgtttctcttctgaacagcctgtggtctcctgaaattcaaaactgtgaattgggtccttgatgaggtccctttccactaggtaacattctgtggctccccacagaaataaagaggtgaacctcagccgggcgcagtggcttactcctgtaatcccagcactttgggaggctgaggcaggtggatcactggaggtcaagagttcgagaccagcctggctaacatggtgaaatcccatctctactaaaaataccaaaaattagccaggcgtggtggtgcatgcctgtaaccccagctactagggaggctgaggcaggagaatcacttgaaaccgggaggcggaggttgcagtgagccaagatcgcgccattgcactccagcttgggcaacaagagcaaaactccgtctcaaaaagaaaaaaagtgggggtaggggggagggatagcattaggagatatacctaatgttaaatgatgagttaatgggtgcagcacaccaacatggcacatgtatacatatgtaactaacctgcacgttgtgcacatgtaccctaaaacttaaagtataataaaaaaaggggtgaccctcaaaagtgggcagtgaaaagtgaaaagagcagagatttttatgtccagacacctgggttcaattccagctttctccatgtattaaaggagtgcctgctgggcatgatgcctctgctcccagcaccttgggaggctgaggcaggaggattgcttgagcccaggagttcaagaccagcctgggcaacatagtgggaccgtatgtcttctaaaaataaaaataagaaattagccaggtgtggttgtgtgcacctgtggtctcagctactcgggaggctgaggcaggaggatctcttaagcccgggatttcaaggctgcagtgagctgtgatcacaccactgcactccagcctgggtgacagagcaagattctgtccccaaaaaaataaataagtaaagcaattctggctgtactaatagatcagcctcagaatttcagcggctgaagccaagtttgtttctttttcctataaactgtagttggtgcaggaagggtggaaggaagttggtggggggatatccatgcattcccagacatttggttccttccatcttatggctctgccatccccgggagtcccagattctcccctggagtctctgtatccagaagcagagagggagtggagagtcacgtggcgtgcgtttatgggccaggcctggaaatagccgcacatcacatcgccgccacctacacttccttggccagacccagtctcttggccccacacatagcagcaggggagaagagaaaaggtcatcacgccatattcccagcagaaaaatgaaatggggttgggtggacagctcaccagtctctgccctgcaccactttcctagctttgtccccttggacgagcgacatggtttctgtaaggctcagtttctggctccgaaaatgaggttaagcaaccttgccttctctgccagctgtaaggaatcagtgtgataaaataggtggtaaattgctcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccaggcgtggtggtgggcgcttgtaatgctagctactcggctgaggctgaggcaggagaattgcttgagcctgggaggtggaggttgcagtgagccgagatcgcgccattgcactccagcgtgggcaacagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaaggccttcttcagctccaaggccaaggttgggaggaggggtgtgtgtcagttgggaggggctgcatgggtgtatggggtaatggggggacggagcataactcattgattcattcagcacctatttgttaaacacctactatgtgcctgactctgatctagcacagtggtcaatatacacacagaaatgcctgccctttggcagggagtgatggctcatgcctgtagtcccagcactttgggaggctgaggcgggaggatcactttgggccaggagtttgagaccagcttgggcaacatagtcagaccacatcattacaagaaattttaaaaatcagtcagacgtggtggcacacacttgtagtcccagctacttggaatgctgaggtgggaggatcacttgagcccagcaggtcaaggctgcactgagctgaaatcaccttactgcactccatcctaggcaacagggcaagactgtctcaaaaaaaaaaaaaaaaaaaaaaaaaaaaagccggtgctggcatggtggctcacgcctgtaatcccagcactttgggaggcagaggcaggcagatcacttgaggccaggagttcaataccagcctggccaacatggtgaaaccatgtctctactaaaaatacaaaaattagtcggatctggtggtgggtgcctgtaatcccagctactcaggaggctaaggcaggagaattgctggaacctgggaggtggaggttgcagtgagctgagatggcaccactgcactccagcctgggagacagaccaagatttcatctcaaaaaaaaaaaaaaaaattacagccaggcgcagtggctcacgtttgtactcccagcactttgggaagccaaggtgggcagatcacctgaggtcaggagtttgagaccatcctgaccaacatggagaaaacctgtctctactaaaaatacaaagttagctgggcgtggtggcacatgcctgtaatcccagctacttgggaggctgaggcaggagaatcgcttgaacccaggaggcggaggttgtggtgagccgagatcgcgccattgcactccagcctgggcaacaaaagcaaaactccgtctcaaaaaaaaaacccccatatattatactacatattataataatttaatagtattacaatatactttaattatatttaatatttatatgtttaacatataataacataatacaatataatataatacataaaatgtctgatgggataaatttacattggggggagagggctggagatagagttagaggtgggtgtggggctgcaattataaataaggaggtcaagggggcccccagtgagtaaaaacccgggaggtgatggtgggagccacagaggtttctagaggaagagcatttcaggcaagagggaaaagcaggtgcaaaggccctgaggtgggtgtatctgaggtgcaagagggaggtcggtgtggccggagccaagtgagcaagtggggaaaggagtggagatgaggtccgggtggggaggcaacaggggccaaaatgtgcagggccgcgtgggcccggtgcggacttgagctctgaccgagtgacgaggcagcgcggcagggatcgcagcagaggaggagcccgagcgggcttaggcttcaccggcgccctctggcggtcagatggggaccgactgtcgagagagcagaagccgggaagcccgagaggcggcgctggccggggtccaggggaggggacggtggctggactagggtggtggtcacggaggtattttgaaggtgagaccgggaggatttgctgacagactggatgtgggtgtgagagaaggggatgagtcaagggtgactccaaggtttcggcggaagcaactgtcagggtggggcaactgggaaggggaggagggaggggagcaggcgggggaggaagacacgggctctgcggcggcccatcccacgtccagcagaggctgccggtgggcacagaaatgcacccatcgggatctgaggggagagacttgggctgacacgtccatttgcaattccttggcacatatattctgtaattaatcgaagctccaggactgggtgatatcgccaaggaattgagcgtggacagagcagagagggggggctgcaatcaggaagtccccaagaccaccctcaggctcaacgacttagcaaaactcatagtgttcagcaaagctgctggactcccgggttatagtcaattacaatgaaagcaaacgtgaaaatcaggcaagggggccgggcgcggtggctcacgcctgaaatcccagcactttcagaggccaaggtgagcagttgattgagcccaggagttcaagaccagctgggcaacttagaaacacccatctctacaaaaaagtttaaaaattcgtcacgtgtagtggcatacacctgtagtcccagctacttgggaggctgaggtaggaagatcacttgagcctgggagtttcaggctgcagtgagccatgattgtgccacaggcactccagcctcaaggacagaacaagaccttgtttcttttcttttttctttttctttcttttttctttttttgagacagagtttccctcttgttgcccaggctggagtgcaatggcacgatcttggctcactgcaacctctgcccctctgcctccagggttcaagcgattctcttgcctcagcctcccaaatagctgggattacaggcgcccaccaccatgcccagctaattttttgtattttcagtagagacggggtttcaccatgttgaccaggctggtctcgaacacctgacctcaggtgatccacccgccttagcctcccaaagtgttgggattacaggtgtgagccacagtgcctggccgacaagaccttgtttctaaaaaataagactaggctgggcatggtggctcatgcctgtaatcccagcacttggggaggccgaagcagatggatcacttgaggccgggagtttgagaccagcctggccaacatggtgaaaacccgtctctactaaaaatacaaaaattagccaggcatggtggcacccacctgtagtcccagctactcgggaggctgaggcaggagaattgcttgaacctgggaggcagaggttgcagtgagctgagatcgtgccactgcactccagcctgggagacacagcgagacttcgtctaaaacaaaacaaaacaaaacaaaaaaatccaagggattaggaaatacctctcaggacctaggggcaagggccaggcctttctctgggcagaaaggaatcctctacagcacaggaatcaggaaggagccctggaaagcaccaatgttattacaagacctcacaccagcagccacgtttctctaagtctgttttcatttagtttttggtggatctgggggtgttttgttttgttttttggtttatttgtttttgaggcagggtctcgttctgtcatgtaggctggagtgcagtggtgtgatcacagctcactgcagcctcgacctcccgggctcaagtgatcctcctgccttagcctcccgagtagctgggaccacgggcacgcaccaccacatcagctaatttttgtattctttgtagaatgggggtctcattatgttgtccaggctggtctcaaactcctgggttcaagttatcctcctgtctcgtcctcccaaagtgctgggattacagacatgagccaccgcagctggccaagtgttctttctcagcctccctccctttatgcctttgtcattccctcaagcaatttccagaacctcctgtgtgtggggctctgggctaaggctctaggaacgtgtaagaccttgcctgtcctcaaggggttcctcaatctgtgagtaaccaacatggtaaaaccccatctctactaaacatacaaaaattatcctgatgtggtggcacgctcctgtagtcccagctactcaggaggctgacacaggagaatcgcctgaacccaggaggcagaggttgcaatgagctgagatggcgccactgcactccagcctgggcgaaacagagtcagactccatcgcaaaaaaaaaagagtctgccctgagtccttcctgcttcagggtcagaagagaggggtctccagggcaggaggcctcaggggctggggtcttgcctgtgtctgacgccttctcccctctcctcaccatccgcacacaggtgatctacatgggccgcaacccccgggacgttgtggtctccctctatcattactccaagatcgccgggcagttaaaggacccgggcacacccgaccagttcctgagggacttcctcaaaggcgaaggtggggacagggtaaagcggggcaggaggggtggggaggagccccagaggaccctgatgggcagagggacagaggaggggtaagaaagggagagagacagagacacagggcatcaaaaggggcaatagagacagagagcaggtggccaggagaagaagagacggagggagagaggctgagagaccgaaagacacaggacaggcaaaggacagaggagacagagacagggagagacacagatacaaaaagactgagagagagggcaacaaaagagacaggggcccggcacggtggctcatgcgtgtaatcccagcactttgggaggctgaggcaggcggatcacaaggtcaggagattgagaccatcctggctaacatggtgaaaccccgtctctactaaaaatacaaaaaattagccgggtgtggtggcggtgcctgtagtcccagctacttgggaggctgagacaggagaatggcttgaacttgggaggtggagcttgcagtgagccaagatcgtgccactgcactccagcctgggcgacagagtgagactccgtctcaaaaaaaataaaaaataaaaagagataaggaaataaatgcagaaagagagatggagtcagagagagacagggagagacaaggaaacaggaggagacaggcccctggtactaagaaaggcagcgccctttggccacgtgttcctttctctgctgctgtcagagaccctggctttggagggaaatccaggtgtgtggaggcggactggatggacagatagacaaaggccccccaagatgggcaaccaggggagaagcaggttggaagagccccagaacttggtggaaatgtgggggctctgggggagggcatccagctctgggggctggacctgggggtttgtggggcacagctagttagacccatgagccccagtggggctgggggaaccccgccactcagccctcaccccacttgtccctctgcccacagtgcagtttggctcctggttcgaccacattaagggctggcttcggatgaagggcaaagacaacttcctatttatcacctacgaggagctgcagcaggtgagtccccacctcctccaggtgcagcgtcccccccataccctctgctcacaccccacactctccccttcccgagggtctcaggacccctccgcttccccatgcaatgcgccagcccctggggatactgcaggaacagaacagaggccctgagcctgtgagcaagaccacagacaaaatccctaaaccacacagcaggctggcggggcagaggagctaaggagcaaaggcgagtgggaaggaagataaggaatggtcaggggcgagatttaacccaggagggttggccggacacagtggtagtggctcacacctgtaatcctaatgctttgggagcctgaggcgggaggaccccttgagcccaagaggtcaaggccacaatgagctatgatggtgccactgtactccggcctgggcagcagagcaaaaccctgtctcaaaagagagagagaaggccaggtgtggtggttcacacctgtaatcccagcactttgggagcccaaggcaggtggatcacttcaggtcaggagttcaagaccagcctggccaacatggtgaaaccccatctctactaaaaatacaaaaattagccgggcacagtggcacatgcctgtagtcccagctgctcaggaggctaaggcaggagaatggcttgaacctgggaggtggaggttgcagtgggctgagatcacaccactgcactccagcctgggcgacagagcaagaccttgttccaaaaaatagaaagaaaaaagattgaaccacatgaaatgcctgtattcaaccagtttttatttatttttatttattttatttaattaatttatttatttttgagacagagtttcgctcttgtggcccaggatggagtgcaatggcatgatctcggctcaccgcaacctccaactcccacgttcaagcaattctcctgcctcagcctcccaagcagctgggattacaggcatgcgccaccacgcccggctaattttgcatttttagtagagacggggtttctccatgttggtcaggctggtcttgaactcctgacctcaggtgatccacccacctcggcctcccaaagtttttatatttggaccagttatatatttatataactggtcggccccgccaactagtttttattttaagatggtaattttggctgggcacggtggctcacgcctgtaatcccaacactttgggaggccgaggtaggcagatcacctgagctcaggagttccagaccagccttgccaacatggtgaaaccccgtctctgctaaaaatacaaaaaaattaggcggccatggtggcgggcgcctgtagccccagctactcgggaggctgaggcaggagaatcgcttgaacctgggagctggaggttgcggtgagccaagatcgcaccattgcactccagctgggttatagagcaagactctgtctccagaaaaacaaaaacaaaaacaaaaaggtaattttatatggttttcccaaatgttgttattatccctattttatcgacgaggaaactggaggtttgtaacttaagagagggttgataatttgcccagggcacatggctcttgcctgcagactccatgtttattttttcccaacctggtaactttcttttaatggaaagctccagaagaggtgtcggtgctactcctccccctcttttccagcaagcattcttctccaaacccagaactgggccacagagcctaacagcttctgggctgcccctgggtgtgaggcgccgcccacatgttagaatttctgggacacgtcagtggttcaagaaggtaaagagatggaaggttatgaaaccaggagtgacctggaaaatcggagccatggggttggcggagctgaccagagggctgaccatgctgggtgctgcatatcagaaggtagtgatggccgggcatggtggctcatgcctgtaatcccagcactttgggaggccgaggcaggcagatcacttgaggtcaggagttcgagatcagcctggccaacgtggtgaaatcctgtctctattaaaaatacaaaaattagccaggcatggtggtgcatgcctataatcccagctactttggaggctgaggcaggagaatcactggaacccaggaggtggaggttgcagtaagctgagatagcaccactgcactccagcctgggtgacagagccaggcttagtctcattgtaatcccagcactttgggaggccgaagtgagcagatcacccgagggtgggagttcgagactaccctgaccaacatggagaaaccctgtctttactaaaaatacaaaattagccaggcgtggtggcacatgcctgtaatcccagctactcgggaagctgaggcaggagaatcgcttgaacccgggaggcagaggttgcggtgagacgagatcatgccattgcactccagcctggacaaaaagagtgaaactccgtctaaaaaaaaaaggcagaggggcacggggaggactaagggctccagggacctgagctcctctctggctgtgtggccttggacaagtgtctctccctctctgggcctctgtttaccaattgagataatgacacttcccttgcaaagctgatggtgggatcggcacaaatgtatggggggcttggatcagagcttggtacatagtagacactcggaaaggaaggtgatatttgagctgtagccgtggcaatgggcccttctggaagccccatgccaaggcccagagggaggaatgtgtagggaatggtgagtcccagaaggagagggtgggaaaggtattggaagagctgtgaccagaccacatctgttttttgggtttttttttgttgtttttttttttttttttgagatggagtctcactctgccacccaggctgtagtatagtggtgagatctcggctcactgcaacctccacctcccagttcaaacgattctcctgcctcagtctcccgagcacctgggattacaggtgcccgccaccacacccagctaatttttgtattgttagtagaaacagggttttaccatgttggccagactggtctcgaactcccgacacctgtctcagcctcccaaagtgctgggattacaggcatgagccactgcacctgccccacatctgtgcttgaaagccgggtctgggtctgggactgtgtcccagggcactcgggagccacggaagagttgggagccagtgaggagcagggtcagctggggtgtgggggatgagctggagggggatggagactggaggcaggaaggctgtggagcagccggctgctggggcatggatccaggaaggggaggatgaggcctaagcagttctaggctacagggacacagaggaggggatatggcaaggggaggcaggtggggagggacagggctcatgacggacaggttttgggggtgaggggtacccagagagggaggccaggctcctgggtggatggtggggccatcctgcaatgggggcctgggggaggagcaggtttgagatgtagaccagccaatgcctgtctctaacctgaaggagggtgattccaggtaaggtgatgcactgacctctgcccccggatgtgacctctgccccccactgtgacctctgcccccggctgtgacctctgcccccggctgtgacctctgccccctgctgtgacctctgccccaagcccacctattccctcccacctagagaaccctccaaagacagaaactgcaaaaacccttagaggcgatatagcccaacccctcagtttggagttggggaaactgaggcaaagaggcagcgtccctcaggcagccccaggttaggacccagacatgcggatcccaggttccacgctccttccttggccgagtgccctccctccgctgacccctctcccctgcctgcaggacttacagggctccgtggagcgcatctgtgggttcctgggccgtccgctgggcaaggaggcactgggctccgtcgtggcacactcaaccttcagcgccatgaaggccaacaccatgtccaactacacgctgctgcctcccagcctgctggaccaccgtcgcggggccttcctccggaaaggtgcgggggttctggggttcagagcccactaggccactgcccggctgtgtgacctgggagagttacttaacctctctgggcctcagtttctcacccagctgtaacattgggtgaacagggtcactgtggccccagggttgatcacgcacggggcttagcactgactcagcacacgtgccagccacccgaggcgtccccatccagagaactcccaacgacagcaaaacatccaggagtactgccaacgccaggtttacccgagagagatttagagtcttcatgagtcctcctcgacggccatgttcacggcagaaatactcaagccctgggttacggggcgcaggcggtagcatagttgtttcctcttcctgctgtaacaaaaacaccgcaaactccatgactcaaaacacgtttactcttttttttttttttttttgaaagagtctcgctctgtcgcccaggctggctggaggttgcagtggcgtgatctcggctcactgcgacctccacctcccaggttcaagcgattctccttcctcagcatccttaagtagctgagactacaggcacctgaaaccatgtcaggttaatttttgtatttttagtagagatggagtttcaccatgttggtcaggatggtctcaatctcctgaccttgtgatccacccgcctcggcctcccaaagtgctgggattacaggcgtgagccaccgcgcccggccttttcttttttcttttttttttttttttgagacggagtttcactcttgttgcccaggctggagtgcaatggcgcgatctcggctcactgcaacctccgcctcccaggttcaagcaattctcctgcctcagcctcccaagtagctgtgactataggcacccaccaccacgcctggctaattttttgtatttctagtagagacaggttttcaccgtgttagccaggatggtctcgatctcctgaccacccgcctcttcctcccaaagtgctgggattataggtgtgagccactgcgcccggccaagtgaagcatcttctaatctctgaccctcctcccttctatagggacccaggtgatgacactgagcccacccagatacttcagggtcctctccccatctccagatctttagcttaatcctatctgcaaaatcccttttgccacataaggtcacatattcacaggttccaaggattaggacgtggatatggagggagtctttattcagcccaccccagggaacccctccccacaacctcattaagggtgctgggtaacatggggcacgtgcacttgccaaaaggcaaactacggtcctctgaatgccatgagccccaggtttccaggtgaggggtgatgcccctgtgatagccccacaatgagaaaactgaggcttgggaggggtgccgtggctcacacctgtaatcccagcactttgggaggccgaggcaggtggaccacctgaggtcaggagtttgagaccagcctggccaacatggttaaacgccatctctactaaaaatataaaaattagccgggcgtggtggtgcgtgcctgtaatcccagttactcgggaggctgaggcaggagaatcgcttgaatcggaggttgcagtgagccgtgatcacaccactgcactccagcctgggcgacagagcgagactccatctcaaaaagaaaaaaaatggaaaactgaggcttggagggttcctgaggctcgcttgctgcgccaatcagcaaattgtttgcaagccctgagcacagagcctgcagaagggggtcccttccatgtccaagcagtaatggctgcagcatggagcgttgtgggggcattgagacaggaggccttgttctagcaggggaggtttgggactggtcgcagaggaggtgacacaagctgtaaggtgggcaggaattcagggttggaggcagaggttctgggcagagacttaaagggtccgggataaaggggaggactggcaggaatcctgcagtagcagaggcagtgagggcggaggtgagaacggcgccaggtgacaggccaagactctgccaccataggacacaaagggggcaatgtggagggtagggaggacggtgtttctggcaaagggaacacctcgccaaaggccgggaaggggaaggaggttgctggaatgttggaggtaggggcgcagtgctccccagaggctcctcaccccctggtgccccctcttctccaggggtctgtggcgactggaagaaccacttcacggtggcccagagcgaagccttcgatcgtgcctaccgcaagcagatgcgggggatgccgaccttcccctgggatgaagacccggaggaggacggcagcccagatcctgagcccagccctgagcctgagcccaagcccagccttgagcccaacaccagcctggagcgtgagcccagacccaactccagccccagccccagccccggccaggcctctgagaccccgcacccacgaccctcataataaacacgtcgattctgtccaggttccttgatgcgctgtggcagggcaggcagcggggcgtggagaatcctcaccacaccaaggcttccagaggccggggtccccgactcagagtcccgcccagaggcaaaggtgctgcaggaacccagcgctgggcatctcacttcccggggtgggggcctgactccccagtctgagggaggagggggctgggggcctggactcctgggtctgagggaggaggggctgggagtctggactgccgggtctgagggaggagagggctgggggtctggactcccgggtttgaggaaggaggggctgggaggctgcactcccgggtctgagggaggagggtctggaggcttggacccctcagtctgagggaggaggggttgggggcctggactcccgggtctgagggagtagtatctgggggcctggagtctcgagtctgagggaggaggagctgggggcctggacccctgggtctgagggaggagggggctgggttgtggactcttggattcagagccagtctttagtaacgcacgtttttggcataaagtggttttattccgagcagaggtaaacgggagctccggcagacccgccctctcagcgcccacagaaagtcccaccacccaccctgttcccctgtggctgtaccacattccactccctcagtattcagctccttgcctcagtttccccacagctcctgaacacagtgtgcctggcagcgactccccatcttcccctccacagctctagcagctctagctcggggcctcacccgggcccctcatcaggaaggcctgaccctcgggagctgtgtgtgtcttctttaggatccgctgcctggggacgctgccagcccatcttctgggttgtgacactgaggtctggtgcaggcaatgggcttgcccaagtccttttttttgtttgagatgaaatctcgctctgtcacccaggctggagtgcagtggcgtgatctcagctcactgcaacctccgcctcccgggttcaagcaattctcccgtctcagcctcctaagtagctgggattacaggcgcccgccaccacacctggctaatttttgtatttagtagagatggggtttcaccatgttggtcaggttggtcttgaactcctgacctcaggtgatccacatgcctcagcctcccaaagtgctgggattacaggagtgagccacctcgatcagcctttctttttcttttttcttttttttttttttttaaagagatggcctctcactgtgttgcccaggctggagtgcaagggcatgatcttggctcactgctgcctccacctcctgagctcgagggatcctcccacctcagcctcctgcgtagctgggaccacaggcgtgcgccaccacacccaactaatttgtttttttaattgtagagatggggtctcactatgttgcccaggctggtctccaactcctggccttaagcaaccctcccaccttagcctcccaaagtgcagggattacaggcatgagccaccactcccggcccaagttgcagaacaagtgacaaacatcccttctgcttgacagacgccgaggccagaagccttgtccaaggcagggcattgaggcagagggctctgagccgacagttgtccggcactgctccttgggtgggccagcagatttggcttgggctcctgttcagggttgccccccaagtcctgcccggggggcccagtctgacggcctgacgcctctgggctcttgaagtttgaatgtagcatccccaccgaaccgccttcgggctggggacagatagcggaggcggtgggcggggggcaggggcagggcaccgccccacggaggtcgggagtccacttccccccaggggcctcctccagtgccccgctgcctcatcagagccttggctggagtgtccttggagccccaggatttcttgagctgtggagggaaagagagggaggtgagaggaggctggggtggggccctgggggcat

SEQ ID NO: 12398 - DNA, 9454 bp, Human
aaagggtagcatagattggcagggttgggagttgggggcaggctgggcaaactggagtgagcaaggcctacttatattttaatactttaaagttatttttattaaactgtctgctgtccaaacataatacatgttgtaggccaaaatggccatgaagctaccagtttgcaaaccctgaactgtgaaatcttttagccacttccctatcttctctgttggagccatcattagtacttaaaaaagtacctttgagtcagggagttctattctactctgtgtttgtgagaaatacggccctgcccctctgggccacagtttcctcatatgtaaaatggggccactcatgtccacttcccaaccccagtgccttgtggtgagactgttgctccggggatgacggtcccgcccctcctttcaggaacaggcctttgagagcagccagaagtacaaagaggggaagtacatcattgaactcaaccacatgatcaaagacaacggctgggactgacccccgctcccccgacgcatgtggctccagcccggcctggccgccagggagcgccactggcttcccgccacccgaagggagctctggaccctcagagcccctgcagaggacggatctagctcctgtatatatattttattgcatgcactgtgaccttggggggagaacagaagggggacgacgcccccgcacctcctgcgatctggctggcttggatctcgtttttaacccgttcctgccccacctgccctatagttatggcctgtgttctgctctcctggtcccagtgcaccgtctgctctgtgaactcctcccaccaggcccttcttaccccacgcgtgtctgtccccctcgttctgtagcgtttgtacataataaaacaatggagtggagacagctcaggctcgcgtgtaatccgggaagggggagctcaagcggagatttccgcccctatagacctgtgcggttctgagccccggcggggcatggggtaggcacagccgtccaagctgggtctccgggaaccgggacggtttcactgctggcggaggtcctgagcccactctggctgcctacgccgtgacctcggctgatctgcgtctgctcatctgcagcgtttggccgccgcctaggggcagcgtcccagggaggcaaccgcgccgccggcctcgcagccccctcgcggtcggactgcaactcccagcggcccccgcgtggtccgtccggctccttcgggcgcgcctcagcgctgagcctgccgggaagtgtagttccgagggttccccagcgcgggaccttcgggaaaccctggcgcgaggcgtcagaagctgtcggactgtgagcgccttcgaactttggaggcttggctcgggatggaggtttttttagcatggggaccagggaggactacggtgctcgggactgggctgcggcctcctcgcggccccgagtgccctgtgaaatcagctcaggccgcgtccctctagcctgcactttccctctgttcacgctgcttccctccagggcccggcctccaagtgaaggggggcggagggcggtcacctgccagaaggtctggggcgccaaggtgtgtcccgggactcttggctccgtccaggttccaggccccgccccccagcttatccctagccggggctccccaccgtgggaacggggaccagctggccggaagcgccaaactgcgtccctgtccgagccctggggatcaatcaagccgaggagttaattatgtaatgagggggcagggggtcgaggctaatgaagcctcccggggtggggagggaggggaggaggggaccgtacccaggtatccgaccccctctcggaccccttcgaggccccaggggtctccaccccagcccaactccagggccccaaagaggggaggggctgtgatcctggatctggaaggggctgagctgtgagctataaagggggcatctcgcagcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccggtgagcgttgggaccagctcctgggtaggagaataggggggctgtggccctcggctggctcctcattcttccccggcttccagaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggtgaggggctggccagggtccgtgtttctggtgggggtctcttgggaaaggcagagtccctggggagggggctaggactgggtggttcccgaggggctagagctctgcctaggcctagaatctgactatggcctggggcaagggttactctgtggcaggaatcaggagtcactctgtgacaagggttaagggccagtctgtggagtctgtggctgagtttagggaccaatctatggcaagggtcatgggtcagtctggggcagggtcaggaagtccctctgggttataggttagtgtgtggcttagaccagcatccagacaaggacagggggtcaagggccagcccattgaccagcatcagggaaatctggccaggattcgggatcagtatgcaactcgaataggagtcagtatatgactaggtccagggtcaccctagaggcagggacacggtcagtgtttgaccttagatgaggtctttatctggggcaggaactcaagccctagcatggaaagtcctcggccctactgcaggcagggtatattttttctaaagcaaattcatctaagagctgcagattctggtgctggagatcaggggaggagaggagggtggggacaggaagctcctagcaagaaagttagtcacccctgcttctgcaaataggctttgaggggtaggagtcatggctctgttcctaacctgctgtgtgacagatcacttaacccgtctgtcctgtttccccaaatgtaaaatgagacaagaaaaccttccagctctaagattccgccctctggcttctttttttttttttttttttttttgagatggagtctcgctctgttgcccaggctagagtgtagtggcacgatctcgtcagctcaccgcaacctctgcttcctggattcaagcgattctcctgcctcagcctcccgagtagctgggactataggcacacaccaccacacccggctaatttttgtagttttagtagagacggtgtttcaccatattggccaggctggtctcaaacttctgacctcatgatccttccacctcggcttcctaaagtgctgagattacaggcatgagccactgcgcctggccctttttcatttttcagagacagtgtcttgccctgttgcccaggctggagtgcagtggtgcaattgtggctcactgtagtcttgacttcccaggctcaagtgaccctcccgcctcagcctctgtagtaactgggactatcagtgtgcaccaccatgcctggctaattttttaatttttttgtagagatggggtctttctatgttgcccaggctggtcttgaattcctgactcaagagatcctcccaccttggcctcccaaagtatagggattagaggtgtgagccacagcctccagcctgccctctgggttctaattccacctcctttgatgtttctctgacagctctggggagcccgttgttatgtcccgttactggtgctgggcccacccctggccagtgggtagctccaggcctctcctgtcccctcccttgcacaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacgtgaggcccaggctgggactccaggatagggttggggggtgctggaagggaggccaagggtgaggcgcagggcagggaatcactcccatttcctccctcccagctgatcctgcactccatgcacaagtaccaaccccgcatacacctagttcgggcagcccagctctgcagccagcactgggggggcatggcctccttccgcttccccgagaccacattcatctccgtgacagcctaccagaacccacaggtgagtgaccctgcttgagggggtggtggccccctgcccagaccgcagttgctttgaccctgcatgtgtgtccccagatcacacaactgaagattgcagccaatccctttgccaaaggcttccgggagaacggcagaaactgtaagaggtgggagttgttcattcatttgttcatgcattcaacaaatgtttattaatcactcactgtgtgccaggcaccgtgctggacatcagaaatgcagtggtaagtgaaaacattcattcactgactcagcaaatacttatatagtacctgctatgtgccagggacagttccaggcactggagataaaacaaacaaagcaaaccaaagccccggccctcatgcagctgatttctagtggggagagtagacaagcagacaagagaaataaataaaatgtcatctgttaggaagccattctaaagagaagagagaccaggtgtggtggctcacgcatgtaatcccagcactctgggaggctgaggcgggcagatcacctgaggccaggagttcgagaccagcctgccaacatggtgaaaccctgtctctgctaaaaatacaaaaattagccaggcatggtggcaaacgcctgtaatcccaactacttgggaggctgaggcaggagaatctcttgaacccaggaggtggaggttgcagtgagtcgagatcatgccattgcattccagcctaggcaacacgagcaaaacttcctctcaaaaaaaaaaaaaaaaagaaagaaaagaaaactctgtctcaaaaaaaaaaaaaaaaagaaaaaaaagaaaaaggagaagagaaataaaccaggaaaagataggaaggactggggtgaggtattagataagaggcctggaaaggcctcagtgggaagaagacacttgagaaagagctgaaggaagtacgggagggagccaggtgggcatctggcaaagcacactagggagtgggaacagcacgtgcaaaggccctgaggtggggctgtgcctgtggcgtggctgcagtggagtgactaagagtcaggcaggggaggggaagccaggttatgtcggacagtaaaggttccgtaaggccgtgggaactgttccaagtgcagcacctcagagctggcccctgccctcaagtagcttccagtttgtcagaagagacagacatgaaccaaggagtcactccatcaaatgcaaaagcagaactgtgacggatgttatgagggaggggtgtgtgctctcggaggtcagggaggacttccttgaggaacttgcgcttgcagtgaggcaaggataggtttggtggctcatgcctgtagtcccagcactttcggaggctgagatggaaagatcacttgagcccaggagttggaggctgcagtgagctgtgacctgtgactgtgccactgcactccagcctgggcaacatagcaagaccccatctcaaattttaaaaatgaaaagaaaaaggacaggttcagcccgtgaagaggggacagaagaggattccagagagaggctgagagtggagatggggcagaaagatgagctaggtgagactgtgccctggccttgccactgggaaggagtttccactgatactaaacacaataggaaagcatggacaaatttgagcagggacaaaattccagctctgccactttctagttatttaattttctggccttcagtttcttcatctataaaatgggtataatgatggcccctacctgacagggtccctgggagggtgaaatgcctggcaccgggtaagtactgttaccatcaccatggccatcaccatcatcatcatcaccaccactgttccccagggagcgagacgcccgtgtgaagaggaaactgcggggcccagagccagcagccacagaggcctatgggagcggaggtgagtgtagtcccgatggcgatggggccaggcctgagacagggatcctccctagcccaacctctcccttccctctccccagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggtgagtgggacaggggaccaggcggggctgcgggtccctctgccctgctctgacatccctctctccatgtcaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaacattgggctcctgtgtttggccctgggcggggctgggtgagcaaaggctttgctaggagacccaggcccagatctagacctgtgtttccagctgcctgacctagcacaaaatccactggccctctaggcccatctcctcttcaggaaaatggagaaatcagaatcctgtgattctgtgtgtgcctgtgtgtgtatgctgttaataagataaggctgcccatgagaacagagccctctccctagggctggggaagccagcaggcagcggcccctggaggccctgggcaagctgactggcctgagcctggccctcttggcaggtcggggccctgaggcagtcaaggccctgacgtccaccccaggtcccaggccagcaaccctgtgcattcccaaccaagtctggcacaaacccaaaaaccatttttcttcttttattagaattttttcattttttttctcaaaatttttatctaaaaacaaacagaaaaaagaaggaaaaaaagaaaaaaaaattattggaaacttcatggttcaagtggggagagaggaggaggaacatggagctaggtctccaggcctctccagagaagtcctcaccctcgaagcaccctcttgggggacagcagagccaggacagccccccccacgcccagcctccgtctgaggaagatggcagagtcacagtggtgcgagggccagaagggttggagggggcaggggccgggcggggtcacaggaagtagtcggccacgggcttcttggaggggatgccccgtgtctcttggggagcagcctcaaagatgatgaaatctttctggagatgctcgtccagctccaagatggctgccacattcccacagctggaaggcggggcagcagggtcaggagcagctcggctcagatgcccgcccatcccagcccggcccagccggctcaccggtagcagtagttgggtgccgaccacacagtgagcaccgtctcattgaagtgccacttgtaaccttccatcaccagttggtgggcacggcagatcatgtcaatgtcattggctgcgttgaactgggccaccacgtcactgccaaataggtagccggctcctcgggggctcacgccccagcctgtggtgtctgatgcggaaagggagggatggagagggatgtcctcaggcttctctggctgccagcgctgccccttgagggtgagcagcctggcccctccccaagtccaccagaggcccgtgggaccagagcatggggcctgaatatggtctgtgggatggcggggaccaggacagcaaatgtaggggcagataagctccagaggagaaagaacgcccaatgcctggggccccctcataatcacagtgatcatacaatccccgtccaaacagcacataagagtgaaaggggcactcccagagacagaagggcaccctgtgttgtcacagggaggtccggagtgactgtggagcagcggctgcatgtgtgtgtctgcatgtgtgtgtctgtatgtgtgtggctgtgatggagcagaggcctcgtgtgcgtgtgtgtggctgtgatggagcagaggctatgtgtatgtgtgtgtgtgtctgcgctggagcagaggctgcctgtgcgtgtgtgcctgtgacaacaggaactctggctggtcctcagaagacctgactttaaatctcagctctgctctacactagtggaaaacccacaaaatgaggggtctcagggggctaccattctggggttctgacctctgaagaagctgctgtcatgttctaaggccccttcacttcagggagccatgacttggttgtcctccacagccctctgggccatgccccaagccactgtgtgctcaaagcacctgccatgcagacctccctgctcctcctccagggttccagccatttggcaggtggaggacgagtgacagtgaagaccagccctgctccctctctttcccaacccctcctggctgtccctgcctgcccctgcccacatgccctcaccttctgggtcagaccagagga

SEQ ID NO: 12399 - DNA, 46794 bp, Human
cattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccagtggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaatactaagacaatttgttgcctatggacgtctgccttacaagaaatactaaatccttcacacagaaaataaatgacaccagatggtaacctgaatccacaggatgaaatgaagagcaccagaaatggtggatatatgtacaactagcaaagactgtatgattgtatagctgccataaattactacaaatgccctggcttaaagcaacacctatttatgatctcagaattccataattcagaagtctaggcatagctcagatggttctctgctccatattttaaaaggtcaaaatgaaggcattggctgggcaacattcttttctggaggctcgggatgaataggcttccaagctcattgaggttgttggcagaattcagctccatatggttgtaagacaggttggccaggggtggttgtcagtttctagaagccactcaaattctttggctcgtggttccctcctccatcatcaaaaccagcagcaatgggttgaatcatccttgcacttttctcggatctccccttctgcctcatctctccactgtctcttccactgcatctctctaatgcttctgcttccctcttctgcttttaaggggccatgtgattactcagggggccatctggataatccaggataattaccctatttagtaacctcagttttacctgcaaagtgcattcactgcagtaccaagattagtatttgattaaataactagagaatgggaatcttggggaaataatttgcctaccaaaataaatgtaagttatctttcagtagcataagactatatagtaattacatcaccatactgttgggtttacaatataggtgcagtgtatattaataacaaaggagtgggtaggaaatggaactctattgggacaaagatgtatcttattagaattaattagtcctaatttgaagatgattgtaataaattgaaatgcatgctgtagagcctggagtaaccactgaagcatcaatttaaaaataaattaaaaaaaacaaaatggtacaccaagaaatatttaacacaaaaggcagaaagaaagaagcaaaatgatagacatttggaaaacaaatagcaaaatggcagccataagtaatcatgccaataatttcattaaatgtgaatggactaaatagttaaaaggtagagatggtcaggatggatttaaaaagaaaaaactatatggtgttcacagaggcacactgtagattcaaagaccaatagctgtaaagtgaaagtatggaaaaatataacatgcaaacagtaatcgtaagagagctggaatgtctatatcagtacagtgggctttaagacaaatattactggaaatataggatattttaaaaagccaatatatcagatataacagttaacatatgtatatgcacctaacaggaccccaaaataacgagaaaaatgatagaattgagaggagaaatggacaatttaataatatttggagattttgacacctacaataattgatagaatgactcaattgagaatcacaggcatacaaaagaatgctgtcagccaaattgtccaaacatttaccaccacccaccacgaacagaatgcacactctttgctagtgcacatggaacattctccaggggaaaccacatgctatttcataaaagaagtctcagtgaattaaaagggatgaaatagtaggaagtatgttctccaaccatgttgaaattagaagtcaacagaaaattgcaaatcccaaaatattcggaaattgaatcacacatttctaaaaaacccatgtattgaagaagtcacaaaggaagttagaaaattttaaacaaatgaaaaagtacagcatgtcaaaatttatagtgtacagctaatgcactgtttaaagggaaatttacacttttaaatacctatactttagaagtattaaagccagtggggatagctgcaaaaatacttaaaacacaatattaggaaactgaatccaacaacagataaaaggatttatacaccaggaccaaatgggccatatcctaggactgtaagcttcatttaacatcaaaaaaatcaatgtattataccatactaatagaagaaacaataaaacccatattattataataactaaatagccaaaggaaagaatatttgacagaattcagcacccattcgtgatgaaaactcagcaaactagaaatagaaggcaacttcctcaacctagtgaagggcatcgataaaaaactcacagccaacatacttgatggtgaaagaatacttttctccttaaatcagaaacaagtcgagaacatcctttcatcatttctattcaatgttgtcatggaggttctgtccagtccctgttccctctccctacaaaaagactagaaagacattaggttggggaaaaaagtaaaactgtctttattaagaaatattacctgtcagattctaaagaatccaccggaaaaaattttttttttgaagctacaagacctaattcagcaagcaaggttgtaggatacacaatcaatattaaaaattgacattatattagcaatgaacgataccttcaaaagtaaactcagaatagcgtcaaaaagaatataataatacatttatttaattgaaaaaatattgccgagagaaatcaaaggatctaaatgagaacttccatgctcatggattagagaattcaacagtgttatgatggcaattctccccaaattgttctatagattcaactcaatccctagcgatattccagaaaggtttttctttaaattcacaagctgatcctaaaacttaacatggaaatgcaaaatgtctaaaagatcctaaatgattttgaaatgcacaaaattggaggaattgccttacccagtttcaaaacttactgtaaagcaacaataatcaagactgtttattgacacaaggatagtcagtcatatacagcaacaggacagaattaagagtccagaaataagccctcacagacgaccaacggactttcaagatatgtgcaaagataattcaacaggagaaaagacagtcatttcaataaatggtgctgagacaattggatatctgtattttaaaaggaaggaaaaaaggaagaaagttaattagaccctcagctcattatgcacctaaaggtaagagctaaagctatacaacttctagaagaaaacaggagaaaatctttgtgatgttaggttaggcaaagattttaataggacttcaaaagcaaaatttattaaaaaccagttgataaattggacttcaccacaattaaaatatttggggctttaaaaaacaagagaatgaaaagatgagccaaagactggcataaagtatttgcaaatcatacatctgataagagatttgtattcagaatatataaagaactcttacaattcaataagaatacaaatggcccaattaaaaattggtgaacaaattcattgctcagagattgggtatggtagagttaattctaaattctgtatttgggtattaatgtttaaatggtaattcggcaacagttgataaagtgaagctctaaataccatgaattatgtgtaggactgtgacaaaaaaagtaaaaataaaaactggtcaaaagatttgacattttcccaagaagatatatgaatggctaataaacataattctttataaagactagatgaaattaaaaccacaatgagaaaccactcctcacacactcaaatgattatagtttttaaaaagacagatagccaagtgtcaataaagatgagaaaaagatgaatctcacacattgctggaatgtaaacagtccctttggaaaacagattgcagtatcttaagaggttaaatagaaacctattatgtaacccagtaatatcatttctaggtatcagtagaggtgccagataaaatacaggaggctcagttaaatttgtgtgtcagataaaaacaattttttagtataagtttgtcccacatattgcatggaacatgtttatactaaaaaaaagtattgtttatctgacatttaaatttaactcggcttcctgtattttaacttgctaaatctggcaactctaatccaagaaaaattaaaacatatgtccacacaaagacttgtaggtgaatattcacagcagcataattcctaatagtcaaaaatggaaacaagctaaatgtccatcatctggtgaattgatatttaagaggtaaggtatttataccatggtttataagactgcttgatccttgttataatgtggatgacctcaaaaccctcatgctaagtgaaggaagtgggatgaaaaggttgcagaaaggcacaagggagctttttcggatgatgggaattgaggcaggagaatagggtctggaggcagggaacctaaggctctttcaccctgacttcctagaactaaattgaaaggaaaaccctaactttccacgcctaagtaaaaaaaggaccagaggctgcagatgggaaatctgtctgcaacaaatcagactgagtaccagtggagtcttcgtttgcaactttgtgacttagctccagcctctgaatggttgccgtccacaatcaaccagactgattgcaggcttagtcagtcttcatttgcacagaagtataactttgtaacttcaccgtagcctctgattggttgcctttaccaatcagatgtttgcacaggagtgtgacctttgtaacttcagcctctggttggctgctttctgcaaccaatcagactgattgagggctaccacttcatttacatgaagtatgcatgaagtggccaatgggaaacttctggggggtatttggaccaaagaagattctgtattgggggctcttgagtagctgctcaggctgctcccacactgtggagtgtacttttgttttcaatacatccctgctttccttcttttgttgcttcattctttctttgctttgctgggcgttttgttcaactctgttcaaaacgccaggaatctggacaacttgcagttacgaccttctactggtgacagaatgtttcaaagcttgattttggtgatggattcagaactccgtaaatttactaaacattgtgcacatgaaatggggaaattttatggtgtgtaaactatatctcaatacgtctgttaaaggaaaaaaaagtaaaactcgcctttgccagtttttgttgttgttgtttgttttttgttttttctttaaacagggactctctgtcacccaggctggagagcagtggtgcgatcacagctccgggcaacctcgactttcccgggttcaagtgattctcgcccatcagcatctcgagtagctgggactacaggcaccagccagcaccccaggctaatttttgtattttttagtagatacggggtttcagcgtgtagcccaggctagtctcgaactcctgagctcaggtgatccgtccgcgtcagcctcccaaagtgctgggattacaggcgtgagccactgcaccgggtctcaccttaccattcttgccacccaccatacttccttcatctgtccgccatgctgcatgtcccgacgcaccctgcttcctgcctttctgctaggctccgcccttcgctggaactgcatttttccctctcctctgccttgctaacttgaatcaaccccaaggctcaggtcggaaggcatttcctccactattgttgcgcatcctgcctgctggcaaatcattgatcccctgctgcatttccaaatcacttacctcatttcattgcacatcgttcctgttttaatccccttagggagttaggactcttgctctccctctcttcccttgagagaagcagacggtttctgtgtattttcctgtccaagcacctaacgtgaaaattaacaaaatagtttgagtgcttatttttggtgctaactctgctgggtccttggatgctccgggagtctggcatgtttggggtgctttgtcaaaatttttaggggtcttccctaaatggctcccaccacactctgtttccaatgccgcatcatttcgtacacatgcctccctctaagcccttgtattaattttacgtctctgtgttgttccaaggcttgctgctgcaactagctatgaatgcctggagaacagggactctgtctgattcatttctgtgaagctcttgcctagtccagggcttggctcagagcacgcactaagaggagcttgttgaatgaacgaatattcaattaaaggaatcccaaatgaatatgaaccaatctaacagaatgtcgctatggagatggatatttacttcatcaataaggagagtccttcatcctggggctccccaaatgcaaggcctacaagtttttttataaagggatttcttactgccccaccaatttctggcctccccttgctattccgtttatttattccatcaactacttccattttttttattggtttatatttttctcatatttgatggcattctttttaaaacaatgagctctccttagtcagaacccagcaccttttagtaagatggaagtttgggatcttctgatttgaattacgtaaagtgaaagaatatttttacattcttgatacttattctcaattttgcattctctttatggcacattgactgtataataaatcctgtacatattattcatctctttatatttcttttcttgtactgttctcccaaatgaaaaccagaattcttattcacagcaatttagaccagcccagcttatgagcagagtgatacaggtcattttggaagtctttccagctctattattttgtgattctcatatagttcttacttttttttttaaccaatgattgaatgaaatctgttttgatcatattgggatgttcatattttcaacctttattcatttatttattctctcaagttcctttttatgtgatttttaaaaacatttcaacttttattttagattcagggtgtacatgtgcagatttttttacatggttatattgcatgatgctgaggtttggggtatgattgattctgtcactcaggtagtgagcatagacccaatgcatagtttttcagcccctgttccctcctacctgccccgtgcagcagtccccagtgtcggttgttcccatttttgtgtccatgtgtaccccgtgtttagcttataaagtgagaacatgccatatttggttttctgtttctgtgttagttcgcttaggttaatggcctccagctgcatccatgttgctgcgaagaacatgattttggttttttatgatcgtatagtattccatggtgtatatgtaccacattttctttatccaatccaccgtggatgggcacctaggttgattccatgtctttgctattgtgaatagtgctgcaataaacatgtgagcatctttttgatagaacaatgtattttcccttgggtatctgagtaatggaactgctgggttgaatggtagttctgttttaagctctttgagaaacctccaaactgctttccacagtggtggaactttatatttccagcagcagtgtgcaaggattcccttttctctgcagcctccccaccatctattattttttgacttttaataagagccattctgactggtgtgagatggtgtctcattgtcaacctttaaaaatgaacaagagtttggttcatcagatcgcattgcctatgttttttgtttgtttatttgtttgtttgtttttgagacagagtttcactctttcacccaggccagagtacagtggtgagatctcggctcactgcaacttctgccttccaggttaaagtgattctcctgcctcagcctcctgagtagctgggattacaggcgcctgccaccacgcccggctaatttttgtatttttagtagagatggggtttcaccatgttggccaggctggtctcgaactcctgaccttgtgatccgcccgcctcggcctcctaaactgctgggattacaggcgtgagccaccacgcccggccactgcctacctttttaaagaatgtgtcctaagcatggttaagtttgatacggacattcggtgcttgccaaatacaggctgagtttaggatggctcaccaaatatatagcttgattcctcctggactatctcatgccatggctatgtttgagtcattccaaaagccagtcgaatgggatctgtgactctgggtggaaggggccctgcatagtacttaacatagagtgggcatcaataagtatttggttgaatacacgagtgcatgcagataatctaactgtaatctaacttcctcagaaatgctgatgttcttctgtaacttccaggatggagggtcacagtgcttctctattgacatatattcagtgagcagggtgccttcactgttttcacagaacattatcttatttttggaaagtaacaattaaaacattctttctagcagagtgacatatgttggcccatatctcctccccactcgtctgccagggtcccacactcccagcctttgtcctgtagcacagcaagtaagaaactgagaccaagtccctttgggtaggctctttactaggctgaacagagtctgtttcttaaactgttactcataccttcccaagcatccctcagtatgctcctgattccttacttctatggctaagaatccgtgtgcctggtggaagataacccagatttcaggtctgtgcagatctcaaaatatctcaaaatctgtttaaaaatcacaatttaaaaaaaactcaacttagcctgttctccaataaatcctcaataggtggcagtgttgatctttctttggtctctggtctgcgggagtgttttggtttgtttgttttgttttcatattagaaaagagttgaggtttctacctagttttagattgagttctactaaatgtagttctcaatcagactatttttcttgaggccataccaaaatcaatgactgtttttcttgaggccttaccaaaagcaatatctcctacgccagctaaaaatgtggtaaatcttcaagctagtattctattatttaacatttttaattataacaattattcatggttgtaaagtttcaaaagctacagaagtgtagaaagtaaaaagtgaatgaaagttttccaggtgttttgctatgcacataaaaatgcatatagttataaaacatatagatatataacatttatatatataaatagagaacaatatggataatatgactctatataaaaatgttatatatctgtatgtttatatataaatgttatacatctgtcatgtttatatatgtaaatgttatatatctgtatgtttatatataactgttatttatctgtatgctcatatatatggcacatatatatatgaggtcatattaaccatgttagtctgcagcttacatttgcttctttacatagtgtttgttcttccacgtcaatatatatgatcaccattcttcccactttcatggcttataacaaaacttttacattcttttttttcttttccttttttgagacagggtctcactctgttgccaggctggagtgcagtggcacaatctcggctcactgcaccctccgcctcccaggctcaagcaattctcctgcctcagcctcccgagtagctgattacaggagcccaccaccacgccgggctaatttttgtatttttagtagagacagggtttcaccatgttggccaggctggtcttgaactcctgacctcaaatgatccacccatctcggcctcccataacatttacattctgttctggaactacagccaagtcttctaggcttgaatacttaaaccaaataaaaatagcatttaccatattgtggttatacaaatattaatcactgcagaaaaaagtgtgataaaatctatagagaaagaaagaatattccatgtatttaataccagccacacagctgtcaacattcaaatcttggtcttttaatgtagtttttactttcctcacttttattcaggtatcattgttttttatttgcttcagtctcatttttttgaaatctcattctttcattccctttgttttgcacaagtacttccgtgagtaatttttacattcgagtgcacacgtgataaactttccttgcattgctggagtataatttcagctcaaattcatattccattggagttttttttcttttttcttttctgagacagtctcactctgtcacccaggctgcagtgcagtggtgcagtctcagctaactgcaaccttcacttcccaggttcaagtgattcttctgcctcagcctcctgggtagctgggattacaagcacgtggtaccacacctggctaatttttgtattttcagtagagatggggtttcaccatgttgctcaggctggtctcgagctcctgacattaagtgacctgcctgccttggcctcccaaagtgctgggattatagacttgagccaccatacccagcctccactggagttttaaaggcatgatttttaaagcatttctgatgggaagtctgaaattaattaaattctcatttctaatattcaagcttttaagcctttctcattcttcttggggttctgaaatttctaaaaatatctaggtatgggttttgttttcatttatcctgcttggtacttagtggcctctttcaatctgaggacttgtattttttcccagctcagggaaactttctattatgtctttgactttatcccccaccacctctctgattttttttcttaccttctgaaactcctactgaattgatggatgctagcctcctggagctttcctgtttctagacttttagtttttactatgctgacttttttctgtatttctggagatttcattgacttccacacaactgctctggcttttggtcttggccattctattattcctgtttgctgaatttttaaaattttgacccttattttacatttctagaaattatttcttgttctccgatggctccttttttacggcagctggctcttgttttggagatttcattctctcacatctctccagagatactaattagggttttatctttaacattacctacttcatcttgttttttttttccaggatgacgttgtgtttactcatgtttgttcaacttggttgtgctattggttttcctcaaatatttggggctccatggctctccgtcgactttcctaaatgaaggattagattaatctgtatggatagctggtgtggcctgctttcacaagaggcgtctccctggaaggggagggccagttcaggtccccttgagtggctgggccatattgtcagcaggctcacctctagattgcagcaggcagcctgggatgcccacgcctgccaaggtaaggaggtatttaaataacggactggagtatttagctataatttccttttggacagaggactttctaccacccctccatgccttctgatatggtttggctttatgtctccacccagatctcatcttgaattgtaatcccataatcccctcgtgtcctgggaggtacctggttggaggtaattgaatcatgggggcggtttccctcggtgctgttctcgtgatagtgagtgagttctcatgagacctgatagttacaggggcttcccccttcacttagcactcattttctctcttgccaccaggtgaggaaggacgtattttcttccccttccgccatgattgtaagttttctgaggcctccccagccatgctaaactgtgagtcatttaaatctcttttctttataagttacccagtctcgggtatgtctttattagcagcgtgagaatggagtaatacaccctctcaacccaaacttgccatatatatttgttggggaggcctacatagacttccaaccctgttcttgttctgcttctctcttgactttagacacctatattaggatcccttcctggatagatcacccacattttttaagaataatgattgggtcctaggtacccaaagggcaaaattaccactagttgttcctttacgggttgagcatatgttgagcaggggaagggagaagggaggggccccgaatgtcccagccactgtgaatgcagctctttgctcagttactctgatggttatcctatggtctactcttgctttctgtctcttgtttctgagtttggggtttctctagggctcccttgagaaggaaagttcttggtactggtgtttggggctgtggtttacctttgtactttctcagttgatctgatcccatctactttttcttttcttttcttttcttttttttttttttttttgagacagagtcttgctgtgttgcccaggctagagtgcagtggcaccatctgggctcactgcaacctccgcctcctgggttcaagcaattctcatgcctcagcctcccaagtagctgggattataggcatgcgccaccacacctaattttgtatttttcgcagagatggggtttcaccatgttggccaggctggtcttgaactcctgacctcaggtgatccgcccatcttggcttcccaaagtgctgggattacaagtgtgagccaccgcacccagccaatcccatctactttctagcttccagtattttctcagactttctcatctgctggcaccctgtcttgttttccaacactgatctgatttcactctttaaaaaatatattttatccccatggatccatggtgtagtggagaggtggatgcatgtgctcaatatgtgacttccaaactaatatatttttcaaacttaattttttttcctaattcacatggttcagaagatactgaaaggtctatcaagagggtacaggaaaaaatttttaaaggtactaaaaggatatataaagtgaaaatgtccctttcatcctatcccagataaagactacaggttgtcctcttatatttattctgcccttctttctttagaaacaaaatctccaattttagctatactcatgaatgctcagctaaggagggcgtttcctagttgtgtccaagtcactgagttctggccagtgggaggtgagtggaggccatgtgcttaacgttcagtggctctcctagagggcgtggatgtgcctttcactttctttactccccctttcttattggctggattgcagaggtgatggtgagccatcctcctccctgcagaggaaggcaacactgtagtgatggcagagccacacaatggaatgatcctgggtccctgacacttcgtcaccattatacctgccctgctttgtgagacagaattgaaatgctatcttgtttaagccttgcattttggggtcacttcttatgacagacagcctagtctgtctgctaattgatataatctctgggctattcagctcaccttcctggaggcaaccaatgtaaccatattgctggattcttccagggatatttcatgcataaactaacaaatgcatacaggcatgcatgcatgaatgcattcatatgtacataaacacatatatccaaccatgcatgtagccccctctccattttcacataaatgatgctgtaccaaacagctacactttaaagaggccaagcttggtttggaggaggattgctggtaatggccctcagctcagcttctccttttcttgctgacaaggtgagctctctctccaaatatacaccacctcctagcaaaccacaaaccctgcagctactgaacccgctttcctctgaggcagtttattactcaagcacaacgctcagcgccttcttaccccttcccccctaaaaaagaggtttattgaaatgttctagccacagaatagcctccctgtaaacaattccaatgcattttccaccccgtttttcatctttctggggtctctgagtgacaggggttggtactccaggcggatgtccaggggatccccctcctcccccaggagggcttgacccagccctgccatggcctctggaagccctggatgtggatgtctcctaaagaatgaagctgattgctgacggtctctgtaatggcctctttcctctctgctcatcttctccccaacagccacgttcccatcctgggtccaatgccctgaactgatgttgtaagagaaaagcacagtagattggacagtatctccaccaaattctactctttctaaaagggagggagaagtctgaaatccactcaggttggcaggggaaggaaaaggtgtatgtgtgggagggggaatggggtgagtcttagagctgggagatgctacagatgaccatctcttgtggggccttggccatcataatatcaccaaatgtccttactcctctgcttgtctgaatcctgcctagctcaaaactcataccgtccactctagatagcctccctgtccaaggtggcaatgtctgtctgtctgtttttccttctctctctcatacacacaaacacacacacacacacacacacacacacacacacaggctgtttctgattcatttctcggttcttagagtccatcatagaggtgcttaggcgcttcttgtgaaatgaatatgtttttaattttattttttgaataatcacttaattaaaaaatcatcttgagatcatattggaagaaaaaaaatcagagtatctttccctgagaattcttcctctcacccttgtccaattcactccaccccatcacctccattgacaactgtctttgttagtttgtttgtccttccagtgattcttatgtaaatgtgaacagatatttgtattcctccctcccttcttacacagagtatccaatgttcttttattcttccccattataacctagagattttaaaattaataaatttaaaatactgatccatttgctttttcacaataaagcatgtataggtacaatcccatgcatgttacaataatttatttttcttccaaagaaaaatgtatccatggccttttcctgagaggaagttttcaggggagaaactatcctggtgattgtagaattcttagcccagaagacagctgggcttgggaggctctgggacccaggtgagtgcaggaactttcttaccaggtggctctgagagctgggagatgagccacctctcatttgcatttctaagagaggcaggcagggaaaagaagcctggctcagagcattgtctccagcccgagtcacttttgggctgtgtatcaatcagagttccaaaagaacctgatggggatatagattaagagttttattgcaaggaattggcttacatcattacggaatccgaggggcaggccgtcaggaaaggaaggctggggccctgggacaggatctatggcctcagtctacaggcagaatttcttcttcaggaaagcctcagccctgctcgactgattgaatcaggcccaccctggttatccaagacaatcttttttatccaaagtccactgatttcaaccccatctacaatatactttcatagcaattcctagagtagcatttgcttgaatatgggactgttcacaagttcacacatcaaactgtcacaggttgacttggctgaaacagattgtgtgagagcagaggctaagtggggggcgttggagttttgttgtagttgttgttgttttgttattttctggaaatcaatgttatttccttagatgatactacccagggtaatcacggctgcaacgagttattccatctatcagtggaatgaagcatttttttttgccaacttgatgcttgactttcctaacttacctgcaagaagcgaccccattagcctctttcacaggtgaggagcacacctcaagttctcttgctcataaacccagtaggagtcactgggatttggccctcatcatggtcactgaggggttaaacctgccgcagctctgctgacccctgagggtttcagccagtactccatggccattaatcatcctcatctgggaccagggctgcggggaacaacgtttactagcaattaacctacagtagagggaccattgtttcccccgcctgcactcccctcctctgcacgcccaattactctaaattaacatttaccaagcaaagtgcctgttaattggaagggcagtagaaagaaaggccacacacctacccagtctaacttaataacctcaaaagcagccattaattaacagggcagcgtttccattcagatcttgtttagacagttcggcagttaactctgtgtctgtgtttctgagctcagccctgcaccgcatctccctgccctcccttgccagcagctcagatgaaaaacacactcataaagaaatcttcactctctagaatgtctgcactggccaggggacttagggattcctggggacagccttcttactgtgtagatggggaaacaggctgagaaaggcctcagggtcccagggtcagacactagctggaggcctcctggctgggggctcctatccaccctgcccgatgtgtgtgggtgtgacatgctttctgtcctctctggtctcagtgcctgatgccaggcactcaggatgtggacttgcatgaagccggggagcaggggtggggctgggggtgcgggtagaaagggggatgcttctaagaggagagagggagggatggagaggagggggctccctctcacaaatggagagcagctgcggtgtctccaggcagccccgaaggccttcgtccattgtccctccccacttgtgcagttgggttgagtggcaactgtacccccagcccagcaaatggagggtcctgcccacttgaccctgggcatccctcgagcccagccttcctttcctgtgcatactcatggtctcctcctcatttggtagccctggggacccctggccagtacccttctttccccagggcaactgttcacagcctcctgacttgccttaatgtcctcatcagacaacctcacctccctccctgagaaactcaagccctccaggaggggcctgcttagcttcccttcctccccctggggctcagcctgccctgtctatagggcctgccttgttggtggtagttggttgcagagttggcctcaacccccaatctggatctggactctggtctcgcgcctctccaggctccttcgggctcatcgtctctctgcaggtctccactcgctcacttcccctgcatcctccccacagcacagggcatactctcaggggacgcccctcctaaatcagccctgccgtcccccatggtcctccagctggtgtcgagcttctccaaagggacattgcacaggttgcgttttcccacctcccacccactctcaattctccatagttgacctttggccctcaactgccccacagaaactgcctttctcaagtttaaaacaacctccttgttactaagtccaggagacactgtgtaggtttctgtttttgtttttttatatgacctttttgtaggattttctgctgttgcccactcactccctccctcccctctgaaactcctgacttccatgatagcactctttgtttcccaggcgtttctttctgccagtccccacaggattttctgtgctggccccttctcttctggtcacatattctccgtgggtggcctcatccactctgtggccccattaccaactagatgaggaagaaggggaagaggaggaagatgatgacagtgacaactcccaaatctctatactgggccagatttaactcctgagcctcagactccatcaaccacctgggagtcctcctacttgggagtcctgcaggcatctcacgcttgccatgctcaaaatgagctcattagcttcccctgtactgcttctacttccgggcttctgtgtcgttggaagtgccgccatgcacaggggagtcatccctgctgccacctctcatgttcaatcaatcaatcaatcactcttcaagtctcgtaccttcttatgtctccaacaagcctctggattcccattgccactaccgtagctgtgacacattccagtcttacctccctacaggcagagctaccttgctaaactcatatttcatcacatcatgcccttcagtggcatggcgttgacctcaagataaggtcaagctacttagaacatcatagaagccagattcctcaagaccactcgagcatgacacattgggaaaattcctgcactctgcaagggttctaatcttggcctcagctttttcattttaacgaataaaacaaacattccctcaatggtgttggttcttagaaccatgatatcctaatttcctaattatagtcttgtcatacttctatgaggcaggtgttattgtccttgttttataggtaagaaaaatggagtctcagagggcacaagctcacaaagtaattaaggtaggatctgaactcaggtctgacatttcctatgttcttgccaggatccctcagctgaacaattgaacagagaagaggtgggggcttccagtgacccagggactgtttggaccaggccacagatctaagagaccttctcacactgcaaacctcttttcctgtgtgccaccggggatgtgtacctggggcttgagcccctgcctgagctctggatcagagagagcctgctcctgcaccttgtctgaaatggaacaggggtgacagatgagcagaggatcaatagccatctgtccaggctccactgacaagctaatcttttcagtaaacatttcattagctcctgccagtctgctgcacctgctgacaggagaggccaaacggagtagggggaggggaacctccgctttatggtagggctccaatggcagcaggggtctcctggcccctgagagctagttaagctcagctggaatacccctgccacgcactggaggaatccggatcatccccaagatttttgtatttgaagggacttttaaaatcatttaacccaagctctgtactttaaaaagagagagcgcagtcctcaaaagtgacttgcagaaaatcaaagtagccacttgcagagacatcagtggaaatcagaccgggttcttttccatgttgtgaaaacatttgtattcattttgtaatatgcaaaacatttgaaattatatacagttgtaaccaaacatctttggaatgggagtatttgtgaaagaagggtgttgggtgggtggcaggaattttcctttaatgtgggtagatttaattgtgtctccatgaagggggctgcacagattccatgcagggtgacttatggcaaattctggagacttatgttctttttgtttcctctagctcttccccagagaagcttccatgaccaccatctaaacatgcccttctccaggcccttgtaagaacattataagttcttacaacaacttgtgctttttcttcatcatactgttacaactactgctgctgctgctgctactgatcatgtcagtgatattaataataacaaagccgacacctactgagcacccactatgtgctgggcgccgcgctaagtgtgttccatatgttatctcttgtaaaccccacaacaacccacgaaggcaggtgctattatattatactttcccattttgcagatgagcaaagtgtctctgagaggttaggtggaggagtgaggggttagagcctgggtttacctcacttcaaagcccaagctcttacccaccatattgcatttgcagctcgtggttcgtggaattatttggctatcatctggctcctccagccagattgtgaggtctacgaggctaggaagtacaatcagttgcctcagcactatgtccccagcacaatggtttctttgtttgattatgaactgatgcaaggtattgtatgtgagtttgtttagcctttactgctcccaagccagtggaaataagctgggttttgttcattgctttcttggggagtgctgtttgtgttagccatgcaaattcactcttctcctctgctgcttccccaaagtactgcctgcaaatatagctagtttgggtgagctctcatttatagccccttttcctttgctttttagaacaaaaccatgtccagaaaaatctttttatgctaggcaataacccttactatgaactcactgttctgaacaagtgagtcattttgcacattgggggaatacccctcagtgtagaaaattatgtttgctggctctcttggaggcctgcagcccctcacggcctcaacgtgctccccttgttctatctcctgttttatctccactgctttgggcagcccttccaaatagttttcatcctggagtttaggttgtctctacatttcaatagaaattgttgcttttggatgatttccagaaaaaaaaaatggacatgctgacatcttgccatggggtgactttatgggaattggggtgcctctgggtgaaggacagtttcagatgatggctgccatgcaaggatgcagcttttctcagagctgagacaggacccagccagaatgcttggtgtctgattctaatgtccttgatcttcaactctgcgttagaaggccttcattagccgtgctaataaaagaaaaatagaaaacactgaaaaactaacacaaaaaattaaaatgggctgagcgtgatggctcccgcctgtaatcccagcactttgggaggctgaggcaggtggatcacatgaggtcaggagttcgagaccagcctggccaacatggtgaaaccccatctctactaaaaatacaaaaaaaattagcagggtgtgatggtgcatgcctgtaatcccagctacttgggaggctgaggcaggagaatcacttgaacccgggaggcagaggttgcagtgagccgagatcatgccgtttcactccagcctgagcaacaagagtgagactccatcttaaaaaaaaaaaaaaaaaaaaattaaaatgacccataacgtttccacctagtgaaaactactgttaaaggtgtaacatggtagataaacaccttcagatttttctctatacatacatatgcacatacaaaaagatgatcctactaggcatatgattctgaaactagttattctcaattagcactatagaatgaatatattcccatcaataaacagatttatttaatttttttttgaggcagagtctcgctctgtcttccaggctggagtgtattcaatttttaatggatctatgatggtctagtgtatgcatggcatatgatttatttaattggtaacttagtgatgcacactgcttctcattttttagctttctaaacaattcttcactgaatatctttggctgtatacccctgtcaacttgcctgagtgttttctcctaaagcagggtttctcaagagtgacaataattcttattctggggggatgtcctgtgtaccatgagatgggtaacagcctccctggcctgcatcactagatgccagcagcaccccttccccaacttgctgacaatcaatgtctctacattgccaaatgtcccttgggcagcacagttgcccctgcttgagaaccactgccctaaggataaagttcttaagataaaagtttaaagaatatgcatattttaaggtttttgttatctattgccaaattaccttctcagaattgcactgatttatgactttatactccaaacaacagtgtataatagcgctcaatttcactacccttatgaatatgaacgttagcactaaaaaaagcccagctcaaaacattttaccaatctcagaaaacaaaatgggttttttgtttgtttttgttttgctttttgagacagagtcttgctctgttgcccaggctagagtgcagtggcatgatcttggctcactgcaacctcccccttccaggttcaagtgactctcctgcctcagcctcctgagtagctgggactacaggcgtgtgccaccatgcccagctaatttttgtatttgtagtagagctggagtttcaccacgttggccaggctggtcttgaactcctgagctcaggtgatctgcccaccttggcctcccaaagtgctgggattacaggcatgaggcactgtgcccggccagaaaacaaaatactatctcactgacttttaaaaattactagagtgagactgaacatgaaatgaaactatgttgattatacagattagctattgtttccacggtgaattatttttccttataatttactattttttcctttggaatattcatttttgtcttattttttcatgtcagcttttaatattatgaacagaatgtacatatttttcctaacttgctgtttgtctttatgtgttgagatgtgtggtcttatttgttcaaaaatcctaagagggttgtaaacagggccaggaagagagtcctcacacaggtgtctctctgggggccctgaatcgtgtccctgccagtgagcctccaaccggctgggtctctgtctagcagaggatcctatgtgagtcatgctcttttttattaaaatctgctgaatgttccttttgtgtctgagtgaaaagttctggctctgaaaactcagttgtcaggggagccttgatctgggaagactgacctggggctcaacaataattagttcaggttaattattggcaatctgtagatgtgcagcataggagcttctcttcccctcggcctgggcctctggaggtttcttttatgagctctgaaccctgagggaggacttaaagtaatgaattttcctgtaatcagatttgagggtttgttccctgagccatccagtcaattggagaattgagcactgactggtttatttggctacgggatgcaggagatgatgcacagagcatctgataagcaacccggggaggagagtgaagaaatggcatgacatattcaagaagttgacctctgggcttggagggagcggttctgtttacaagggggacatagtgtctgggagctattcagaagagtggggtattttattttgagtatcagggagtaagagttctgcttatcctcgaggggaaccttgtgagattcaccttgaacttcattcctatgacagcagtgcagtttgtacatgtttataaacacttaatttgttcaggtgagccacagtggctcactcctaaaatcccagcacttttggaggttgaagtgggagaattctttgaggccaggagtttgagaccagcctggaaaacatagtaagatcccacctctacaaaaaaagtagaaacatttgccggccttggtggcacgtgcctgtagtcttagctactcaggagctgaggtgggaggattgcttgaatactggagactgaggctgcagtgagctaggattgtaccactgcactccagcctggatgggaaagcaagaccctgtctcaaaaaaaaattaaatatttaatttgttcagatttatttagcatccattcatttgttcatttatccattcaatcaacaaggaggcactggggatatagaaaatacctgcccctgcattattggaagaaaatagatgcttcatgcggatttgtgttatgtaaacagggggtcacaatgagaaaagttacagaggccaggcaggccaagttagtgaggcgggggttgggtcagggagacgatagggagtggtgagaactggggtgaagtgaagagcccatgtcttctctaaggaacagctgcctcagctccagccaatggttgccaacagtgtggcccaaaattgccacgttttccagtttttcaagaaaagtcggaaatccagattttttggggggtaaagtatttctattttaaaattttggttcatatttttattaagcattctgcaggccaaacaaaacatgtgagtgggccagattcagtttataggcagctggatgtgaacataaatacttctgcaaagtatgtggatattctgtttaataaacacacctacaaagaagacaaggagatgtcacagaggttagaaaccaaatagaggaaggaggcgaagctggggtaggggagaaatatttatatcagaagcctagggtaaggtgactctgaagcatgagacaagcttaaagcctactgccaggcaaaaagggaacgtgtattgtctaataaaagcacatctacctatatatttaattttttctttttaacatttcttttaaattaaaaaaattttttttttactgtttttgagatggcgtcttgcttcgtcacccaggctggagtgcagtggcacgatctcagctcactgcaacctttgcctcctggattcaagcaattctcctgtctcagcctcccaagtagctgggattacaggcgcctgccaccatgcccagctaattttttgtgtttttagtagagacagggttttgccatgttggccaggccggtcttgaactcctgacctcaagtgatctgccagtctcagcctcccacccttctgggattacaggcatgagccactgcgcccggccagtatttaattttttctaatgttatcgactaagtagatgtgatgagtgctatgctagattctttaccaaatgtaactctcaactctgctgtcggaacaccctcatttttcaggagaagaaacggaggccctgggtggtgaaatgacttatggagctgaggcttgcacctggacccggcctttgcaacaaggtgtttctgagaacaagaaggaggcaaaagctactttaggaggtggcgagcaccacattgctacagatttataaacaggaaatgaaagagtatgtgatattgagggaattcaagtatggagtgggagtcaggccagaggagagtgagatgctaatgagcctagcttggggaaagggcaccaaaactctgaggcgccggtcctgcccttcaccacttcttagaaagttcttccttctattgagctgaaacctgtgtcacgggtctaagctctgcccctgggacagttgggggtggcaatgactgagcatctaacatatgccaggctctgtactgggcttcagggctgccgtgataactcagacatggttcatctcccccaaggagcacacagcccacctcgacacacaggtgtgagaacaattgcatttgtcttattgctaccctgcctggcatccaccctggagccccgcagcgctcagtcacagcacatcttcccctctgaatccctctgattcatatcagagtgctgggcctgcagggggttggcagtagatcctgttgccaccctgtcccacattctctggccctggagttctcctgaagctgcaaaaggcagtccccagcttgtgggatgattctgaggctggtttcagtatttcagagggtccccagtgggtctgagcccacagctgccttccttggcttctggaggccaattttccgtctcattttcctcactttcttgctttgccgcctgacattgccttctcgattaactctctgcacccaagtcgttgcctcagttctgctctttgggaaacctaaactaagatggacaccctcccatttcacagggaggaaaactgagtcccagaagaagggcagtggcttgtctgagccacccagatggcgaatgacagagaagaccttgattccaggtccgtggccctgagctcagcctcgccggctccttccccacggtacctcccagtcttccttagtcttccatcatcttaggctcggtttttctttttagcagaattcaatggtaacaaagtcagaatttggggtattttttcagatctgggaattttttctcccatgatacttctggtattgctgctaacctagcccggtttttatctgtagcaccttttattcataggttggagatccacgattgatagccatgcctgttaccgctttcatcttttctatttcttaatcgcatttctggaaacatcttgtaagtttattataatatatcttgtaagtttattataataaacattttatcagtttattatctgaagtaagaaatttgttgcttaccggtttcagtgcattttatcttgaaactattttcctttactttctctccttacctcgctcagttcttatttaatagaacttccatattttgatgtctcattaagaatatgcccctatccattcccaaattttccttctatttcaggaagtgattgtgtttttaaggaaaggtttcctttggaccttactatacctggttcctattctctctgttacacaattttcacaaggccccaagttgaggtttcatatgttggttttgttatctatcatcacattcttgagcaaacagatctatctaggcccagtgttggtatctcccagaagtgaggattagcactaatttcttcttagtttgctatgacttggccagtggttgaggagtatgtacagaagcaattgatgggttttcagtgaattctagttccttcctccaggaaaatgtcccatttgaatctcttagaaaatgcaaccactttagtaggtctgaactcaggaaaaagctccttggaaatggactttcgagtccaagcagagaagaaaagtctagagaccgttctagacaggtgctgtttctgaggacagaggccaccagggccttcacagaaggaaactctaatggatctccattggcaggcacctacatggcagaatgtggtctgcaccaggccaggggccgtggcctctgatggagggtgaggcttcctggaccagaagccaggagagcgaggcgagtcgccaaaggggagtgaggacacagactgcagcaggggcccctctgccctctgatctctcattcactggaggggaccgtgtttttcctcccgtcctcagttgtgcttgtttctcatttttctttgcaatggcctggttttcccttccttttggcaagtgtcgtgggtgatatgaagggaattcttgagattgtatttccattcaacctgcctcttctcaggagccactcactgatttcagacaggaattctatgttgagtgtagattacaaaacatttagaaataaagcacggagattccaaaagggattcattctacagggacgtgagactcttgaatatgtcattctgagttaattccattctgtgcttaattccagtaaaggagataaaagagaggcagccgaagacacaggctacacagaactgtgctggccacatgcctcagtgcctcatgctgagggtggggcaagaaagcacatgtgcacacacacacacacacacacacacactcacatacacaagaacatccagggatgtggtcaggttggaagtccacaggagctgagatttgggaaaaatgacaaaaaggctttgctgactctaccctgtgtgagttcaaaattgcactcaactgttagcaacagaggcctgaaaaacagtggcttaaacaaaataggggtacattttttatcttaggcagggcaggactgctctggtggcttcacaatgccatcaacatcttgagctccttctatctttctgttctgccatccttagtgagtggcttccatctgtaaggtcacctcatggcccagcatggctgccagcacccctaccctatctgtgttacaggcaggaagaagaagaaattggggaagaacaaaaagggtgcctttcaaatgcgtcagcatctctaaaggaattccccagaaatccccccagtgacttctgtgtacaactgactgaccacatctgcaggggaggctgcagaatgtggttttgtagcggggcacattaccacattcaacaatatggagattctgttactaaaggaaaggagagagtagacaaggagaaggcaactagcgattctggacacgagctccaggaagacagtaaacagaggaggaaaagtactgccctcctcacccatctggggtacacgggacactatcaataagcgatagaagcccaggactcaagctgtagttaacttgctttcctctcttctaaatgttaaaggaaagttcacatccagggtagttaggagacagagcagcattttaaatgctgtcaaattccagctgaattcagaaaattcagaattttctgaacggtgttgcacaagatgtttttgaatgttacatgaaaaaatgagtccctaatcaaaaagtttgggaaactctggattgaaccaagttgtgcagtttatttgattgcagaaaatgttggggtcactggtgtgctcacttgccttgtgatttttttttttaaattttggacagagaacattcccatatttgaccatggactcacttcttacagaaaatcccatgggataaacattccacatagtaaacatttaggaaataatggtgtggtcagaggctacatctttaccctgccggttttctcaaagcactgcccatgggccacctacactagaatcttcttagctccattacacaactactgaatcacagtctcaggcctgtggcttggaaatccgcattttcaaagctctctgagctatagtcttacgcttattgaagtttgggatccaccaggtgacagagttgtgcctccactttacagacaccatgacttgatcaatttacatccaggtacctcctcctggctccctaaaactcatttctctcatcaccatgtggtacccggataattttctcagctctgttccaagcagcttgcatttatctttattgttgctctttttattgatttaggtccatctctgcaattcgtcaagcttggattgcattttaatcttgtcctccaaagtagctaagatcccttccagcttcctatcatccagaaatctgattagctgggtctcgattccatccttcaagccattaatgaaaacattaaatggtcctggcttggcatgaaggtcttcagggttctcggtgggtatatggctcccatatctgccactagcctctgcttggcatagtcctgggttggagatcaggcccaatatttcagttgtaggttactgcatcctcatgcttcctcatccatgcacgtagtgcaaatctgtgtaggaaaaatacaacctagtaattaattaattcattagacattagatcaacaaatgtctttaaaacactaggtttttcctcacaccagtggcatgttgacctcagaatgaagaagctaatgccgagtgtgtgcattagaaagatcgatttttatgtaaaatgcaactcggatctgtctttgtgatacaccattccaggaggagatgacctcaagacaagcagcttccatgcaatactgcagcaagggcttactttcctgagcatttcccacgctccaatcactgctctaattcctttagatgtgttaactcacttcctgctcacaatacttctatgaggtgagtgctatggttatctcccttttttaaggtactatgcagatagtgccagagctgataagtgtcagagcaagaattcaggctcaagcagtctggcttcagggcccaggctctggaccactcttccatcccgttgcagcagtggttgagtggattatgtggtgggaacagcctacccagtgctcagaacccagaaatgatcagaaagactcaccgtggtgctcatgggttttcagcagtcatctctgttcatgttcccaaaccatgccaatcaatattctttgctgctattgggtagatgaggaaatggagggaccaagataactgccccagagccaaccccaggtccagcggactctttcctcctcagaggcttgccccaggagagaccagctgaacaggcattgcctgggactccttggggaagtggaggttggaaaagtaagtgaaggaacaagcactggggggggggtcagtgttcagttcatcccttgctatggccccatcctcaaacctgtcacaaagccctgccagccagggcacccacaaagcccaccttctccagaggggcctgaatctcttgttgggcttggtgtgggtttcggaggcgatgactgggctgaagtgacctctctcattcaacagactcagccactcagggctgggcctggcctgactctaggagcacaagatgcagcctctgtcctcagagattcaaaggttgagcagacattggccacagtcccggctggctccgaccgtggcagaggctgaaccagagcagaggaggaagcagaggggtgggccgcaagctcttcttggagtctcaggagctgcagagagcaagctgggcttcctggaggaggaggcgtgagagttgggccttgaagtaaggtttcagtgaaagcggaggtgcggggtgggtggggtgggtgttgagggggtgtgaacactcatgcgcggcctcatgagcactggagcagcgctggcggctagtgatttttcagacaaatgcctgccaaagcctctgacataaatcaatttttcacttcattccttctgactcaacccctccgtcaggcactcagcagctgtttcctgagctgatgtacatctcattagtctatcaagctccaacagccaaggccaaggcccccagaatgaaaaactgacgcagccaccccttcctgtgccagagacaggagaagggagggagactgacggcctttgttctctgagcaagaccgtaaagcacttcgcctacaggccacaagagggcgatggtggtccacacataagatcttcccaaagagccagccaaaaacgcctgcctggagaatctggaggttgtgaaaggtgactttgttaaggaagggcgatggcccttctccctgccccagagctctgaaagcctttaaagtggctttagcagcgtggtttaagaatggctccttcggtacaaggacggccatcactgcttctcctactgtgtttgatgccagcgttcttcccgtctgcagggaaggacggagagtgaggagggcacacaggacgtagctggctcctggccatggacggtgaccgctctggggccagcagggtagagctgccttcctacatctgagaactcaagggcgagagggaggcagggcaggggagagggttggtctcagttcacagggcgaccctctggccctggttctgacggcgactcgctgtgtaagctaaggagtgtctcgctctgtacagcgggcaggtggtgggtctctgcacgtccagcatctccagctttccgtcctctgagctgttttgacatgggaggcgctggcagggagagaggggtcactgatgtgggaagctggtgcagagctggggagtagcttgtgatgctggagaacctggagatgcccctcccattccttgggcctcgactgtctcatctgtggaatgggcgggtcagactggataatctctaaccattgcttcccttcacttctgtcccaataaacacacacggagctttttcgtttgtcttttgtcttttttttttttttttttttttttttagagacgaggtctcactatgttgttccccaggtctgagtacagtggctgatcccactattgtccagcacaggagctctgacttgctccatttcctacctgggcctgctcaccctcccttaggcaacccggtggtccccctctccagagaggccaccatattaatgccaaacttagcgcagacacctgatcggcatagtgcactaaagcccagaactcctgggcccaagtgatcctcctgccttctgagtagctgggatgacaggtgggtgccaccactgtgcctggcacagagcctatattggtgctaatacttctgattctgattccattaaaaaacaaaataaaacatgttgccctttggctgtttctgacctccatagtgcccccaaagtgtcccaactggatagtggttggagaccattactgtgaatgcacatgtggcccttctccacacagtgcatctgagggaaaatgacagaacactcaatccaattagaggaggccagcacaggctggcagtgaggagcaggcacgaggctgcgttccctgtgctggctcctgggcccatatgctaagctctgccttcagttcctgcaggagctgtcccttgttcagcctcagatgtcctagcctccagccgatggaggctgtgttagctctatggtggcacatgggccttttgtggctcccatggcgcattaatactttatgtggcccatatttcttcagctgcatcttccaacgctcccattgatttttaaatttcagtgcaaatacaaagcaaaactgaagtttatggagtgtaggagaatccatctgaaaattccctagggtggcaccagagattgtaacattagatgcactaagaaagaaacaactgcagcacattgcttggctctgcagtaaataatatttatatagtcatagaattgcagagcataagagagctgattatggttactgaaatgtatgggagagttagcaaacctaacaaaaaataaaaaaaggtttggggtggggaaaagtagaactgaaagaagtcaggaaccaaagctggaggaaagatagaaggcaaagaagctgctagtaacagtaacaattgcatcttacaaaatgaggagtccggaaatgatgcctaacattgatagaacaagaaaaagaggtttaactattttatgtctagctgcaaaggtaactatgttagtcattagtgccacttgccaagatatttctggttctcctttgttctggataattcctgaccctctctggttagatggggccatgagattagttctggtaactgagttgtgaaccaaagtgatgggaatcacttccagggctagcatttcattaccagtgggatcaatctttcttctagaaggcgactggcattatgtgagatggtggctcttccatcagccttgggttttgaataattacagtgtacagattatgcctcttcctgtcccccatggacctgtaatagacaagtcccatgagtgagaaacaaacctttcttgatagaagccattgggatttggggttgtctgtcattgcagcattacctgctgtatcctgaactagcacataatataactttactaaaaggacaggagaggaagtggtcggggttataggcgagctaagtcttcaactattagaacataaaataaataggtaatacagaattgttaatccaagaaatagcaaaattaacatattatttgagatgtaaaattgtctaaagtggttaccactggggagggggactagggatggaacaaaggaattttgctttgtcataaacccttctctagtatttggcttttgaaattaaagtttgttagtttttgaaatagactaagtaggtacaaaagaggatacaggaagtcagtctatttctcacttctgttttccaatttggaggcaacgccttgccagtttcttaggtattcttacaggagcagtctaagaatacaaaaacataaacaggcttacatgcctttactttcaagtagcattgtatcttggacatcattcctaaccacttatttaaagctgcttttgcttaaaaatagcgggatagtatcccatcgtatgggtatactatcacttagctggtccgctattatgcgacatttgtttctcatttttaatgttattaacaatgctctgtgaatatctttgtaagatgtcatgttacgcatggatgagcctatcaaaaggctaacatcctgaaagtgaaattcctgggtatgtgtataatacatacaccttttgagaaagtgtacaaactgcctacacaagttgtatcaatgttcattcccaccagtactggagaaagtaccctgagctagtgtctcacctataaggtctattgatttgattttaataggagttaaagtggtggggatttattttctaaattacttcctgaattatccattgaaatgaatgaaaacaagactgtaatactgcactggcatgaagagttttaaattaaatctcacattcttcaaatctctttggcgctcactctttgcttcatttacccagcaaatattggttgagtaccttctatggtcagggctgctaaacacagtgagtggatgggtggacggacagataaccaaactgtatttcagatctatagctccagtaaaggaactaatgcagacaaatactagggattctgaatattctttcttttctaaaaaattttatacctacacatacatctacatatctgtatctctcaatgattctttctcggtttctccatcattgagtgtagagttgtagaagcaatgacttagtttgagagtaaaactgtgaaatcatagcatttgcagctcattcccattctctccaacttcttccaccactcataactgtgactgcctctctcccattccccccaggatctcattttttccacctccctcctcttggcttccaacaggcacagatcttcccagttttcagatgaggcttcctttgccactgtgcttatatcaggacaatccaaccaccctattccctggctgtgacatcagcacaagccccctcgtccacaacccagtctcctttctgaaaggaagactggatcccatcactctcttacctaaatatattggtggtacctgtttgcctttcataaagcatggcatcaatgccccgaggctctcactgcttctgtgccaggctcgttgctaagtgctaggtgcacatactattccatttcaccctcctgaccactttcagaggggggtcataatattacccaccttgtacaggtaggagcactggggcactaacgtgactgaggaccaaggacacctagctaggaaaggaaggtgcaggaatttgagtcctgttttcaaagactgcccctaatcacaacacgatggcaccatattgttttgataagctttctgagattactcccaaggggcagaattcaagggtcctacacctttgcttccaggttccctcattgtggtcttcattgtaagacactttgccatgcagctctctgcctctattcctacagtgggaaaaattgaagcataggacggaggcagagattctcagaaaatgttggtgaagtggaatcccactgcattctggtagcatccaatcctgcatgcctcttttcctcacccctttcttcaacctctctgcatctgggctctgcacgtgcctctgttccattctagctaggtcttcggggacaggcacccttgtggccacatgcattgccagcctggggccctgctcttgtagccaaagttgtcttccagcttggtctccagcacactgcccatgaatggctgtgtcccctccatagcttcttgctttctagctccacaaggtagatgtgccttctatccacaaccttcttaccccaagtcagggagctgtccacagctttgtcctgcactacctgcccccccacatacaagacccacccacagtccctactggggacataggagccattccataaacagaagctggatgaatatttaatgggaagtagtatataaacaacttacgtgggtgttgtaacgatctgcagtgaaatattccctcacctcttggtgaaattatcattccgaaccacggaatacattaggttttatgatctacttgcttctttggggaaatacaaatcttaaaacgtcatcttcatatgacagggcaaagagtccccagggacacaagatgtttaaggacgttaactgagaatcagaaatagtttgcgattaatattggggttttgtttatgggcataaataaatcccaagtctagggctgacttataaaaatctgtctgtgatgaaaactctgatcgcaaattgatggaatgggaaaacaatctgaatttaaagaagtgatttgggggcaggcttacagtgtttagaagctaatattttctggccataaatgaatatgctattcaaacattctgagtcatcaactaaaataaataggatagagactaggaatttatattgatggtctacagctgtccaagttctgtaagtaggtcatgtgaaatggagttccttttctggggtcattgaaaggggcctgctggcccttcttccttccccatgaaggcagggaagccgtagtaattctcaacaggaggagggcagaggagtaaacactggcatttggagcctggcgtgactggaagtaggcaggggacctcatggaagaagcacggctttgggagtgggaagatccctgttcgcctcctccccgcctgttagttatgtgactctcacatatccaaccgtgttcaggcctcctccttggtccagagcccatcacagactgcccatggtttctagaacaaagtccaagcctccagatctttagcctggctcctggcatcctctgcaatgtgcctctgccactctctaggctcgcttcccagcacattgggcttctgagcctcagcacaggctctctcacttcttgctccctttccataacctgcagcctctgcccaggatgcccttcctcttagagccatttggttaaaaaaactgctcttcttttaaaacagctcagaagtcatctcctctctgaagccttctcagagtcccctgggaagaggtagcttaacccccttctgactttctagtaaaccctgaatatcttgtagtcttgtggccttgtggtacacagaatgagtagaatatggttccctgtctcattggtgttgaatctggctaggtggcttgtttagtccagggccttaagaggcaatgcactgcttgtgttcttttgcgcttctttgattttccaaggggaatgtaaggccatgtggagcaaatctgatcccaatccaaacctggagccaattccagctgacttgcatcctaaggcagagctgccctgggcaaactatacaactggaagtgaaaaaaaatgcttgttgttggaaaccactgagttttgaggtggcttattacacagcattcatgtggcaatagctgaccaatacattatcaccttggggctgaacctcagagagaagtgtaagcagaagaaagtatcagctaagtgtggaggagctaaaagatatcagggctgctactctaagcctctcagagaagccgacctttggtgtgaggccgtgtctaacatggaagtggtagcactagagagaagaaagatctggatagatgggcagagacagtgctcctggatggatatccaattcctggatagagatccaggaattcccacatggcctggtgggggatgaggaacctctaggagaactacttgacttatatcaattaggggacagcacaggtgagctacaaagcacaggttcttgggacctcaggctatggaaggactttaattatctccttaataccccccagaccagaccaattaccttccgcaccaaaagaccccatcacaggacgcccaggacctcacagaatggggatgcaggagtagaggccagtgaagacccagaggggaacataagcacccagggtcattcttcccgtcactatgctggtaccatatcagaaattaggaggtggggagtggagaatctatgaacggagaaaaccttatgactttatggatgttaactttaaatcaactgaaaccatacccaagagactattctaaatgggaagagatggagttacctttaattaagaagcttaagatgcccctgtcctaggttgaattccctcatcagagaaagggtagaggcttgggtacaagataagacatgttgcagagaagacagttattattattattattattattattattattattataacatctaagttgtagtgggtaattgtttactttacttgctatgacctgaatgtcggtgtccccctaaaattcatatattggaacttaatttctaaggtgatggtattaagagatggagcttttgggaagtgattagatcataaggactctgccctaatgggtgggattggtgcccttataaaagggttttaaggagtgagtttaccctcttctgcccttccatcatgtaaaggtacagagaaggtatcatctgtgaagaacaggacctcatcagacactagatctgctggcaccttgatcttggatttcccagcctccagaattgtgagcaatgaatttctgttgtttataaattaccccgtctaaagtattttgttatagcaacaggaatgaacttagataccactatacacactctgcttgcactgatggtgctttggaggttgaaggaattgggtgttcgatatgtgctgaagagttaagggaaaagggcagttgttgcatgttactggaattgaaaagtagaaaagcgaacatttatgtgactaagaaaaatggaaatcccttagccctgaagatcttcagtgatattaggaagattctctctttcccatcacatatggatttagggttaaagtcactccacttaaatattatggcaacagagaggcgctcaggacctggagacctccaagctgctgctgacttttgagtttcacaacgttgagaaggtagggggtattattttcaatacatctcttctagagaaggatgaaataaaatgtgtgtgtgtgtgtgtgtgtgtgtgtgtgtgtgtgtgtgtgtgtgttggggggtgattcaggagaatctgaaataggacagcctgatactgaattgatcatcattgttgctgtaacaaattagccacaattaacacaattaactttagtggcttaaaaacaagcctccactgtgtttggaggaaactagcaggcaatgggattggttagtatccaagatcattgttaagtgtcagagcaggcaagagcccatccctgatggaagcctgaaatgtggggtgagaatgactcatgggagagtcagtgactcctactctgcactttgggtcaaaaagttgtatgttgaaccgaataatggtcccctaaggatgcccatgtcctaatccctggaacctatgaatgtttcattccatggtaaaagtgactttgcagatgcaactaaattaaggatcttgacatggggagattatcctgaattattaatatctgggtgggcgcaatataatcacaggagtatttataagaggaagacaggagttgcagggaggggaggcgatggaagcagagaactgagtcatgtagccataggccaaggaatacaggcggcctctaggggctacaagaggcaagaaacagattctttctagatcctctctcagaaggaaccatccttgccgacaccttgatttcagcctcagaagactcattgtaggcatctgactcccagaactgtaagagaatgcatgttgttttaagccactaaagttaattgtgttaattgttgctaattctttacagcaacaatgaaaaacaaatacaagctggaagcaatataatggaccaacaataggggactatgtgacagaagctgtttttgtagaggaacacacttacgggaagtagtgtagagtctgaggttttgaggtgagcagatgtggaggtctgagtccagttctatcctttctagtggtgtgatcataagcaagtgacttatcctctttgagcctcaatttcttcatctataaaatggggatacccacctcatagtcttgtgagggctaaactgtgcctggtacacagtaggcactcactcagtagtaacgtctattaccattatcatagaaaaaaaatctgaaaggacctaaagcaataggaataagagaaaagtaataaaaggtgcgttataacaattaaagaatctggaaatgttcagagttttataaaggtctaattcattctcaaacaatgagctacagtctctttgtagctctgcctcttgggtaattttttttattacttttactacttttatttttacaagttacttgcaattaaatgttttatcttgccagttcttttaaaaaaattttcaaagtgtacaacatttgtactgtcttccgttaaattgcttttgcccacgtggtttgctcccaaggttttgaggtggtagggactctgagtgagggcagaaggcacacagggaaagaaaaagggagcttggcctcctgcagtctggagggacagcctggggcatctggggacagagagcaagcaccctttcatctgatacttaacgctgggaggaaaaaagcaaggttaaactgtgactttaagcaaatcatgtttacttaagtaattcattgtgggtattttttgaaaatggcttaaaactatgtctctacttagtcatgcagatattagcaggtaaggagaactttatttttaatattaattcaacagacatattgagcatccaccatcggccaggcagatcaaagaatggatctgggagggaagtagtgagtggatgaagagaaacacaaaagtgagtaaatcaagctaaccagtttccataagcctattatctactttcacatttttccatatttaccttatatctctatttctctttttattttcaaaataatttgaaagtaattttcagacatcatgattcttcatccctatatatttcaacggaaatctctgctatggattgaattgtgtccccctcaaattcacacgttgaagccctaaccccaaatgtgatatttggacatggggcacttgggggtaattaggtttagatgaggtcacaagggtggagccctcacaatgggattagtgcccttgtaagaagagataccagagagcttttgtgctctttctctctctgttgtgtgaggacacagtaaaaaggcaaagctgtctgcaagctgagactacagctttcaggaagagggccctcacccaagttcaactatgctggcaccctgacttaggacctccagttcctagaactgtgagaaataaatgtatgttgtttaagccactcagtctatggtattttgttatcacagcccaagtagagtaagatgattgcctaagagtaagaacatattcctttattaccatctgctattattactaagaaagttaaacataattctataaaatcatctaatatcatctatattctaatgtcccaaaaatgggttttatacctattttaatctactctgattttattgttgttgttttacttacctggaataaaactgacctttgatcgctgttgccaatggcatgtctgtgcaccatatagcatttgcttgcattgcagagtcctgtttaaaagaaaatcaccaggctctgccaagcttgacctctaccttcctgttaaataacatcaaataccatgtcttgaaaaagctggaccctttcacctcccctttctaactgtacctgggaggagcttaggctctcttcttatggaccaactgatgttcactcaggtaggatgaaatggggtgcaagaaattaggttcttcagccccttctgcagctgccaattttgaaatgatatcatttgatttggaaaatattaagtgtccaccatgtgcaggggcctttcacatgaattatcttacatgttaaatactcacagaaactctgcagaatatagtgggaccataactccttttagggctctgggtatacaagaaatgttattattctttatttcctttaagtcaactttggactctttgagttcttgttttaccatgattttttttttttttttttttttttagcattctgcttcagttgttattggggtcccccttcctgtcttccttcctccttccctttcttttatccacctacttcccttaatcccctctatcccctttcattccccttccattctgctcttccccacctcttcataagtcccttctgactccctcttccctctgctcttcctcctcccaccttccttttctctctgccttcttaaccacacagagctccctgtgggtggggctgtggtccatactaataacagtaaattcccatttatcgagtgctcactgcatgccaggtgcatggatgagtctaattagtcctcacagcaaccctgtgagaaaagttgattggttatgatgctttaggctgcaagtaacaaaacccaactaacagtggcctgaatcacaagacatctatcctttacttaacatgatggaggaggaggatgctggccttatttcagctgcccagtggcggcatcaaggcctccagccttctgctctcttcttctccactgggcttattcctgagcatctgcagtatggcaactgagccccacatctgcactcaaaggcaggaggcagagtagaggctatagttgtgcgaaactttcttttcctgttgtgaaaggaaaatatctcaggcccccagaatcactaagctaaagggaaaattcaagctgggaactgcttagggcaaacctgcctcccattcttttcaaagttattcctctgctcactgagataaatgcacatctgattacctcctttgcaaaagtgaatcagaaactcaaaagaattcaaccatttatctctcacctatctgtgacctggaaaccccctttccccttcgagtcttcctgcctttgctttgagttgtcccgcctttccagactgaaccaatgtacttctaacgcatattgattgacgtctcatgtctccctaaaatgtataaaaccaagctgtgccccgaacaccttgggcacatgttgtcaggacttcctgaggctgtgtcacaggtgcacatcctcaaccttggcaaaataaacttcctaaattaactggattttctgggaccactctgtgcttatctctctttaatcttccccctctcaactcattggcctaacatgtgttacttggtcaccgctagccacagggagactgggaaactgagtgttgagcttttttagcctctgtagtggtgagaagagagaagggatttgggaatttccttcgggtggccacttaacactgtctgcctcataattggccctccttttacaaaagaaaaactgagactcagaagagttcttattcgctccaaggatcaagctgctaagaagagcttgaatcaacatttctttgacttcaagttcacaaaattttcaataagcaattcttactgactgagggcattctataaggcacacagctctcttgccacccttatatgtacatttatttattcaaacatctctgagtgcttattgtgtgccaggcctgggctgaacaccaggggtccagagatggatgagcagggcacagtccagtgggctcgctgatgcattaacagatggttccagttcagagtggtaagtgcgccaggagagctggcgtgtgagcacagatgaagggtgttaatgactaagcttccaaaacataccttgcccaatgtcacctgctagagggtggcagagcagggactcagagtgtgagttgtctaattacaaagctggaaccctgcccctcttcccttgcaccttctgccatccacaacagccagtggagggagcaacagtgacacccaagcaggcatggaccccagctctatgtaggtggcttctgaatgatgatggttctcttcacagcattccccagaagtgatggcatgagcttaaagaaaacaaaagcagcgctatctccagaataatccccctgcaagcctgttcaaagtgttttttttcttaaaaacaaaacaaaacaaaacaaaactgtttggtcacatctaagctggtctcagcagagtgaagctagccatctagatcttcatgtcctagctacttacttttcttcaatggtggcattttcccccttaactaaggtcactcagttccccacttggctttacctgtggttggttgtaggctgtaagtgaaaggaaatgccaacttctcacaacttggagaaaaactcagcccagtcatggcttttcctcccactgtagaagctgaaaatgccagacacatcccgatctcccttgcaccaagcagagccgtggcctgggctcagccaatcagactcatcgctcctgagctgaattacaagcgaatgaagtggagaaggagggaccctgcaggatccattctagcaagggcgttggcagccacagcagccacaacagtttccccgaggcggcagatctggtggctgcatctgaatggaacagcagagggctggcattgtaaactatgagctgcaggtccacagcagcaacagcggagtctgcacagggccggttctgagcctgctttccaacatcatcccagctgtatggcctccaaggctggttttaggctctctcatatactctgtgtgctatccaatatcctacaataaattcctttctggtgtaaatcaggaaaaattagtttgttgcttgcaaactaagcaccctggctgttatatgcacaacttctggaagggcacacagacacaatccattactaaaatgactagtcttattgaaagctttctactgagcacaaaagatgctgcaaactttttttttttttgaactggacttttgatttcagaatagttttagacatagagaagaagtgcagagtagttcaaagggttctcatatattccatagccagtttcccatattcttaacatcttatgttagtaaggtacagtggttacagttcataagccattactgatacattaatactaactaaagtccaaacattattcagatttccttaatttttacccatttcatctaatgtcatttttctgttccaggatcctatacagaataccaaattacatgtagttgtcagttctccttagcctcctcttggctgtgacaatttctcaggctttatttttggttttgaggaggactggtcaggtattttgtagcatgcccctctactggcatgtgtctaatgttttcctcatgattagattggggttatgggttttgaggaagaagaccacggaggtgaagtgccattctcgctacatcagatcaagggcacatcctatcaacatgacataagacattgacctcaatcacttggttgaggtagcggatgtcaggtttcttggctgtgaagttactctttttcccccttttcatactgtactctttggaaggaaggaactatacacatcctaaaattacagtagggaattacgctctacatccttgagagtggggtacctacataagctatctggaattctgcaagggagatttattccaaaccaatataaataagtgagtgaataaataagtgagagatctattctattttctcctgcttatttattcactcgtttatttatatcagcgtgacaccatggatatttattttgcactttgggttacactctagtactactttattttggtgctcttggctttgggaggccaaggcaggcggatcacctgaggtcaggagtttgagaccagcctggacaacttggtgaaatcctgtctctactaaaaatacaaaaaattagctgggcatggtggtgggtgcctgtgatcccagctactgaggaggctgaggcaggagactcacttgaacccgggaggcatgggatgcagtgagctgagatcccgccattgcactccagcctgggcaacaagagcaaaactccatctcaaaacacacacacacacacacaaacaagcaaacaaaagaaaccaagatctaggtgctaggcatgggtgttgctactagggtgtcattgcccctggagtgtcattgcttctaggccctctcagctgacagagcaaggaaatatatgtgtgtacactaaccggtgcatatccatatatccataaatatttctttgtgtagccatctggatctatattaagtttcacatgagtgcttgctgatgtcttcaactctgctctattactacatcgatcagtgtagccttctccccttgcttacctgtaacctctcactccaactgtg

SEQ ID NO: 12400 - DNA, 43550 bp, Human
gggctgtagaaatggcggccccatctcccaacaacttgggcattgtgaatatcacctccttaaaggggatctcctttggtcatcccgtctagagcagccaccataacttctgagcgtttattgctagctgatatatatcagaaaaatacaaattccacaaaagcagggactggtctgcttctctccctgcagggcccaggttctggcacatagttggtgcagaaagtgtgcagcctcaggtcctatccaagcccccagggcatcacactcgggacttgttctgcatatttttacttttgcctcccactggtactagttcttccgtggaacagcctgagtcccttcagatacttaatgttttttctcaagtgctgccatgaagccagatctccaccgtcttggggcattcctttttagggatgggaagtatatgtcgctccttttatgtgatttacattctatcttggataatttggccatcaccgtagttcattcagatctgtttggatcctgcccatctcagcttcagtccatttcattcttttaaatctgatcgacagttacctccaacagcttcatcacaaatcactcacaaaaatggccttaatcctgaagtttatttacggagagcacacttgctaggtgtgtggcagatatacaggaagcacaagatgaggcagcagatctagaggcaaatgacttccttctccctgcctagtggtgactgccagcatcacgccctcccgggagaggtgagaaacccctccacgcaagcactggaaccttcacagtcaagagtggcaacagctccggttactggacttgggcctgttgaattctaatactctgtgactccacatctgggctgaatttttgctgagtatgatggaatttacatgcttcctccctagcccctacttgtctgtatagttggaatatttggttgcctcctctggagggatctagtacgtttagagtctagacgctggaactgtcaaagttcagaggaaagagctccagctgcaaagcaagagaaatgggctggaattctagcttcaccccttaatgaatgcttctgatttttttttttttttttttttttgagacgtagtctcactctatcgcccaggctggattgcagtggccacgatctcagctcactgcaacctccgcctcccagactcaagcgattctcgtgcctgagcctcctgagtagctgggattacaggcgtgcgctaccacgcccggctaatttttgtatttttagtagagacagtttttggccatgttggtcaggctggtcttgaactcatgacctcaagtgatctaccttcctcggcctccgaaagtgctgggattacaggcccgagccaccgcgcccagccgcttctgatcattaaaaaaaaattttttttttggcggggggaacgaagtgtccctctgttgctcaggctggagtgcagtgcagtgatctcggctcactgcaatctctgcctcccaggttcaagcgattttcctgcctcagcctcctgagtagctgggaatacgggtgccccccaccacacccagctaatttttgcatttttagtagcgatggggtttcgccatgttggccaaggctggtctcgaacttctggcctcaggtgatctgccttccttggcctcccaaagtgctgggattacaggcgtgagccaccgtgcctggccaaaaaatttatgttttaaaaagactagtcaagtgcagtagtgagaaggggggaaagagtagagcaaggagttatatctgttgcttctgaccattttgaacaagttacctaattctctgaggacaagctcggagaatgggagagacagttatctatttgcagggttgttgggaggaataagtgacatcatgagtgtgtgccaggtgtctgattacagaaggtgttcaattaatctgcaatcattaattaacccttcagtcgctggtattatttgccatccatcctccgagtgttgccaagttatgggtgcgttctgccagcgtcctagcagtggtaaggcttctggctgccagcggcgaacctctcccttcgagtatttctcctcttgctgagatgaaatgcgaccgggtctctttaagggccaggcgccgggatccaggcggcgcccaacggctggactagcagtcgtccgcgccgactcgcacaagaaggaaccccgggcctctggatccgctcgcccggctatgctgctgtggccgctgcggggctgggccgcccgggcgctgcgctgctttgggccgggaagtcgcgggagcccggcctcaggccccgggccgcggagggtgcagcgccgggcctggcctcccggtaacgcgcgtcttggtcccgcctcccaggagcccctatgcgcccacctactcccggcccctcggcttccggaacccgcccgagcccgaagcgcctcttccgaggcgcgggatttcctccccggctgcggctgggacgggggcggccatcggccgttacccgggcgcgagaccgcagcgagcgctgggggcgctcggctttggttctgggatggagagagggcctttaaagagcaggacggacacgctctgaacattccggcccaaactcggtcccccgacccatttcctgtcccgattctttcgaccttgggggcgatggggactgggagctgccttaagccgattctgctcacactctggtgccagcgtgggggaggggggttacgcccccggcgctctcctgccctccctgggagtggggacccacacagaaacgggtcactgttacacccgggttctggtgtccgccatatggctgttgagagacgcctcagaaccacctgtgggacggatgggcagcgatgcccgccctgggcctagaggaacacctgggtcccaggcccaaaaccacgtccgccgcccactcttccccgtgcaccgcgagtggaggctgttctgcctttccacttgcttaacatccagtctgtgaagatctaaataaataacgtggaaaatgcaaagtataatgtactaagtgaaagaactcgagcacactgggggtccacgaagctgcagctgcagcccagggtggcacatcggcgagacggtggtgcgcgcctccaatctcggagggcgcccaaaatggaaaatgtttttaggccagggagtgagcataaacattagtgtttttgtggtcatgtagcaaattagggcagaggagagttatttaaaagtgagtttaaaaactgatttcctttcttttgtagataaagaacaggaaaaagagaaaaaatcagtggtaagtccctcttttatgtgtactctctaggataatttggttttttgaagaggagagagaaaaaagcagagtaaaaagcaaaaatacattccatagtaaaaagcaaaaatacaagaggatctccagggagaaggaagtctgtcaccctcctagaaggccacctctgttaccaatttcttgtatctttccccagagtctgcacagataggagcacacaagtatttgtatccttcaggtagatttgggctgttaaagcttaagggatgattgtgaaaggatttgaaaaacgctcattgtgttgtggggaaggtcagtttcatcttgggttgggcagctcagatgtgagggaagctctgtccaccaccaccctctccccccagtgttgagactggtgggtgggcaggggatcagagagaaaccattagggtccacagatgtgggttcagttatcagggtggctttgagatgctggctctgggctggggctgtgactagtgtgaggctgaaggtcaaagaagggtcaggttggtgtccatggggatattgggtgctttagctggctggggtagggagtgatattttggtcacaaaccaaggctcaattccttaaaagaactgaaagtccctagctccagtggctgggaagggggtggcttggcaagtggtggcaggagtaccgtggctgggatctgcagagggtagacagtgcgggcaggcccccagcgtactcagggtggtggagagctcttgggaagtagtgaaaccacatagagaggattgaaatgcttgagatttgtggaagtttgttgaaattaggagaaggatatgccagcgggtgccatagaaggggagggaaatgcaaagttgagctggatggtaattaatgtatttttgtttgtttatacatttaagagacggcgtcttgctgtgttgcccaggctggcctccaactcctgggctcaagtgatcctctggcatcagcctcctgagtagctgtgatgacaagtgtgagccactgtgcctggctatttattagttattgagctagcattgatgtgagctgggcctgttctttgtgctttttgggtgtggtttgatgtgcccccagacacacaatagctagttcatagaaagtggtatggagcctgcattcaggctcaggactgtttgtaaacattcaagtcctgtgagctcctgtgtgggatgcactgggctaggacctgggcacctggcaaacagccctgacatttgggagtctgcggtctgtctgatgggggaggtttgtctgatgggggaggtctgtctgatgggggagacagcagtaactaggagaatggtggaactagaacagcagtgagtatggtggctgtgagtaggggggctgatgactgagaggagctttgggaagccttattgcctgctgggagatggagcagagtttgaggcaggagtgttggaacaggtacaagtcacagaagaatgagaacctgcaggcctgggcttgtggccagtccctagagaggtggctggggagggctgggggataggtgcagagggactgagaataggtcctaaaacccagagtcactgaagggcctcacccccacccagcacgatccgggttgcctctcagggagcgatgtggggaaccatgagtggagggcctaactgggtgagactggaaggggagagaccttaactaaactagagatggcacagagcccgcagctgagtgggaaagcagggcccaggggagttgctggttggttgactggtgttggtgggtgaggagagatgtccagagtgttaaaggtgtctgggtggatggtgcagccattacatggcacagtttacaatattagataattgagtatcacaacaaagttttttaataaaataactggacagaacttaacatccaacagggccatacctaatggctcatgcctataatcccagcacttcgggaggcaaaggtgggaggattgcttgagctcaggagtctgagaccagcctgggcaacatggcaaaatgctgtttctacaaaaaatacaaaaaattagctgggcatggtggcatgcaccagtagtcctagctactcgggaggctgaggtgggagggttgcttgagcctgggaggtcaaggctgcagtgagctgttattgcattgctgcactccatcgtgggcaacagaacgagaccctgtctcaaaaaaaaaaaaaaaatcaaatagtagggagttcaataaattgtgacaggtcttatataatggattatgtaaagccattaaaaaccatgtttttgaaaaatatttagtgacctgggaaggcactcactatgtaaaagatgaaaaaaaaaaataacaaaaccaacaaaagtatatgaagtatgatcccaaatgaaaaaaaaaactgtccttaggaaacaaacaggaaagaaatattataaacattaatgccgaaattctcagtctagttaagagatagatgtggggttaacaaggagcatgtaagagagagtttgtggtgtgatggggtaaaagtgtcttcccttagttatttgaatgttaaatgaaattcagctgggttcctttttaaaacagctttattgtaatttgcataccacaaaattcacccatttaaatgtgcaattcaatgatttttagtaaatttacagagtaaacagcactacagagtaaacaccactacaatctaattttattttattttatttttattttttattttttgagacaaggtctggctctgttgtccaggctggaggacagtggcacaatcacaacttactgcagccttgacttcctggtctcaggtgatcctcccacatcagcctcccaagtagctgggactacaggcacataccaccattcctggctaatttttgtatttgttgtagagatgggatttctacatgttgcccaggctgtgcaatctaattttataacatttccattactccaaaaagaaaccttgtgcccatttgcaatctcttctggccccaggtgaccactaatctacttcctgtctctttagggatttgtgttttctggacgttccatataaaatggaacatatagcgtgggatcttttgtatctggcttctttcacttagcacattttttttttttcttttttgagatggagtttctctctgttgcccaggctggagtgcaatggcatgatcttggctcactgcaacctccgccgccagggttcaagccattttcctgcctcagcctcccaagtagctgggattacagtcatgtgccaccacgtgcagctaatttttgtatttttagtagagtcggggtttcaccacgttagccaggctggtctcgaactcctaacctcaggtgatccgcctgtctaggcctcccaaagtgctgggattacaggcgtgagccaccgctcctggttgcttagcataatattttgacatgcatctgccttgtagcacgtattagtatgtcattttttcctatagctgaatagtattcatggcgtggctgtagtgcactttgtttatccacttgccagttgttagacgtttgggcaagtttcttttgactgcagatttctcagggtctttgataagacaggatatttggattctccctgtggaggctttggcacccaagccagtttgcctctggaaccctgggttctaattaaacatccaaatgacaatgattgctgagatttacgagtgatttttattttcttcttttagggattgtgtaataaggtttgatcagagaaatccaactgataaatacatatatgcatattcataaacatatacatatattcatgcatacatacattcttgtgtgtgagaatgtatttctttttttttttttttttgaagacagggtctcactctgtcacccagactggagtgcagtggtgtgatctcggctcaccacaacctccacctctcagctcccaagctcaagcgattctcttgcatcagcctccccagtagctgggattacaggcatccgccaccacgcctggctaatttttgtatttttagtagagacggggtttcaccatgttggccaggctggtcttgatctcctgacctcaaatgatcccctgcctcggcctcccaaaatgctgggattacaggcgtgagccactgcgcctggccactgagaatgtatttcttagcacaagaatgcttaatttccatttttaggaaagattaaatattgttacttataatagggatagatggctcatcacagtttcagttataatcatggaaaattggactcaagggctcatagcagaggaaaatggagataaattgtagcgtaatcacagagtgttgggccaggccggccatgtgctcccacagcatggggaccatctccttttcacagtttcctgttgctttcctccacacactcatgagctctttggccgttgcaacgaggccctgagtacacagtgcctggcacagcataggccttcaataaacagttgaaacgtgctcaaagatgaggactgtatagaaaataatatttggcatgaaatatgctcatatgtcatggggtttatctcttagtattgggattatgggtgatagtttctcctttttgattttctgtattttcttcaatgggcatgcacttctcttataatatttttagacatcactttaaaaagaaatgtaaagactccctttgcttgcttcctgttcccccttccatttcaggggaactttgtgagattcttcctgcgttgcctgctgtaaaccggagggcagattggctgagctcattcagggcctgacattcaccagctcttcaggatttcatgctggggataggaacaagtttctgggagaagggcttatctgaacaacctgttaaaatgcttcaatgaacaggaaagaaaaaagactgtagagtgatgtctaggttgagctctttttatatatctaggaagaggaaaagttttctttaaagagcaataaaaaaattaaatccattagtgccctaatggggtcttttcatgcccttttgttcattcccttgggttcattttgtagtttggggctctaaaggagtgggctgggagggacccaggatgggagagtggccttgtgtctcctggatacccgttaggatcaaggcaggaggaaccttctccgccagctgacagagttctagttgctggggagactttagtggggtcgggtgagacggcccactgtgacctggtgtttatgtgaggtgtgactgaggctccatcaggagtcgtgagaaggggcctggatgtgaattctaattctgattcttccctagccaagtctggcacttgggtaagttacctgtgttgcccaggtttctctgggtgcttccagcctgagtgcaaaggaacaggcctctgtgcagcaggtcgggcccctctctgtgtgtgcccctggaggatgtctaatgtgttctcaggggacagtttgtcttatgtattggagctgcccgttccctgtggccatctgctggagccagagccactgggcctatgtcatcagcagtgcctggctgagcagagcttggtcagaatcactgggctacaggttcaagggctccagcctagagtctgatttagggtctggatgctacctggtgccacctcatgtttaaccagctcctctggtgcatctgaagcaggcatctgtggactagacagggagaagctctgctccagcctcgtggttcccatccttgcctgcacattgaaatcgcctggagagctttaaaagttactgaggcttggccgggtgcagtggctcacgcctgtaatcccagcactttgggaggctgaggcgggtggatcacctgaggtcgggagtttgagaccagcctggcctacatggtgaaaccatgtctctactaaaaatacaaaaaattagccgggtgtggtggtgggcacctgtaatcccagctactcgggaggctgaggcaggagaatggcttgaacccaggaggtggaggttgcagtgagctgagatcacgccactgtgctccagcctgggcaacaagagtgaaactctgtctcaaagaaaaaaaaagttactgagtcttgagtctcactcccagagattgtggtgtaattggtctgggctgtggcatccctgtagagatttttaaaaggtcccaggtggtcctagcgtatagccagagctgagaaccgctgcctggaataccttctctccctaagatgagttacttctaggatgctccttggtctttggtataggtagacccagaaggctgtttctggcccctcccactagtgccatgaccccctttccctcccacgtgcagtcattgtgagcagagtctaggttcaagctgtccttgctttattgtcttctacaagcctcatttttgttttctgtgaaaaatgttaggacttacccttctcaggtttcagtgaggttacatgtgataatggtgtgttacctgtctcagggcttggcctgtgacaaggtgcttaacaaagtccttgctctttttttcttctcccctttcctaatggtttccagtcagtgaccaagtgctttttttttctgtaaagcagtgaattcgattctagataacatatatgtgtttcctagcctcaaagccattgattaagctctcgttaaggaggcaggacacttaggcctaaaatctaatagtctgtggggttgaactaaggaagggcagagctgggctgggcagacaagctgtgtatggtttaggagttgacgtaaaggaggatctggtctggggggaccacatgagcctgccactcagggaggatcggcttatctgttattactaacaatgggaccttgccagtttcccgaggagggattttggtttacatgtgaaagtcttggactgaaccaattatgctggttacatgagccctttccgtagccattattccctgacattcccctgggtgcttgagttctggctctaatatgcattcgtcttttgccagatctgtgtcgagggcaatattgcaagtgggaagacgacatgcctggaattcttctccaacgcgacagacgtcgaggtacagcctctatgctaggtttgaaggaagcggagaaagcttgatgggataatttatagagggtgtggactaaccttgtccaataggactataatttgagccacaagtgcaagccacaggtgtaatttaacatttctaatatcctcattaaaaaaacaaaaggggccggtgcagtggctcaagcctgtaatcctagcactttgggaggcggaagcaggtggattgcttgagcccaggagttccagaccagcctgggccacatggcgagaccccatctctacaaaaatatgccaggcatggtggtacgtgcctgtagctccagctacttgggaggctgaggtgggaggattgcttaagcccaggaggtggaggttgcagtgagctgagatcacgccattgcattgcatcctgagcagcaggagtgaaaccctgtctcaaaaaaagaaaaaaacccacaaaaaataaaaaggacattttatttcacataacatatgccaaatgtgatcatgtcaacatttaatcaatataaaaatcatcaatgagctattttgcattctatcttgttatactaagtctttggaatatgatactggttgagcatcccttatctgaaatgcttgagaccagaagtgttttagatttcagaatttttcagattttggaatatttgcataaatgtaatgagatatcttgaggatgggacccaagccaaaacacgaaattcatttatgtttcatatatacatagcctgaaggtaattttatacaatattttaaataattttgtgaatgaaacaagtttgtgttaagtatttatgtgtggaatttttcatttgaagtgtcatatcggtttccagaaagttttggagtttggagcatttaggattttggatttttcaattagggatgctcaaactgtttgtatttgtaaaataagtgtaacttatagcatatcttaatttggactactcatatttcaaggtcttaatagttgcctgtggctcatggccactgtattggacagtgcaagtgttgactgcctcaaagtctggttaggaaaagagtctacatgggtaagaagaaaggacaggctattgagcagggctagaagtgtgacatctgagatagcaatgtctgagcagtgggtattactatgcataggcaattaatttaatttctagttcatttaaagcctagtcactaaaactaacctcagagatgtttaagaatcatctctacactaagacattgacctgtcttccttgttctagattttagtggtataatcttctctattgatggctctcttttgttactacagaagctacaatttctatacttttatagtcattttctttccttcttcccttcctttcctgtttttacttctgctagaaatatatgcatggccaggtgtggtggctgatgcctgtaatcccagcactttaggaggctgaagggggaggatcacctgagcccagtagtttaagagtagcctggccaacatgacaaaaccacatgtctacaaaaaatacaaaacttagctggatgtggtggcacatgcctgtagtcccagctgctcaagaggctgaggtgggaggattatttaagcccaggaggttgaggctgtggtgagccaggactgtgccgttgaactccaacctgggtgacagagtgaggccctgtctcaaaaaaaaaaaaaaaaagaaaaaagaaagaaagaaaagaaatatatatagtttgataaaaataataataaacattatatagcccttgtcctgctgtgttcatgtgctgctgtgcaggaaagagttaacatagcagacctaagactgctgccctttagaaatgcctgcttgcaagggtggtctttggctggcatctgggaacttagatcttgggagggcccccaccattcctaactgataacagtggctctctgcttaaattgtttctgcaaacagtatggtttatgctgacacctgctttcttcctgggagtccggaattttggtacatgtcaggaagtggttgtctgcatggctgagcgctgatgaaaaccctgaactcccaggttcaggccagcttgcctgctagacaacatttcacatgtattgtcacatcttgttgcctggggaattcagtgtgtactgtgcagctcctctatgagaggacccttggaagcttgtgcctggtttcctccagactttgcacctgccctttttccctttgctgatccttttttctttttcttccttttttttttttttttttttttctgagatggagtcttgctctgtcacccaggctggagtgcagtggcatgatctcggctcactgcaacctccgcctcctgggttcaagcaattctcctgcttcagcctcccaagtagctgggattacaagcacccaccaccatgcccagctaatttttttgtatttttagtagagatggggtttcaccatgttggccaggctggtttcaaactcctgacctcaagtgatccacccacctcagcctcccaaagtgctgggattacaggcgtgagccaccgtgcccggtcccctttgctgatcttgttttgtgtcctttcggtgtaatccatcttagctgtgagtatgactgcgtgttgtgtcctgtgagttctcatgaatcatcaaacctggggaggagggggggcttggggactcttgacccctgtcctgagtgatatgactcttaatggcactttagaagtgcttatagtctcactgaagaccttggacccgattaacaacgatagttaacatccagtgagtatactgctatttgcccaacactgtgttgagggttcatcataaatactaaatgatctcaccctcacaagaatagtccctctgaagtaggtaccatttttaccacagttttagatgaggaaaccatggcctaatgaggttaagtggcttgtccagggtcgctaggccagtgtatgatacagccagatcccagcccggatacagccagatcccagcccaggctgtctggttccaggggccacacccttgtttgattctgtggtacgaagagctttgttggctttaggaagaccactctcccttcagatctgagctccgtgtcccctgaccttcccagcgaggttatgcttcctgacagaggatcccctggccgctctgtacctctcttttataccacttcttggggtttgaaaacatgttggcttctgtgattacctgagtaatgtctgcttcccctggtaggcttaaggttctgtgaaggcagaggctgggctggttttgctattgttgtgtcctcagtgcctagcatggatatctggcacacagtgggcactcaataaatgtttgttgggtgacagtgctatggatggagcacccctgagctgggtcggggagcaaggctgcctgtgacccagactctggtgggcctgtgtggtgctgtgtatgctacttaggggctaggaagaagacctagaagaaggagagggggtttgagaggggcaggggaagggcatatttgaactggattttgaagggtatacaggagttttccatgtgatgaaagttgatgtgaagtggaatggggtgggaatgctggtcagaagaaacaacgtaagcaaagacacagagtatcttgcttgagggtggatcacttgaggtcaggagtgaagggtggggggtgattacttttcttttctttttagagacggagtcttgctctgtcacccaggctggagtgcagtagcgcgatcttggctcactgcaacctttgcctcctgggttcaagtgattctcctgcctcagcctcccgagtatctgggattacaggcatgcaccactacatccggctaatttttgtatttttagtagagatggggtttcaccatgttggccaggctggacttgaactcctgacctcaagtgatctgcctgccttggcctcccaaagtgctgggattacaggtgtgagccactgcacccagccagggtggctacttttcaagagttccatgcattgcctgccattggtcttttgtcacctatggccccttctcacatgtactctgaaagttcccagatggatcctggcactctgaagatcttggccccaagaacaccatttaaatcttttctagcacacacctgcatacccagaaaggctctagcagagtctggggttgtcccagatttgtgtgtctagaccacagatggaggctctagaaatgcccagcagagatcctgatatgtgtctgaaaacacacaggatgttggagagattggcagtcatcctaaaaggtacaaacaggaccagagggaaagaatgcctccaaaccagtgagacagggagcgtactaaagaaacagggactatcagcagccagtgcacccagtgcagtgatcagaggcaggaaacggaggcaggtggcctgccaaggcctagccctgtccagtgtccctcctggcttctcccacccacctgccagcttgatgtggtaggcaggcaggggtgggatagaatacacagaagagggatggacagagccagctctgaccttggggaggctaccagggcaatagagaggtaggatgtacctatgcttggcacattgggtaacatggatagagttattctcaggacatttctggaagtaatgtgaggaagccgtgtctagatagagttgtgacctcacgggggttgtcagctattttggcctaccttgggcacccaaatttggatagtctttttctctctttttcccttctctcctcactttcccctcaacacttacacacttttacagggttcagcacagagaaacagtagctctgatgttttctttccttccaggtgttaacggagcctgtgtccaagtggagaaatgtccgtggccacaatcctctggtgagtgggttgttggttgcatgaacccccggcttccccttaagcacctgagaatgatggtgcctctgcctgagccctgcctgcccaggcattctctgcgctcttaactgagttggagaagaccagggagggacaagcagaaaatggtggcatgttggtgttctgaggtcaaggatctctgaggcctgagtggctgtgcacagagcctagggacttcccgtcagctatcccatactattcccagtggccgaccttagccactaggggtgtccatttcttgttgctcattccagccttcccctcccctagaagaaacctatcagaacccgggacttctcaggcctaacccccccaggacctatctctaagtaaccaggatccttggtggacccctgacttgggtttgcaaacttggccctgtctggtaacaggggccacctctggcttacctggaagccaccagcctgctttcccaagggtgaacctagcaacaggggctgtagtgtgctgtgtcccttccttcaccttccccaattcgaggttctgctctggttgcttgaaagagatggatagaatctgggtcctgcaagagagagctttagaagaggatgttggttctgagctcccatcccatgaggtagggatgattagtctcatttttcagcttaggaaattgcacttatataagttgcctgaggtcacacagctagtaaatggacttggaagcctgtgctgccctgtgattttttttttttttttttgagatggagtctcagtctgtccctaggctggagtgcagtggcgcgatctcggctcactgcaacctctgtctcccaggttcaagcgattctcctgcctcactctcctgactagctgggactacaggtgcgcacgaccatgcccagctaatttttgtgtttttagtagagacagggttttaccatgttggccaggatggtctccatctcctgaccctcatgagccacccacctcagcctcccaaagtgctgggattacgggcgtgagccactgtgcccggccatgccctctgatttttagcaacacaattggcatctcctgtgtggttcattagactctgagttctactaggagcagggactgtatctactttgttcattgttatttgctaaaaccaaggcacactgcctagcacttagtaggggcttgtgcattcatccattcattcaaccaatattcagtgcatgtcagccatgtggcagacactgttctggatgatatggcagtgataaattcaaagcccttgctctcctgcccctaatattccagtgtggggaggcagaagtcaaacatataatctggcgggtggtgatagggcctaggaagaaaactaaagcaggtgaaaggatgtttcttaaataaggcaaaacctctcagtctttcaataaagaatcctaaagagacatgagaagaatttcttctctgtgcattcgggagaagatggaataccagtcatcttctttggatataacaaagaaacctctgtaacattcatattctctagaagccaaggaggaacccaggcttagttattaagtaagacagctagagttgcaggtgttagggatcataagtgacgtttcacgggacagaatcacagcctcagaagtcttagtgtccttggtacagatagccttttcaatgagagtttcctaataaaaaatacaatagaagtagccatttttatataagtttccactctagaccaaaagaaagatcgatacttttgtgaaaaatctcaattcatcactttatctgaattggttttctgatgcagaaaggtgactgtttctgcggccatcaggcaagagggagtgtttctcctagcctttatgagattttctctcaactgcagtcagaggagtctgcagttctcaatgaagaacactggagtttcattagtttgcaccaagagaaaaatgaaaagcaaaaatgaggaaaaggccgggtgtggtggctcatgcctgtaatcccagcactttgggaggccaagatcagaggatcacttaaagccaggagtttgagacaaccctggtcaacataatgagacctccatctctaaaagaaataaaagtaaataaaattaatttaaaaatgaggaaaggagcagaacaggtttcttagcaagtatgctggagcatgaagtgttttgcttctagaagggatggagagtgattgagtaggtgggttggcttctgttttacatgagataaccagggaatgtgtctatgataaggtgcttaaacatgagggtgtgagcactgcagatatctggatgaagagtgtttaggcagaaggcgctgcagaggcaaaggccctgagatgggaccatgcttggcatgtttgaggaatgctaagtaagctcatgtggttggaagccaaccaggccagagggagatgggtaggagatgagagaaagccttgtgggccatgataagggtttggatttcattctgcatgcaatgggaagccactggaaggttctgagcaggggagtggcaagaactgatttaggtttcacagactcactcttgtggctggatagagaacagactacagagggctcaaagaccattcactgaacgacttgaacgcatgttccttggtgattttattttattttttgaatttccaaagaaaagtaatttattttttgcagttagggcagctgagaagtccagggttgaaggggtgcatctgctgagggctttcttgctagtggggactcttcagagtccccaggtggtacagggtgtcacatggtgagggagttgagcatgctaggtcaggtctctctcccttttctcataaagccaccagtgtaagataacccattaatctattaatccgtgaatagattaatccattcaagagggctctgtactcatgatccaatctttttttttttttttttttttgagacagagtctcactctgtcgcccaggctggagtgcagtggcgcgatctcggctcactgcaagctccgcctcctgggttcgcgccattctcctgcctcagcctcccgagtagctgggactacaggcgcccaccaccacacctggctaattttttgtattttttagtagagacaggatttcaccgtgttagccaggatggtctccatctcctgacctcgtgatccgcgcacctcggcctcccagagtgctgggattacagacgtgagccaccatgcccggccgatccagtcatttcttaaaggcaccacctgctacatactgccacatgggggattaagtttccaacacatgaaatttaggggattcattcaaaccaaagtattatttgttaaagatgatcttaaagagcttaacttctttaaaaattttaaacttatttatttatttatttattttggagatagggtcttgctatatcacccaagctggagtgcagtggcacaattatagctcactgtaacctttaactcctgggctcaagtgatcctcctgccttgggctcccaaagtgctgggattataggcatgagccactgcacctggctctcttttctttatgctagaaacattcaaattattctcttatagctttttttttttttttttttttttgagatggagtctcgctctgtcacccaggctggagtacagtggcatgatctgcctggccagcatggtgaaaccccgtctctactaaaaatacaaaaaaatttagctgggtgtggtggtgcatgcctgtgatcctagctacttgggaggctgaggcaggagaatcgcttgaacccagaaggtagaggttgcggtgagctgagatcatgccactgcacttcagtctgggtgacagagcaagactctgtttaaaaaaaaaaaaaagatttttatcaaaaagacaggtgataggtgtggagaaaggggaaccctcatacatagttggtgggaatgtaaattagtacagctactatagagaacagttatgaagtcaggcagtgtgatgcctccaactttgttttttttgctcaggattgctttggctatttggggtcttttgtggtttcatatcaattttaggattttttttttccctatttttgcaaagactgtcataggtattttgatagagattacattgaatctgtaaattgctttgggtagtattgtcattttaatagtattagttcttctgatccatgagtgttgaatatctctttttttgtgtgtgttctgttcaatttctttcatcagtgttttatagttttccttgtatagatctttcacttctttggttaaatagattcctaggtattttacttttattaattaattaattaatttattttttttttcgagacagggtctcactctgtcatccaggctggagtacagtggtacgatctcggcccactgcagcctctgcctcctgggttcaagcgattctcatgtctcagcctctagagtagctaggaccacaggtgcgtgccaccacacccagctaattttttgtatttttaatagagacaggatttcgtcatgttggccaggctggtcttgaactcctggccttgagtgatctgcctgcctcaacctcccaaagtgctgggattacaggcatgagccactgtgcctggctggtattttatattctttgtagcatcgcaaatgggattcctttcttgatttctttctcaggttgttcactgttggtgtatatacatgctactgatttttatatgttgatttgtatcctgtggtattactgagttcgttcatcagttctaacagttgtttggtggagtctttaaggttttttttttttttttttggtcatttcaacttttattttacttttagcggggtacatgtgcaggtttgttacctgggtatatttcatgatgctgaggtttagggtatgatggatcccatcacctaggtactgagcatagtacccaataggtactttttcaacctttgccccctcccttcctccccactctaggagtccccagtgtctattgttgccatctttatgtccatgagtacccattgtacccacttataaatatccacttaaagtgagaacatgcagtatttggttttctgttcctgcattaattagcttaggataatggcctgagtctttaagcttttctaagtgtaagatcatgttgtccgtgaacaaggttaagatgacttcttcctttccaatttggatgcccttcatttctttgtctggcctaattcctccggtccctcggagactttccataggctcctattatagctgttaccatactgtcctataattgtttcagtgtctgcctttgtccaccctgctgtcagagccctgtgatcatgctgggtttatctccagccccaaccctgcctgtgtaggtttcttgagctgtccttcagtgccttgtgagaccagggtcctcctgcagatgccactttgatggaaagtgctgtgttttcccttctgcagggcctgatgtaccacgatgcctctcgctggggtcttacgctacagacttatgtgcagctcaccatgctggacaggcatactcgtcctcaggtaggtttcagatgctcagtttcagccttcttaaacgttttcttcagacttggggtatgtgattgccaggaagggaaactttacaaggaagccaggctaggccttcagtgctgtgcaggcctctctgtgtggggccaaggtctctggcttctgtggttctcttctgacctgcctctagtgcccccacctgcaaacctcagccagccaggtggtgcccctgccaccattctgagctcacatctttatgacctgaccactgctgggcttaatgccgtttaactcagttcttctcaaagtgtggtccctggaccagcagcggaagcatcacctggaaacttgttagaaatgcacattttcagctgggtgtggtggatcccacctgtaatcccagcactttgggaggctgaggcatgcggatcacctgaggtcaggagttcaagaccagcctggccaacatggtgaaaccccatctctactaaaaaatacaaaaattagtctggcgtggtggtatgtgtgtgcctataatcccagccacttgggaggctgaggcaggagaatggcttgaacccaggaggcggaggttgcagtgagctgagatcataccactgcactccagcctgggtgacagagtgagactctgtctcaaaaaaaaaaaaaaagaaagaaatgcaaattttctagtcacatcccagacctgctgaattagaaattctagggatgaggcccagcaatctgtgttttatcaagccctccaggtgactcgaatgcatgctttgtttgttttcatatttgagaaccacttatttaaccttcatggggtctggctcttagttcaaattcttgagacaaagaatctgattggttcagctttggtcaggtgtccagccctggttcaatcaggtgttggggacaggaccccaaggcacaaacatggctgcttaggcctattccatcagtgaggatgcatctagagacagagtctcttagaagaaagggggctgtggaggtcctgatcagcacctatgtttcaaagctgtaagcacaacctatgatgccagctttaaggctctgcatgaaggagacagactgtccctacagccagttaacactggcacagctgctgggctggacagttcggtcccagtctgggtacctgcagcaatagctaccattcttctgtaagtctgtcttttaaaattgaaagatgtgagtgggccgtttttggtgaataagaatttccatctccccaaatatctgtctaaattgcacaaatccacaaatcgaaagatctgaggttagtgcattttgcctttgctaatttgcttttcctgagcaggcactcaattgcaaacctaagttgtatctaatgatatttgaataggaagggatataaatgcactcctctatttaaggaaatctacctcaggaggcagagagagatggacagaccaggaaagatgagcagaaggagaccagagggatgaatggggagctaggaagtaaggaaagagaggatggaagaatggaaaggaagatggatgggcagaggatggatggacagagggacagcagggagagggaggaagtgcctgggttatggctttgaatctgccttggatttgttggcccaggtcccatgggtgctgtgggccatggccaagtgagagtagtgttagtgtgcctggcatcaagggtcagggcgcctcttgcttcccagaggaacgctggacaaagggcaaggtcgtctgcagagggtttgagcatcctggcagaaaggggcactgtcaggctgtcttcctccctcttgggcatcgttcttaccagtttccttgggcagagcccccagaacgtcacccccaacccgaccctcttggggctgtacctcatgcatgtggtccctctgcttaagcaaactcaccctatttaggtccgtggtagtcaccacatgttgcctcaagtggacagctttggatggtttctccagggcttgaccgtgttctagttgagactcacctgccatcaaagaggcagctgctgatgagccctcagcctcggcattgctgggccatgcatgcagctttggggtgtggggcaggtcagggtggaagggggacacagcctgagcctggtggcagatgtggcttctcctcccggcaggggagtgaggaggtcctcctgcttcactctctctgccgccttgattctcatattcagcaaagtccccaggcagggggagtaacagacatttctcaaggcctcctggctgtctccttttcccctgagttagtgattctctttttgttttcctttaggtgtcatctgtacggttgatggagaggtcgattcacagcgcaagatacatttttgtagaaaacctgtatagaaggtactgtagtttgaatagttgataatttattaaaccactaatttttcaaaatgaaatagaaacttgtttattcgattgacagatatggagtacccgctgttgtatcagttatccattgccatagcaatgcggtgtaacaaacagccacgaatcctcatggcagacagctatctgcattcattgcccagtcagccagggtggtcaccaggcagctctgcttaccttggctaggctcaatgagatgtctggggatcagccgatgtaggatagcctaagcaagggtgactggaggtggctcatctcttttcctcttgcctgtcactctccttctgggaccagcaaaccagcccaggtgtccacttctcacggtgacaaagggtagaagcaacagcagagatgcaaggacatatttttcaggcctctgctccaagtttgctagcattccattggccaaagcagatcacatggtcacatgagcccagggtggaaaggtgggagggtccagtgagttacacagcatggtacaaggctaaagggaagggtggagagttgggcgagtcagacgcacagtgtgcgtcgcatttgttgtgtttttcactaaaagcttccctcatgagagcagactctgtgatgtatacctagttaggggcttctggtggcctgtcagtgccaagggctcaggcatggggccctccatccctgtgctcagagactgccgatttctaggggtcttggaaatgggttgcagaccccacctgtccctgccgcgagcttgggatactgctgtccttccctcgcagagctgttcggatgtcaacgctggaggcccttcctcccactctcatctgcagctgtcttcctaaatgccaccctgtctcccagccctccccgaccacgctgtctagatagggcaagctccttgttagtctttgtttcgtttttggttttggtttttgttttttgaggcagggtctggctctatcacccaagctggagtacgggggcacgatctcagctcactgcaacctccgtctctcaggctcaagccatcgtcctgcctcagcctcccgagtagctgggactacaggcacacaccaccacacctggctattttttttgtatttttagtagaggcaggatttcgtcatattgcccaggttggtcttgaactcctgggctcaagtgatcctcctgccttggcctcccaaagtgctgggattataggtgtgagccactgtgcctggtccccttgttattcttaaggactactttctgttagttttctttgtagtatttaaggcaatcatatgaaattgtttaaccaattatgacctacaaaaatggcagttttgtgtggttcaacttagtatgtgtctaattgtttattgccacccacccccccggaccataagctcctaagggcaggcaccaagtttgttgtccttgcctagggtggacccagcacagagcaggctcctcgttgatacctgttagctattgttggatgaggggacctgtggctgtgctttggtctccagcccaacttgttccccaggctctggtcccccactgttttgcacctttcatttgaggggccactaaaaaggcttctcctaggagccctgagctgccatggatcatgcctttgagcctgtgtcaccccccaaaatgagagcctctgccccaaatccacccagagcatcagagcaatgctgtgggctcaggggctggcagccaaggtgagtcctggccgtggctttgccccctggcctcagacttttcttgtgggctgcagcttgccctctgagcaggtggcattcctgaccttacggccccattttcacctgacaacctgggtttccaggtgtccactgctaggtttatccagccctctgcggtcctcagctcctgctccttagcacctcagccagagggaggacaggcaggacagaggagagcgagagcagaagggagcctctgttatgtttgtgtactgctctgattagaactgtaacccgaggcggaggttgcaatgagccgagattgcgccactgcactccagcctgggcaacagagcgagactccgtctcaaaaaaagaactgtagcctgaggaacagatcttggcagtggggtgggattacctatgaacctcgcagagtggggctgtgtctgtcttttaatcacattcagcttggcctgttctgtgtggggtcagtggctcttgttgctttttttatttttgagatgggcttgtgctctgtcacccagactgtagtgcagtgccatgatcatggctcactgcggcctcgatgtcctgggctcaagagatcctcctacctcagcctcctgaatagctggacctacagcacatgtcaccacttctggctaatttatttcttattttttgtagagacagggtctccctgtgttgcccaggctggtctcaaactcctgggctcaagcgatcctcctgcctcagcttcccaaagtactgggattacaggcatgagcctgattacagctctgctcggcctcgtggctctttttgaagcaagtaatctggaatggaatgaccagaggttaaggggagaggatagagtgtggcatttggtgggcctgggttctatcctggctctgaagtttgctctgtttgtgagcaagaccaagtttctaaatttctctgagcccatctctcatctctgattcctcttgtccatctctgaagagcctttggacctgccacctccttcgtgtcttaggacccttttgtgggtccttgcccaccttggtctttattaaatttgtgagttccccaatcctacccccaaacctgtaggccacccagcgctaggtagatttccccaggagccatttgtctttgtttggccggtcacagttcctgctgatggccatgggctttggtaactcacgcccatggtcctgcatcaccacatttctgatgcgtcagttctgtatctcccaatctctgtggttacggcattggtctagatgacatgggccttgcctggagctgttctgtgggtagtttaggaagagaatgtagcttttaatttttttagctcttttcctgtcctgatgactttatatttatgtctctccctggccctcccagaatgcatggcctctgtggttaggatttctgtgggacaatgaaccacagaagaaacttacagtgtcctttctgttcttgggatctaattgttttaagttcatatggctttcggggggctcagattcccctgaagaccttgttggggccttgagatccatcactgggatctcttgaagccaaaggctctcagtgggcatgtggcctcgggcactccagaggctactgggagcactgtggctgcctggagggccaggctatctaccatggtctccagagagatgagaaaaggcggtgttcctcagaccctttcatcggattcctctgaaggcagaggaaagctccccacagcactgcttcctcatcctcccagaccctgtggtccaaagcagccacctgccaacaacccagaagtttcttggagtctcctattttaacctagaattcattgggattttgcattttcctccataatatgttcttaagtttgtatctaaaaataataatttacataacttatcattgaggacaatggatgttcctgtattaaacaccatgctttgcatgtggcttggagttcccactccctcagccacataccccagagtccctaagtccaggaggcagagaaccaaggggtagcggcattcaaaacaccttcccagggcaagtgattcacttgtgaactgcacctgcttatgtgttccctggaaacgggggcatctgctctcatggttaaggaacagggcagggacccatggacaggagctgcatttactgtctggttgttgaccctattgggcagataaggaactgagaaaggattacaaagccagtgctccttcctgatcgggcaggaactaaccacaggaggggaaggtgttccgaaccctgctgtgtgggggcaagcagcaaatgaggaagtggcaggaggcatctagatttctctcatcaaggccaaaggcttcagggcccactgggttccccaaagctgagaatcctgaggtactagcccaagggggagactctgcctctttccagacaggctttaccctaagcttctcccacaaccacctgtgcatcttgtttacaggcagattccacttcagtagcactgaggtggggcctgagaggccacatttctagcaggtgcccaggtgggaccatactcctactggtcggggatcacactttgaggaatacgggcctcagaagaaggtggcagggccgggtgtagtggcttatacttgtaatcccagcactttgggaggcagaaggggaaggatcacttgaagccaggagttcgagaccagcctgggcaacaaagtaagactcccatctctacaaaaaatttaaaaaattagctgggcctggtggtgcacatctgtagtcccagctacttaggaggctgaggcaggaggattacttgagcccaggaggtcagggctgcagtgagctatgagcataccactgcactccagcccaagtgacacagtgggactttgtctcaaaaaataaaaataaaaaaagctggtagccaggtggtccacagggcgccctccatcccaatgccacgacccttttcccctggagttctgacggtaaggtgggcttccttggggcttcactggacctttgggggtcataagaacaagagcctcggcctgagggttgtctttgggaccatggtgaaaagttctgcgcagtgcaggatttcctgtttcctgcacctggcctgtggtttcttaatttcacatttgttgcttcatatttgggttgctgggggctgtgttgtgttatctttgtttttaaggtttctggacttattcctaggccaagaatcaggcagccatagggcaaagtaaaaagtatttttagccagagccacagaagggataaagggaaggaagactagagcttggccactctccggacaactccagctgccctcgatggagcggtcatccacaacgaagtattactgagaaagtagatgtggggtttttttgttttttgttttttgtttttttgattttgagacagaatcttgctctgttgctcaggctggatcactcaggcgatctcagctcactgcaacctctgcttcccagattcaagcaattctcctgcctcagcctcccgagtagctgggattacaggcgcccaccaccacgcctggctcatttttgtatttttagtagagacagggttttaccatgttggccaggccggtctcgaactcctgacctcaagtgatctgcctgcctcagcctcccaaagtgttgggattataggcgtgagccaccatgcctggccaaagtagatgtttttagaggtttcggctccttcaaaatgcagattactgtcattgtcactacctatgcaaaatgtagcatagaactgactttggctgggtcctttgcccatacctagaataaggtgtcttggttcccacctgcagggagttcagccaggtactgggaaccacacggtggcatgtggggcgtcagctcctgcctgggagctcgtgtttcctcatttcctgggatgctctaggaaaaggcttcccaaaatgccatgatggggagcccttcacaaggtgggagggcacattaccattgccccttcagtgcttgggttgatctttttctccctctcagaagctcttgcaaccttggttcaggatctgtgggggcctagacagaaggctatatggcaggctcaggtccccagaaaagcccacatattggaatcctgcatctcctcgaagtaaaatttcttgaagggtgttcttgctctttgggctgtgaacaaatgaagagctcgccagggaaaagacccacctcttctggcactgtctaccctggcgaggttggggtgtgcagaatgtaactgcagttatgccaccagggattcgagagggctgtgttaattgctggagaggaagattccagttacacagtatccttaaagacgggaacttctttttcttttttttgagacggagttttgctgttattgcccaggctggagtgcagtggtgcaatctcggctcactgcagcctccacctcccgggttcaagcgattctcctgcctcagcctcccgagtagctgggattagtcatgtgccacaacgcccggctaattttgtatttttagtatagatggggtttctccatggtggtcaggctagtctcgaactcccgacctcaggtgatctgcctgcctcagcctgccaaagtgctgggattacaggcgttagccattgcgtctggccaaagacaggaacgtgtaaggggcaggcagctggctggcatgaaaagctgaaggtggtgagcaagattcatgtagctaaagaggccacacaggtgactgtgtgggccgagtaatgggaagcaaaggttttacaagattgcctggtcgtccttttctaagaacagaagtgagggcgtggagtgggacccagctcgggaagtggcatgctgactcacctgtggcttgtggttggggacactgagtaagacctggtgtttggaaccacaggctgggcctcctcccctgctgattggcccaggggcttaagttcttcccagctcctgtctagactgaaacctcctggtgtgggtcatgcgcctaagagctgtggccttcctggagctcaggctagagagacactggacttgatccgagtcagctgacagactggggtgggcgggtggtgcaatggagagcatttgggtttgggggtagggagagccaggcttggacccctgctcagacagagttggccttcacttctctgatcctcaggtttcttctataaactgggactgaagccagcctcacaaggtcttgtgaaaacaaaaggaaataacgtatacaagggagctcttccattccattccgcacagactggggggctctcttggcctcagggaaggatgcaagaaattgtactgatgtaacagcaggattcatgtggatcaagaccttggttttgcccccttggggtcagggcaagggtgagacccccatgcccactgttgagttgtgtgcttggatttgccaagcttggatttgcttggtattgctctccgtgcattctgtagaaataaaggcagtggcttgtcttgtcggtggtgtggggagccccatgcttgagacagacacaggaggagctgggcagagttcctaggaggaaatacagttagagcagcgcccactgtgccccatgtccctcggagtcatggagatcaggcttctgtttcctcactcagctcagacactggtcattcagtcctcctggatcccccagcctcttctggcacatggttctagtcatggaagggttttcaataggtctggcctactgaccctgcccatgggaggccacccgaccaaggaccccttccaagagcattgggaagggagaggctgcccctcagtctgcaccaaccctgtgggggaagccttttgtttggctgtgatgggggtgggagtgggaggcccctgtgactacctggagccgattcccaggggagctgtggcaggggcagagccaccggagtctgtcagtcccagagtcccccacaggtgtgaccccctccccatgtctccatgtgcagacccccgtgtactgtgactgttttgcagtggtggttggtttggttttagttaacactgcttcatttgttctgagctgtggttcagttccatgatcatatctgtgggcaccctcccagctctgggattggacagagtctccctcgagctgtgcagacgcatgaggtactccggtggctagtccagccttggacacttgggagactgtcccatgggcagctcagcttctccccagttgctgctaactggccccacccctttggtgccacctcttctgtgccctcaagccatgagtttgctggagtaggcgagaagctaatcagcagcttcctcattgcacatcctcattttcttagagtcaattttgttctcagtcttctttttccagaaaaggaaaataagagatagtggtttggtttcttgaacatcaaatattcggagctgaactaactgaaacccaactcagggtagcctgaacaatgaggtgtcatcaactcccaacagatggcttatttggtgcctctggcctggtttctctacattttgctactgtgcatcctgttcgtgtcctcatgcagttctctcagggtgacaatgtagtcgtggcagcattgggcttctcactcgctggttggagtaagggcaggtgtcttgctagtggctcttccctaagcgtgcggaagtatcttttctgtaagtccctgcaaacctccctcacgcctgcctaatccaaattgggcccctggctgggggaggccctgcactgattgacttagcttggcttcctgaacgcattgctggaactaggggagacgacttcctttagaccgattgtgcctaccctaaagcttggaagcttggggtggggtgaggtttccctgaagcccttgggtctgtggatggaccctgaataaagaatgggctacttttaaggaggtaagcggagaggaggcagggaggcagcctgtggacacaaagttgtcacctgaacttgtagtgcctgagttttgttgcctgggagtcccctctgcaatgctgtaggatttccttcccactcctccagcctcccacgcagcttctccaggttttctgggagtcctggccgtcccacaggttggtctgccctggcctctgtgctgcagtctgctcaggccccgctgctgttctccgtccactctcccgctcctctgtcaaatactcttctcttctgaggacatgggggtggtctcagagactaggggagaatgtccctctccagttggtgccatgccttgctgttagggccccaagacagggctacttgtgcccttggcctcccagagtgcctgcctcactcttccagcctcttacttccttccatgctcatcccctcgtgggactggagtcagcccctccctgccccctccccactgagagcctcccattgcacatggctcaggtacggccactcccccatggccagtcttgccgaacccagctctgagcgggacccacatggagccactagtggaatggaggatgttaaagggagaattcctctgctaggcctgtgagggttgtctgcctgctgatgggcttgtgccctccagctgtgtccattcctgctctctctttcctgttcatttcctcccagggcacaggaaacccacaggaataccaggaatagatgccagatttctccttcaccctggctcgttcttccttcccactttcttgcctttttttctttcttttaaagttaacatttaaaatgtgtagtaggccgggcgcagtggctcatgcctgtaatcccagcactttgggaggccgaggcgggtggatcatttgaggtcaggagttcgagaccagcctggccaacatagtgaaaccccgtgtctactaaaaatacaaaaattagccaggcatggtggcgcacacctgtagtcccagctactcaggaggctgaggcaggagaatcgcttgaacctaggaggcggagattgctgtgagctgagatcacgccactgcactccagcctgggcgacagagtgaaactctgtcttaaaaaaataaaaaatagaccatcctggctaacacggtgaaaccctgtctctactaaaaatacaaaaaattagcccggcgtggtggcgggtgcctgtagtcccagctactcgggaggctgaggcaggagaatggcgtgaacctggggggcggagcttgcagtgagccaagatcacactactgcactccagcctgggcgacagagcgacactacgtctcaaaaaataaaaaaaaaaaataaataaaaactaaaatatgtagtaatgctccccaactcccactgctgatttgagaagtaatgtgttgttaaaatttggaaaatacaaaaaggtataaagaaaaaaagaaaagtctcatgtagtcctgcagcttgagaaaagcactttttacattttgatatttttctttcccacctttccaagatgcattggtgaatacttttggaaatgtggttgggatatacacagttttagatcctgttgctttcactgaacattagatttgaaatttttccatgccattaaatattattttacaatatcatccttcagttactgcgtgaattttctgttatatagatttaccaagatttagttttttattggtttaaacagtgccgcggtgagcatcatgattattttcacaaaataaatttttttgttttgtttgagtcaggggtctcactctgttgcccaggctggagtgcagtggcatgatcatgacccactacagccttaaacccctgggctcaagtgatccacctgcctcagtttcccgagtagctaggaccataggcatgcgccaccacccctagttaatttttttgtagtttttgtagagatgggggtctttccatgttgcccaggcagatcttgaacttctggcctcaagtgatcctcccacctcaccctcccaaagtgctgggattacaggcataagccaccaccctggtccacaaaataaatttctagaagtgaaattggtttgctgattcattgcctaacctgagcactgtctctgttctcagggtacaagctttaaagtccctttctctgcttagagttccaatcccaagtgaattctcccatcactccgtgccatggcccttgcagcattgtgccataagccgctcccaggcagcaggaggtcgggaatgcttagggtccttgtcactgcatgtccagtattgcacggatcacactgtgccctggtacccttggtgactcctttcattgagagccgtctcaagatccttttgggggaattgcatagcccagaagttttctcttaggtgaataagcccttacaactctcattgcagtgggaagatgccagaagtggactatgtagttctgtcggaatggtttgactggatcttgaggaacatggacgtgtctgttgatttgataggtgagatgcacccctcccacctccctctcttgtctctctcctgggtcccttgaggatgtgcttggctgggccccaacccttgggggcagtgggtgaggcacttgcccttggcagttccttccccatgggagttcagctttctccctgagggcagacagaattcgggacttctggtctctcatggagaagaaccctggcctttgttctttaaacttccctccctggctcagctactttcagacccaaatccactgtgatctgatgggtttttctagtttgcaaaggaacaggaaggacagagcctgaacattcactgagacctgctgggtgtgaggcctgttttgagctctgtctatgaacagaatcccattcagcctcaaaacgaccccacggggccgctgacactgaaagagaatgaaagtcgaggcggagggtcagtggtcaagccaagagctggccctccctgcttcctgctcgagctgtgcagaccttcctcccgcctttgcctgtgtgcctgctttgcttccaagccatgagcagagtcctgagagccacgtattcttttaacctcagtttaccttcggaccaatcctgagacttgttaccagaggttaaagaagagatgcagggaagaggagaaggtcattccgctggtaagaggcctctttgacttggttaaagacaaactgggaaaccacctctgtccaacccggcttcctctcccggccccacccccatgagatcattgtgcccttgtttgcagagagagaacaggaaccaagtgtatcagagggtgaactctgacttcctgtttggccagagacccacgtggatgtccagatctgcttggcttcctgtggtcgctgactcacagtttggcaaccctcctgcttggaggcgttcccctcccctccccacctgcccctccccatcttggcagcaccagggcttgtctgttctgcctcctgaagattgcctggccttgtgctctctgtgtcctccctagaatgcgagttccaggagggcaggacccagccctcttgttcactgctgcatccctagtgcttagcacagtgcccggcacggaggcggtgctcatgcttagtggtgtttgcccactggagagatgccatgcccttctgagttctgctcaggccacactgactctcatggggactctgccagtataggcccgggctgtgcatctcgccctggcccttccctccttgcatctcccttcaaaatctggcctccaggctgccgcccggctgatatttccaatactcatcaccactcgtgcaatttcccagcccagaacctttcagtgccttgctgctggctagaatgcagtccccactttgtaatacggcttatgacccggccccaactgcctctctggcgttatcatcctccattccctactttctatgctctggctataaggaactagttgtggccacacacaaacaaccacatacacagtggagttatgcaaatgtgcctttgcacagtcgtttcctttgtctttaaagtgttactcagatgtcacctcctccaggaagccacccctgaccttccttccattgtaaccccccccaaacccaccccctggctttctgtgatcatgggccttaggacagcatactgacactatttgtttatacctttgttccccatccctcactaatgtgagctttttaagattgggtcttattccctccgtgtcctctgcatgtgccttggggcctggtgcctagtagttgctcagttagtattgaactgaatgtcccatgtgagaagctgccactggagggagacagaggctgggcaagcattcagtggggtgtcaggggctctgagctcaggataggctggactgggggccctgggaagcctatccaactcctgaaatcctgctcagccttgtttttccttggtgccagcacgatgcattcctgccacgagggcccaggcgtcactctgggcagctcctttgaaatcttggagacaagaatgctaggaagatggaatgtggtggaatggggccaggctggaccatgctgtgatgcgcacagcagctctgtgcagtgacccagatgctccccaagcctgggggccgtccaagccgtgatccaagccattgtcttaagggtttgaccaggtccatgggacacatctggctcctattgccaagggagagctgggcaggagatgtaaaggctgctgcagagttgacacgcgagcctctgggatggcgagtggaatctgtgtgaggagccatcccactctgtgcctgggagagcacgagtatctgctctgcctggcatgcaggccccatggctcaggagggcctgtgccccttttcccttgggctccgctgcatcaggctttctgcagttggtggtctttatagtctggagggtctataggttacgagttgttgagggggtagaagggcaatgggtgagggtcacagtcctcttggtggcaagacagagcggagggtttagaggctgcccagggctgggcccctgcctgaaggaactgaggccctgctgctgcaaaagtggcagtaaatgggagaagccaggtgtgggtcctgcctttttttttttttttagtatttattgatcattcttgggtgtttctcggagagggggatttggcagggtcataggacaatagtggagggaaggtcagcagataaacatgtgaacaaaggtctctggttttcctaggcagagggccctgccgccttccgcagtgtttgtgtccctgggtacttgagattagggaatggtgatgactcttaatgagtatgctaccttcaagcatctgtttaacaaagcacatcttgcatcgcccttaatccatttaacccttagtggacacagcacacgtttcagagagcacggggttgggggtaaggttatagactaacagcatcccaaggcagaagaatttttcttagtacagaacaaaatggagtctcctatgtctacttctttctacacagacacagtaacaatctgatctttcttttccccacatttcccccttttctattagacaaaaccgccatcgtcatcatggcccgttctcaatgagctattgggtacacctcccagacggggtggtggccgggcagaggggctcctcacttcccagactgagcggccgggcagaggggtcctcacatcctagacgatgggcggccaggcagagacactcctcacttcctagacggggtggcagccgggcagaggctgcaatctcggcactttgggaggccaaggcaggcggctgggaggtggaggttgtagcgagccgagatcacgccactgcactccagcctgggcaacattgagcactgagtgaaccagactccgtctgcaatcccggcacctcgggaggccgaggctggcggatcactcgcggttaggagctggagaccagcccggccaacacagcgaaaccccgtctccaccaaaaaatacgaaaaccagtcaggcatggcggtgcgcgcctgcaatcccaggcacttggcaggctgaggcaggagaatcaggcagggaggttgcagtgagtcgagttggcggcagtacagtccagcctcggctgggcatcagagggaaaccgtgcaaaggggagagggagagggggagggggagggggtcctgccttttgccttggctttgattcaggcgccaggggaagggccagtgtttgtgcccacgaacccccagtggagcagagcagggtggctggtgacacttgtgctgttttgctcagcctggccaccgagtgtgtggctgcgtctgccgctgtccacttgagccaggtttgctcttgcagggttcctttgtctgagtcactgcccatggtcattgactactttgaccccctctgcttgacacccttggtaggtggggtctgctctgtccactcccgacagactgcttgtgtttccctggcaggaatacctggaagcaattcaccatctccatgaggagtggctcatcaaaggcagccttttccccatggcagcccctgttctggtaagtaagactcccttacagggtacgagactgttctagaaagaggagtgacccggggaatgtcagccaccttgcagacaggggagggcacagtcctttagagtttgacaacttagaagaaggaaggtgggaaggctggtgctctctctcccagtgcctgtttctgggctgagtctcagagtgagttggccagacccgagggaaggcagtctgtgccagtgccatcacacctggcagttgtcactgatccagcatcttcagcgaagactctagacccgggtctcagttttcaccatttgggatagtagttcctctgatgtgaccttcctccttccgtggatgacacagagcctcatttcacctttgtttggtgactcaggtcatcagaaggaatgtcattgtctggtctgggctgtcacacagtgatgcccttaggaatgctgaggtgtgtggaactgtctgccctgcccactaatgtctctgcgttcctgtgtttactttttacagtaatcctcctttctcttgctgccatgtgtcatttctgactgatattgatgtgtctgtcccgtcagcatttccttacttccccatctccttgttttccagtttgctgtttccagatttctttactcagacaaataagcagtggcccagatgctcccaagaaatgcggagtctggggtccctccgagtcttgattggagggaacctaagatggttacatatacaacatgggattggctgtgaggcagggttgtgcgcaagctttggtgcatggctataggagcattgtttgatgggatgtgaggcagggctgtgcatgagcttttgtgcgtggccataggaatatctgtttgggctcaaacacttctgcttatggctcttgcaggcagtgaggttgccggaaagtgagatattactgtagtaattttttgtttgtttgtttttgagacagagcctcactctgttgcccagactggaatgcagtgacgcaatctcggctcgctgcaacctctgcctcctgggttcaaatgattctcttgcctcagcctcctgaatagctgggactacaggcgcatgccaccatgcctggataattttttatatttttcgtagagatgggattttgccacgttggccaagctggtctcaaactcctggcctcaagtgatctgcctgcctcggcctcccaaaattctgggatcacaggcgtgagccactgcacccggcctactgtagtagatttttaaataagtacagcttatttttctccctcattatggaaaaaaaggagggtagaaagtgatgagggaaaaaaacaaatcattcatgagcttacagggtctcactgtgttgcccaggctggtctcaaactcctgggctcgtgtaatcttcaggtctcagcctcccaaagtgcttggataatagacatgagccaccatacctagctcttgtagtacattcttaagtgaaaacctcattggaaatgtagattgccctagagctgaaagcgatttggctctaaccttcctttttatctgcctgcaaccttctgtgcccttccctgccccctgctgcctgcttccatctgtctgtctccagctgtgaaaggaggatgctgctgaggtcagtgcagccttgtgacccatgtgtctaatttccaggtgattgaggctgaccaccacatggagaggatgttagaactctttgaacaaaatcgggatcgaatattaactccagagaatcggaagcattgcccataggaggcaaaaggtctatggctcatgtctgaaaaatgcctgctgctgccaagttagctattgggagcaatctggaaaaacttgctcccaggagggctttgtgtctggccagcttgattttcctaatggtctcatctcctttgctagtgtctttgtcatgcgtctctggccctcgtgggtaaatgacaaacgggaccaatgggtttgccaagccctttgctgttcgcagcctcacattcccccggtgcctctcccatggctttgtgctgctgagtcgctctcatgaagcccttagggagagcacctgttgtgtgcctgacaccacgctggagctgtgtaccaatcgtctcagccttcattaggaggccgaggtaggagtcttatatcccaggtgaggaatttgaagctcagaaaggttgaggggctccccagaggtcacacagcctgtgtgcagtggagctggcaccattcagactttcagccgactcagcaactttcccttgccctgggctgcctcctcctgagagctgttccccaccgccctgcctcttccggttggaggctctcatgtctctttggggagagctggcagtgtgcggagctgataacattttcccaatattgagcagttcccaaggacagtcagcatttctagacttccacaaaattatgctgcatttggctggagcccggtgttcagtggtttccctgcccgaggtcgctgcagccccatctaccacatcttcatgtggacattgagattcacatgctggctcctgaagggtgctcagtctccttggtgattaaggtcctgcttgaactgctgccaactccatgtcagggaagtcgcttttggtgcctggctggtttgcccagagccaagctggggcaaggggcagccagccctggcttccaaggctcccgtactgtctgtgtccttgtataaggagctttgctcttggaattactgaaagtctgtggcccaagagagagacacaagtggccttaagtctttttgaagtgttatttcatccagggaaatgcctcgagccatagagcctgaaatcatctttgttggctcagaaaataccttagcttcactcagctggactgcattgaaggcgaggctgccccttggatcaagcagaaaacaagagaaagaaagaacgttccctttggggatagtctggaaagttgggatttgcaaataaaggctctggaagcattgctggtcctgaagctttggaggtgggcagagagagcttcaagaagactagatgcaaaccctggaaaggattaaggctcaactctggagaaacaggccacagcctctcagagcagctgttggctgtaaatagaggtagcaaggccgctcccaggcccctgtgagtgtgggcacctgtgcatgcaatgctccgactctgcagaggtgccaagtgcccctgctgggccagtcccagagagttaggaagtcaaggcctgcaactcctggttcttcctgtttggaccagttcttgtgccattggcaggatgagaggcagcagccaggcgggagctgtgtctagcagcacctgtagcccacgtgctgctaattagctggaaaactggcgaaggcagaacctttgctaccaggaatcttgacatgtggggtctgtctttgagaatttgtaaatgaacagtccaatatttcctctcggctcattttgcacatccatttttggggaaatgtgatttctctctctttttttttttttttttttgcctaaggcacaatctcaagaggtcctgagaccacgtacccatgatttttttcttgctctgtgatacccaataactccttcacctaagccctgttgttgattttgaagtgcttcctaggccagtgattttagcttctgccagctgcttttgccagtagattaacgtgtttttatttttcaaactccgtgtttcctaacgtggagtgtatgggtctaagagagcctgctgtcctccctgccttccaccttggagaggaggctggacgcatcagcagtggccagggcaggtcgcaaaatctcccagcctagagaccacacctgaaacggctgaagccagcttgcacaagggctgctgtccctctgcggcaggcagagctggtgggggcaggggtcacagagcagtcatagacaccatggaccagggcaggagaagggcagatggcacatgggcacaacagggccttgtccttagagcactggggggtcatggctgggaggggcatggcaggggctggcatccctgtagagccagaggggccacccagggcagtgacattccagatatgttgggctcacctcatccttgctgtgagactggagttccatggggacatgaagtcagtacaccgcagagctgctcagctgctctacctctcgctgacttttttgttgcacatatacattttctttcaattagcatttatttcagcttttatttaagctttttgacagtacatgtaaaatatatgattataaccatttaaaaataccttatgtacctggttttttttggaaactagatagaaatatatttatcttttacataaaagaagtgtgtagtggggtggtccagggctttgtggtggcttagtggccatcggggtcccaggctcttcccacctttctcttttgggtccacctcttggctcctggcttccttcctctggggcctgactgtccaggatggcagctggagctcctgctctgggcacggttggcatcagagcccactgctccccatccactctttaatccagatgctggtaatgtccctttccaaggcataactaagataagctggaaggttcttacgaggctttgctagaggccctgggaggtggggggaaaggcaagagggcagtgcccacccatagaccgggtcacatgacctggcatcagcgccgtggggtcctttgggcttcacctccctctcccctctgcccccacgtcatcccaccctcatcctcaccctcaccattcccatcccgtaccgtaatgtcccttgcaaggcctaactctgtgaggaatgaaaccacctcatccttgttccaataacatgagtgaccgaatttacaaacgagtgaatgtggacctctggaaacattacccagcttgtttttacttttcactttctctttctgcccctttcatttccgtaggagccctttacctagatgagaagtgtcc

SEQ ID NO: 12401 - DNA, 18159 bp, Human
cccatgtttaattctctccaataattgtacagaacaagaaaaacaagcaggtctaatttattatctcagaaaaaattataaccatacatggctgagatcacagtcacctctctctccaggtttcaagtgttgtgggggttccaacatcttttctatttattttaaaaaaccacagcagaggggttgtgcaccctttcatatttcttggctatttggatttgttcttctgagacatgtccattcctattttttgctcattttctattgtttttgccttttttctaattagtttttaagatgtatttgtatattacaggtattggctctttatcatgtatggcaaatattttttcctcatctatcattgtctcttgacttttatcagtgttaattttcggggtaatcaagtatatctttttacagtttgaggttcctgtctttgcagtctctcaacccctagaatacccttatagtctcctaaattatattctaaatgttttgttgtttaaatttaagattctacgccatttatcaacgaaatcatcttttcctgattgaaataaaatactacatttgtggtatttccggattctgttgcactaatgtgtctttcctaccaacaatatcatattgttttattattgtggttttttgtttttgagacggagtctcatgctgttgcccaggctggagtacagtggtgcgatctcagctcactacacctccgcctcctgggttcaagcaattctcctgcctcagcctcctgagaagctgggattataggcgtctgccaccacgctcggctaatttttgtacttttagtagagacgggggtttcaccgtgttggtcaggttggtctcgaactcctgacctcaggtgatccccccgccttggcctcccagtgccttggcactggcctattgtgttttatatactatgtttgtcatctggaaaggcaagctcctgctccgtcttgtaaagttttcccagtactgtagtagttatttttatttttatttttgacagtctcgctctgtcacccaggctgaagtgcagtggccccatctcggctcactgcaacctccgcctcccgggttcaagcgattctcttgcctcatcctcctgggaagctgggattgcaggagtgcaccactacacccaactaatttttgtatttttcgtagagacggggtttcgccatgttggtcaggctggtctcgaccttctgaccttgtgattcgcccgcctcggcctgtcaaagtgctgggattacaggcgtgagccaccgcgcccggccgtagttattgttttatacgattttaagatcatttaattaaatcctctgaactccgtggagattccaatagaagtgtgtatttgtaatttttgaactgacaaccttctgttacctttcatctaatatgttgttgcatcagttcaaatactgttttaaatccttcgataagtcgtctctattcgtagctttttgggtcacttttttttttttttttttttttttccaaaaaaacaggaagtctttttacctgcagcgtcaactgagccggttttccggcgcgcgccagcccctcccctgctcccgccccaaggttctgcgttaccatgggaacaaaggttgacgtcacttagggcttccttgctggacccaagggtcgatggtgaagggagacgggtggagaggcggttttgctccatctacgcatgcgcacttcctgctccaggactcccccgccgtaaatctcgttccggctgggccttttccgccgcgactctcgcttaatcccggagaaactgccccctgggggaggggagtagaaaaaggctgaaaccagcgacagccaatcccgcgacactacaacgcaggcgagattgattgagtccaccaccgcagccaatgagagagctcgccgtcgctccgtcatagagttcgccccaccccatcccctcctttctggactcggagctcagttcacgcagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttgggtaagctgggcccccccgggctgcccccgctccccgggcccaaaggaggcttcgagccgggccctccgcctgcacccgggcctggggcggggctgctggctcccgggccgccgccgcccccgcccgtgggctcgatgggggccctgaccgcggccttccccttcgcggcgctgcctccgccgcctccgccgccgccccctccgcctccccagcagccgccgccgcctccaccgccaccgtcccccggcgcctcgtacccgccgccgcagccgccccctccgccgccgctctaccagcgcgtgtcgccgccgcagccgccgccaccccagccgccgcgtaaggaccagcagccgggcccggccggcggcggaggaggtgagtcgggccgagagagcgcgagaggcgtcgcgcggacgggcccggccgcctgaggggcgcgcggcggcggcgacggcggctgcacgcggcaggggcgcgcgtgcgcgcacggggaggcccgggcggaggcgcccctgggcgcgcgcggcctggttctagggcctcgagtgcgcacgcgcgctgtggggggagggctgggcgggcgggaggcgctctgtgcgcagacgcagtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaaggcagggttttcatccgggagaggttggcatgcttcagatgatggttgggtctgatctttcttggtctcttttggggagagaattttagtttgtttttttttttaaatctgttcagtatgtttagatctcagtctgatcggctgccctgtcgctttgttttaaaaagcttttccctctgatcctgtaccccttgggaaatagaaggactcttttgtggcaaatgtagggagtttctgcctatgtacggggaaaggagaacttggctgctattgtataggttgttgaatttttgatagatccttttaagagttcagaccctcagtgtccaactggccaggaaaactgaatgctgatcttggctaaacttatgaagacaaaggtgatcttgttgaagaattgggcttttcccacttggtagggtgtaactaggtttagttgtggtccggcctctcgtacaaaagtgactggtgaggggagtggaggtgggtggagcccccagtcccatcaggactgctttacaaatctatgattcttcagtgtatttttgtctcccctggggatttcagagcactcatggttgatgtagtatctatctaacactctctgcagccatatgcattaagattaccacgtttatatatctgacagtttttctagacaaaagaaggtgaaatgttaacttgcctgaccaaggaccacatacccttgtagtggccataagctttaaatctctgatctctgaggtttgttttctgtttttttaatgtttaagttttaggttaagctctcagcttcacagtctgctgagtttctgtgtagtaccttaaatacccttagctgtctgttgataactacttgtatttacatcggatggattttgtctctgccttttagacttcccaagtaagaagcggaagaggagccgctggaaccaagacacaatggaacagaagacagtgattccaggaatgcctacagttattccccctggacttactcgagaacaagaaagagcttatataggtaaatatacgttctgcatccaaatgcactttgagattgttacgatttattctgagcaagatctgcattttttgaaagtttgagattgtagttatcttttttgagatgagatactttcacgactttggtatcatctgtcagtttttgcccagtgagttctgcatttgcagctccttgttttggtctgttcgtaactgcagtgttctccatgagtatcaggaaggtagggtttcacttaggagtaagaacagtccccagtccagcagccacccttttcagctgctgttcattgccagttgatgaggtgagtgtcatctgcctctctggacaggccccagtggagaacaccgcaggtactgtaaaccaagtacttttcacagcgtggcctttcaccataattttatatttctccccctaaaatgtggtcttttactttttataggtactttctgaaagaaaaaaaaatgacaaaaagtggttctgaaagtgtgtttacaatttacccctttttattttcttgaatttaagagtttaaccttcccttcaacatcttttctggtttggtctatggagagctgtcttaaaatgaaggctcttgtatttacttttaaagaactctgctgggaaagggatattgcatggatatggaatgaagtgctaggataaaaaggttttatttgctgggaggttttgagaattaatgactatccacagtggaattgaaattaacctcaaaattgcttttttggaaaaaaaagtttttaatgcaagttttatctttatatacctgtgcagctgtctcaaaaaagttcactttataaacatttcctactaaccaaataaacatcccctttggaggaaattcgggcaaagacctcctaaacctacgaggctgtggccttcacaaccaaaaagcttcaaggccagcatgttactacttttgagggtcttaatttcctgttttttagactgctgagaattttgaggcgttggaattgtctgtctcctttcacagtactactaatacttgttctttcccctactgttcctgtctactcccacccattccgttgtgtctcatattagactagtctgggtctttacatccttgtgaaatgcccctagtggagtgatatcccaagaacacaagcatacttagaagatgggaagagcacaaattctttatatctccatttctgtttttgtggagggctagttagttcactgggccctaaggactatttatagctataatcaaaatagaatcaaaggagaggtgtagttctccacagaagagaatgaccctttttatttagatcaggccccacatctccatagtcagctaggaagactcaccttctcccctcagtgaaggtgactttcacctcgagttgttgagcttaatactcaactgcaaagtcagaactttttaggcataaaggagcttggggaaccatgtgtcttactacttttctgtctcccacggtacatactgctttgtccaggatgccctcaatatctttttttttttttttttgagagactgagtcttgctgtgtcgccaggctggagtgtagtggtgcgatctcggctcactgcaacctgcgtctcccgggttcaagtgattctcccacctcagcctcccaagtagctgggactacaggcgcacgccaccatgcccagctaattttttttgtagttttagtagagacggggtttcaccatgttggccaggatggtctcgatctcttgtcctcatgatctgcctgccttggcctcccaaagtactgggattacaggtgtgagccactgtgcccggccagtattttctttcgataataatgggttttcatttcttcagggttttagtgtgtgggtgtggtatagccctgtggatgtatttaaagttagaaggaatctttggttagacacgcattaatcctatcttggagccagctcagttttaacccaacctagtaacatttgcccttattggagatgcctgctgaaaattctcagatgctgcgaaggtaaggaacaggtggttattccgcatgttgaagaaagctgctctggctctgcagttcccattatcttggaaaatcagctgtgtaacatttccctggcgtcactggcaacttttgtgaaaccctcatctctctttttcatgcacagcctcattggtcaaggcccgagggccaagtacattgtccttgaacacacattccattcttctacacgcctgctccccatatgaacagtgagcctgaaaacaaattcttagcactttatggttactggtttattaagatatgtggtttgtcatttaatatttgaataaatatttcatataattgaataagagctgcaggtattgggagacccttactagtacaggtctggttgtacagaaagagtatgtacaaatttctataaggtgttgaattttgttattaaatgtcttatttaaggaattttaaatgtattaatgaaaatgatctttgctcaattggtatttttccttgtcccatgttaattgggtctcattttgggctatgtttaacatttaatgaagaaaaaactcaattcttgccctcaagtaatttgatgggagtcgggtattggtgacgtaacatggtttatggttctgggtaccaatggtaagcaagccttggtggggaggaagaggtgaaacacctcctaataattgcttggatgttagccttagtgaacagtctttattgctaacccctcttccaacaaactgtttgcttccttaagtgataaccattttgaagtgaaaaaaacctatagatgtaaaaggactcctgccgataggtggttgggggtttttgcttcaatgtgttcactgatcagtcgtccctttcaaagtctccgagttcttcatgcttgttgttgagatttgagatgtttattggtaacattgtcttttttccatccttttttttctttcctaacctggtttcttccagtgcaactgcagatagaagacctgactcgtaaactgcgcacaggagacctgggcatcccccctaaccctgaggacaggttgggaaacagttttaaccagctgacagtaacgcttttacctttttctcaatacgttttactggtggcaacatattgtgtcagttcaataaaatcatagtatgacgactgtaccctgaccactttggggattaaggtttaattagaaatatgtatggtcagtcaacagttagaaaattggaataaaacttaaaaatgttgggagaataaaaagttacaggaaaatggacaactggtttccaattggtaagcatgtagatcttaacctgatttacccacccttaggggacagtgaggtggcccgttaacctgccttttcagtacctgctttggccaaaagcccagggcatagagtttttctcacaggtacacagtgcagggactaaaaatatttttgagcatcactgaacttgagcaagccaggagctctggtcagctcattgctgcagtcttcctgctcatggttttgagatggtttcaaaatcagatgagatttctaaccaacttctttcactgccagttaactttcagccttggccattgccttgggggtgttgggaggggccagaatattctcacctattttgggaaggcatgcaaccaaccctaaattactttttttttttccttaaagggagcgtgggcctcaaacagctgtggtcatgtcatttcagtttgcagtttctctcacctcagaaaaataaattgtgtgggggagatgaacttttttaaactggaattttattagctgattgaacagctaaaattggtcatttaattagaagggcagtaagtctctccctctcactgaattttctcttagtacatacagaatagttgaaaagactttgctttaaaaagtagtgtttttggtttttgttacccagttaatagcttattaaatcaggaagatgatgtaatggctttagaagtcactcactcatgcatctttcttccgccctttgccaggaaacattaacttccttgtttctccatattgactctttaatttgacttactacatttgctatattttacctatagatagattttggttgtagggttgtgttgtgtttcgtttctttttgaagattttttttttttttaaatttacattgtaggtcatagaccacaactgtttagtgcctttttggcctttttccctttaataatatgtctacaggtcaccagtcaattcctccaaaggttgaatttttaacaaaccttctttgcttcctggataactgggattagaatttagttgatgtagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgagcccaggttggagggaaatgcatgggttttcttaattaagataatttcttaaaaaggtgttatatcacttaagccactttattgttattttgatgctgcttaacttgcacagtaaaaacatgtttaaaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgaccttttattccatcgtgtgtgtaacgtggtgtgacatggttccctttaggctgaagacagtgggagcagccgagttcagtccttgctctccaactaggcaaggttctctcaactaaaccaagggtataggagtcttgattactttcagtatgtttttttaataacctgatccacatggtctcttcccttcttgcagctgctactaaattttcattcagaatatcaagctatggtcctttttgtaatcttaactcaaaattctaggagtgtaacctctcttttttattaccgcaaaatccagctgtggtaaactgaccattttatcattacatttttttacttgtagcaacagcattttactccttaaaaaaatgagagagagaaaatctgctttctggacttgtaaactctggtggagaatcataggttttccccttgctgtttgcaggttcagaccctagacaagtatgaccaaatctgcatttgcagcctctcgcagaagctgctttagcactttaacgtttttctctacccagactccccaacctcgaacagccagaaaacaggttgtctcctgggccttggacacagccagccaggccattgaaggaaaagcaaagacgaagcgaaccatctctctccattgtgggggccaagtagctgcagtagccttcagtcccagttgcattgggttaaagagctcatacatactatgtgttaggggtacagaagcttttcctcatagggcatgagctctccaagagttaaccttttgcctaaacttggggtttctgtggttcataaagttgggatatgtattttttttcaaatggaagaaaatccgtatttggcaagaagactccaggggatgatactgtccttgccacttacagtccaaagattttccccaaagaatagacattttttcctctcatcacttctagatgcaaaatcttttatttttttcctttctcacacacaccccagacccctaacgttaagccagcttccatctccccattccacacgatcttgagtagcacacgttatggtcggttcctccgaagagtgttgtattagggtctgagaggcagaggggctgggaaagacttgttatagtccgtgtgggaatgagagaagtcggtgcagaatagtaaacgggagtctgtttcccacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaagtaagcggaggggctcggtcatctgggatgaagacacatgcagatcatgggtgacctgctgggatgggacagtattggtactactcacctcttgcctcaagtcacccataattagcacttggtaccaatatttggttttagaaaagccgctggctgtgtcattctccagaaatgtgcggtgacacaggcttttctttcttagacctccagcaacacgtgtgagtgataaagtcatgattccacaagatgagtacccagaaatcaactttgtggggctgctcatcgggcccaggtgagtaactgctggtctataggatatagaattcctttagagcctgtgagatgtgtccgttttgtgcctaattggggactgttggcttacttttcccctttttggtaggacatttcattttggctgaattaatgcctttctgtgagaaggtgtcttaacttccccactagtgcggagaagtcaaatcctcaggtttactgtggctgaccataatatagagttcatggagctcttggtgggaaaatccaattctctgcgcttgtggtttcccaccaatgccaaattggtccagcctctcttccctcttgagtgtgaatttgtcaggtataaacttagtcatttctgcctctctagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacaggtgagcggtgagcccagaaaggaagcctcctggcagaaacctaggtggaggccctaagcacttaactgtccattgcattttcactagataagaaacatcctgaagcagggtatcgagactccagaggaccagaatgatctacggaagatgcagcttcgggagttggctcgcttaaatgggacccttcgggaagacgataacaggtatgtgatcagtttaaaggagagtgtagagacctgaagaacctatggaagtagagattgttcccttgcattgacctctttttcctttaataggatcttaagaccctggcagagctcagagacccgcagcattaccaacaccacagtgtgtaccaagtgtggaggggctggccacattgcttcagactgtaaattccaaaggtgaggggctggctcttgcggtttcctggtagcctgcgatgtgcaggacaacttttctggcacattcattggttgctgttaatcttaccaagagaaacatcctttctgttagtgtggtctgtaatggtgtgatttaaagcccaggatgattagaaataggctgtacagatacccctgtttgtttgtcttgagcccaagaaaactggaagtttccattttgggtatgtttttactggggctcaataggaaattcactgcttttgctgttcagaattggttcaagaagactaagcaatctctacagatttctgaccagttgcaagtcagcactcgatatcaacactttctgactggctggcgaatatgtaaggttttgtttaggaagttcgttctggcagttgtgccagtcttgcatagattttcctttcctcaaactgggaatgaagtttgatgaaattgacttgagagaacctgtgcttcatcggtgctcagggtctcctgtgctcttcgcccaggggcccctctactctggtgatcccagatgcagaactgggcacgaaactgaagatctgatgagactgttgagagccatgcccagtaaggggttagaaagatgtgtgatgatctggtgattgaattcttcaaaactttccatatgttggttcctcaggataaaagcttccttcttaacaagtttttcccctttctctgtttgtgtcccccaccccacttcaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccggtgagcctgggggctggctctcttggtctggcttccccattctctactgcagagactgggagctatggccacgtggtttgggtagagcagacaatggatgtggatggcaacattgttcttccgggatctcaggccagtttggggacttctcacttcgggaagaccttgttcttgtgttctggtcctgtgtcataacccgaagaacaatgttgccactagggggcgcaggcagggacgttggcaggaaatgctctcacgtagtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatgggtaagtaagtgtcagaccagaaaccttgggggctttgggataagcaaggggttacgtcaggtcgctgttggctagaagcagctctcaagtggctgggcaatgtgctgggtctgcctggcttgccagggttgtggctctggaaggagcaagactccattctggttcagggagtgattctgtgttgggtaagcacagacctgccttttacaggcatggttttcagaactcgcgtaaggatagcaactgaggttatcacaggggtggcttccctggccagttccaatgtcctgctaagtccctgctctttccttccatcaagatcagtacctgggaagtacgcctgtgggctctggggtctatcgcctgcatcaaggaaaaggtaatggctgtctgctggctgtgggtcttcacctaggcttgggtgagtgggggttctggcccaagtccccgcctttccctgaggcctcatctttgcctccacctgtccacaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagtgagtagaatattttgggcttgtgggggtgggtgggatgggggtggggctgacaggaaccatagagcctcacacaagcaggcaggtgtcttgggatgagcccctgggctctgctggggttgtaaacagaaagggcctcctggtccagggggtggaggggcatcttgaagaggagagctgatgtttggtgtggttgtgtctggggagaggttcgtgggggcctggaggggagcctgctattgtaggtagggggccagaagtccagaccctcgcaggctgagtgagcggctggctggactgagcctggtgcatatgggtcgagtgggatggtgcatgcttgctctggcaagggctgcgattggggtgagagactgcagaggtgggactgggcagtggggagacagcagctgtggccttgaggttgaatgtgccgttcggtggtggcggcggctgggcggagggacatcagagctgttcttgtgtctggtaccttcccctcagcccttccaggggcattggtgacaaagggcttactctgttaagcccagagacctcgaggctgaccccagggtagtcctgcccacccctccactccccatcaccagccccgcccacccgccccccaccaccgtaccgcatgccaagcaaggagcaggcgcccctcgcccccatcccaaggcagcagccgcagacagccgcggtgtgcccccgcgcgtgtgaccttgggcttctttaccaccccagatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggtctgcttctttattttctttttaatgcctgccccgcccggtttttcttttcacataaacttcctctaccaccagcagcagcagcagcaccaaaggtgccttaactttcgttcagcaccaggtccgggggggtgagactgtgggtggttaattagggaagcccaccacctgcctcctgtgtgtggctttggtggtgggagctcagtgtgtgggtggctccacagtctcccctttggtgactagttaacatcgctgagaaccaattttgcccctccttgttcactgctcatttttctagtctctgtcctttgaaggctttttcctggggctcagacgtccacgtttgatgagctccagtggtgatttgtgcctggaagctgccacctaaggccctgggcctggggaggcatcaacactaaaggtcaagccaactaatcctgcctgtcaggcacagagcagctaaaattaaaaccgccaagtggcttttttccttctctgctggtgacttgcagcctgccagcgctgtaggctttggcgggggtcggggggacaggataaagtgccccatcttgtgctttgcaagcacttttcaaagggtcttctgctttttttccatgtcttgggcggcgagtgggtagttactgttagggttccagaaaaatccatgtggagtctccaccaggtagtgaggtcctctcctgggcagaggtgccttagagctgccctggttccacctgcctctccttccttcagggcggctgagggacagtaggctcccccagcatctggctgctggggccagcaactggcctgggctgctttccagctgtgagctagggctggctactgctgtttactggggtgtctggtcccccgtccaggaggcctgtgctttgctatgggtctgccaggcttgaggagccctcagaagcaaggcaggctcagtgcgtttccccagccaagccctaaacttcggctcaccaaaaggaggacatcttttttgcctttgtccttaagtggcagaatgggggcagggcctggggcctggctaccctctttgaccttggcttcacctcattgcttctcccacaagcttggtttccctggtgggctcattgggtggttaattagctctttgaagctctggaagcggcaaagtggcgctatgtgggttttagaaataaaatcaataaatgacttaaccacagcttagctatctcctccgcttctctcccccaggccagctccattcctgtgctccctccctttctgctccctgccgtcagcttttgttaaggttttggagaggaagtggctgactaaggcatcagtctccaaggtgctagaggccctgaaatggaagagacagcaggaaggcttggccctctgaaccgtggcaagcacttgcctctggcagaatcagagagagaaaggcctgcccacctgtcttaagacacctggggtgggaaagcaagccatttactccatcacattgtgacagggctgtgcttgccccaccccctctcctcacgttcatttctgctgctgtagcagcactgtccccgtccctcaaggcctggcaaggcctggcaagaggaatgccagtggggaaaggtcagcctcagggctctgttactgaggttcagccaagggctctggagaaacccaggattggtccaaggaaggaggccgggtttctagttagaaacttagacataaataacctcgagtgagttcaggttgtaaaagtgcttcagggttcattaaacctgcatacacaacaccaaggaggggcggaggaagcagggaaacagatgagatcgtgctgcccaggtgtgatcatgctgggctggggcatgcagtgtcaccccgggacaaagcctggaaacagtggggagtgatggcatgacaaagacggaaagaagccacagaaaaggtagttggagaaagttaaaaatttcccagtaaaaatgttcctgagagcaagcgccctgggtgcaa

SEQ ID NO: 12402 - DNA, 36123 bp, Human
cagagagcagagagccttctttggctccccccagcagtagaagattccagatcatagggctttcaaagaggctctgagatcttgaatcagattctcaggttgggctcagggacatcaatcctgggtccagctgggcataaatgcatgtgtgtgtgcacatgtgcatgtgtatctgtgtgcatgtgtgttatatgcatgtgtgtttatacgtgttatatgcatgtgtgtgcacatgtgtaaaggtgtgactgcatgtgtacatgtgtgagagtatgtttgcacatgtggctgtgtgaggagccagaaaggactaggagaggaggccatggtttgaggataagagcccagccctgaggttgtgctttggagttggaatgggggctctgtcatgacagctgctgacctcagacaggtcacttaacctctctgggcttttctgtcctgtgtgtctgtagtgtggggcagaagggatagtgtgacctcctctaggctctgtaaggtcagggggttgcagggagagcacattcccagcatctggtctgcaagaagtgttcactatggccagctgaggctattgtctggagcctcctgcttcactgaacactgctagcttgaaggttgcctgaaagaaataggggcagagccccaaccccatctccactcaacatctgcacacagtgggtacccactaataagttgtagcaccctttcagtcactcattcactcattcattgacagaagatcatctttccaagagctacttctctgatgagcctgcacatgcagcccaggggtccgtgagtgtgcgtgtgttaaccagaggggctgagggggaggcgctcactgggcctaaattccggagccaagagtaggatggctggaagacgcctctgagtggaaccgaggtcctggtacctgcagtcctgtagatggcctgtagatgacagcagaggcccatgcagagcccctgcgctgagccgcaccttcccagttccaagtgagccagctcgctcaggtccctcagcttccggattgggggagtgatgtgatgtgcgcaagtagttcagatctgtcccagaagacagccacagccaccctccctatggctctagacaagttgttttctccccaggggtcccagtttcctcatctgtgaaatgagagttgcttaacagccggtgttgggaaaactggctcaaaatacgtaaggtagtctaagatgggcttaacagagacttatatgtgcaaggcaaaactagaaagctaatggagaatatctgtcactcggatgggagacagagactttttaaacacgacgccaaaagcccaaaccataaggtgaaatgttggcggatctgatcaaatggcaactcgggatttctggtccccaggatgctgtatataccaaagggaagcagcgagtcaagggcataagcgggagctgcaaaaagggggcagtcgccagtgctggagactcccagagccaccagagactaaagagtggcgaattcaacaacgacaagatgccacttccctcggcatgtttaaaaagttgagtacgctgagggttggccaacactaggcaagtcggaagcctagcaagccatactggagggccacctggcagcgtgcagagcaaacacccgactcaaggagagctttcaagagaaataagacgtcctgcgctgtcacgttctaggttgcgagtaaaacccgggacccgcacagtagcggactgccagtacaggggcctccctgggtgtccctggaaaccgaggaagtaaccgccccctcgggaagccacgcctcctattttgttccggctcgggggcgggacccagccggggcccgcctggccctttaaggctgacctagcggggccccaagttgggatgacgcgcagggagcggggggtggagtgggggagtgggggagtgggggggtgggggggggggaggtcacgtgggcgccggcagcgcgactctcggccctgggatttctgcggccgccagctcccgcgaccgcctctcctgcccctcgccggtacctcagcaaggtgcgttgccgccaggtacgccctcgctgggccccctctgcggcctcctccggggacctcgcggccattaggcgcccggccccttcccttcttgacacgtgcccgggcggtgctcgcttgtaccccgccgcgcgaccaccgccccttgctgcacgtctgtactctcaggccgttcgtcccgcactcccagcttgccccgggctcgcagcccagcccagttcagaggctccaaggctggggtgtgttggaaaagtctgggcgggactcactcttcccctttcccccaggtgccactagaagcgccaggctggggccgcctctgagcgccccgcgggggccatggatggtgaaacagcagaggagcaggggggccctgtgcccccgccagttgcacccggcggacccggcttgggcggtgctccgggggggcggcgggagcccaagaagtacgcagtgaccgacgactaccagttgtccaagcaggtgctgggcctgggtgtgaacggcaaagtgctggagtgcttccatcggcgcactggacagaagtgtgccctgaaggtcagtgagccctcactgaggcctggggtatcctggagggtccacagcggaagcctgtgagtgaagctatgtctagcgcccctgctaagcttcctatgctcagcaacatgtttcatcgtcatactgtcctgtaaggtcaggcttgtggtcctccctacttcacagatggggaaactgaggcgtagcctagctaagctttgagtgtcccagtgagcaaggggtggagtcactatggctagagatgctgtatccggaagcagggaaggggtgactcctgactctgggattctggctggacccatgtgttcaggcccaaaggggatctcttgttcagcttggctgccccttccatgtgaagctcctctgactggaatggatctgtttccctttgctggaagctgagaccccaccaaggcttgggtgggactgcttcttccctgtggcccctgcctgtctgggctggagtggtgtgagcctcccagggctggccagaggacaaggctgatgcccactgcacctgtggagcctcaggaggctgctgatagactcctgacgagtcgctggtcccgtgttgaaagggacaggccctgggccaacccacccctggttcctgggcagagggcgggccagccatctaaccacctcagactataggctccctggagacctggcatgctgatataggtggcatggtgggggtcagggggatgctgggggcgggtacctggttccagcttaaggcatacagttctgggcctagggccacaccccatacccagaatcccttgaatctgtcatctctggggtctttactcatttgtagcttgtgccaatggatgggtagagcatggcagggatagtggctcctggaggctagaagtacagcaaaggcccttctcattttacaaaagattttttttttttgaggcagagtctcactctgtcgccaggctggagtgcagtggcacaatctcagctcactgcaacctccacctcccaggttcaagcgattttactgcctcagcctcctgagtagctgggactacaggcgtgcgccaccacgcccagctaattttttgtatttttagtagagacagggtttcaccatgttggccaggatggtctcgatctcttgacctcgtgatctgcctgccttggcctcccaaagtgctgggattacaggcgtgagccaccgtgcccggcctttacacaagttttaattatgagtccaagtgcagagtcctctagatatggctaatagctatcctgtgtttgccagtttcatgaccttggatgatatcctagactctggaagccaggtttctgcatctattcatggggaaagataaggagttgttgtgaacatgaaatgagattatacatttaaagcacttggtacaggacctgatacaggtctggagaggttacaggacttatttaaggcacaaggtcttaaagcatctgagcagggagctggacccagctctctgtgtctttcccaggaccactagggccaacagaggaggttgtctccccggagtaccttggaggggaacatgcgggtgggtctaggagaggatcagggttgggctggtggggctgggccccaggtatagcttctttgcccactaacccagcagtcgaatggggtcggggagcttttcagagtatcaggaatgggattctctgagtcttttagggaaaaagtggctcttctgagggcagacgggggtaagaggatgaggaatgagagttttcatccccctctgggcactatttaaccttccacctgtgctaggattgagggcaggctgggtgggtgagggattgaggccagagacccacttcttaataccaaggctttgaccctgtgggccaagactgagctctgaccagcccctgtggtgtccagatgctgtgggtgagtcagggatggggtgggagaccagaatttgtaggcccacacagtgccagctttaagtaagactggacttaaccccttccccatagatgctatgtctgatgagtgacttggggtaacttctgactgcaagaacttccacagcacctcatcagtgctctccttgttctggactgggaattgggtcaggcctggagtggatttccctctgtacccctttatgggtgagcatggctaaggctactagcttgggaccttcaggatctggccctaaattggccctcaaaggggacatggattagatgtggctcccactccaggaccttcctgttcttagtatcactagtgaccaagcctagaagtccttacccagctaagcaggcatttactatctcccaatattgggctaagcacaacctctggtacagttattttacctgtcttgtgagtggtagctgtggccacgaggaggaaggtgacatctccccacttatagcttctgcccattgcccaggaagaccaggacctggggacctcagtacatgggcaggcctgggcccagggagcttagccagctcatgatggatcacagtcctctccttgcatctgcctagccctctccccccagttgccccagctcagcctaggcaacagtcgtgggctctgtgtctttctgcctccctggtgatgtactccaggttaaccagggtggcctgtcctcatcttataacttgaccttgttcaggccatctctgcccatttgtctcatgctcatcctcttggctctgttgcccaagatggaagatagtgcttaacaggaagcctgaaactcagcaaacactcataaaacaggaagagctgtggccactgtccttgtaactgttgctattctgtggaggccctagaggagcaggtccctccctcccagggagctgggcctcttccgctttcccttagcccctgaccacctgcttggttcatcttggcctcagtcatactcagtggctccctcccaaggctaccttctgctgccagtgcagccattctactccattgtaccccaagccctcattgctgtcctcttggcaggaactggaggactgcctttcttggagagggtgtatgggccaggcggtcctccagtgtctgcttctcctgctgacctcttgcttgtgccctctcccaggcttaactagttaattagtaccttcagctttccctctaactgggcacagccctgcagatttgtcacacatcagttaccccaccacatccaagatccagtccttcaaactttatcacatacatgaaaattgggacccaaagtgagtcacacggtttgaagtggggggtgtagcagaggcccgaattttcttccctcctgacatcctgcccagccctcttgtggtttttggcctcttggcaggcagaagtgaccatggcacttagtatctctaaataaaagcaataggctgggtgcggtggcttgtgcctgtaatcccagcactttgggaggctgaggcaggaggatcatttgagtccaggagtttaagaccagtcttggcaacatggtaagacccttatctctacacaaaatttaaaaattagggctgggtatgatgacttatgcctgtaattccagcactttggctgaggcgggaggatcacttgaagtctggagctcgagaccaacctggccaacctggcaaaaccttgtctctactaaaaataaaaatacaaaaatttgctggacacagtggcgggcgcctgtaatcccagctactggggagactgaggcaggagaatcgcttgaacctgggaggcggaggttgcagtgagccgagatcacgccactgcactccagcctgggtgacagagtgaggctgtgtctcaaaaaaaaaaaaaaaaaaaaaaagtagccaggtgtggtggcacacacctgtagttccagctactcaagaggctgaggtggaaagatgattgctcgagcctaggggtttgaggctgcagtgagctgtggtcatgccactgtactccagcctgggtgacagagtgagacccatctcaaaaattgaaagaaagaaaagcaataaaaggccttatggagacataatggtggggtcttctttcctgcccctgtgttatggactgtggggctgggggctcttcccctctgacccctaaagcattttggaggctcttctaggctcccagtgccctcttcttcccttctttgttaaggagagtagagtggtggggtggtggatccacatgtccaggagacctctgcagagtcctctgggtcaagtctttgtagcagccatcttccttctggttcccaggatctggggaggttgctggggctgctgcctctgggacagtttccttccccttgatgccagttggcttccgtgagccaggctgctctgcatgtgggatctcagtgatgcctcaaagcacaacacagaagagggcatatttctcctgacagatgggaaactaagctctggagaccaggaggagatctcacagggatttgagattacacagggatgctgggacttggctgtgtatgttctgagcctctaactgtggcattcaaagcctctgcagtccagcccacctcccttttctactttaggtgacatctttccttctccagcactgaagaatttcttctcatctgtcaagactcagccccagtgccacctcttccaggaagctgcccagagttcctggctttggggcaatggaaccttctttgacccctttgataatactcccctttgattcaaagctcttttatagcacctaggcccaaggcctggcatatatcagagattcatgaatgcttatgaaaatgaccaggctctggcccctctgagctttggaaggagcatcaggagctggactttttccaggttgcaccttctccacaggagaggggttctttgattacagctcagagataagccacagagaaatgctatttctactctcctaagatctgggaattcacaatggaatctaacagttccactgcctcaatagacctcatggagaattcctgggagaaaggaaatgcccattcatgaggccatttctgctccctgcctgctgtccaggctgcacctctgagtagacagaggggctctgtataaccagaatgccaaaaggaagatagaacatgatggatgcagagactgggaagcaatggatccagagcccagtaccctggatgcctcactctccctggggggatggtgcccactgctccaagggtgaggctggcctgttggggctggtactgttgagctggatttgaagccaggtgaagctgccaggcaggccaggccctttttcatttggcagccatcatcccctcacctaccatctccagaccggtcagatcagcctctgcagggccacttgttagagtcaacaaatcaggaggcacatggagggactatgcagccggtacaatagagtccctggaaatagtttcactgccccctgggttctcccaacgctgctccttacctagaaggaaagaatctgaggagccagagtgttaactgccagggatgagcaatttgctttttcatgaagatcctggggagggcatcaaaccctacaaaatgcaaatagtggaattttaggcagaggttgattgttctgagatggttcgtaccgtgcctggctggccttgcttactgttttcgaagctgtgctcccagcctactctcaggatcacctctgctggggcttctaggatcttttcccatcccatctaggaactgatgccagctctccaggattcaggccttggtgctgtggattctgatacccccataaacggctaacagtttttcagagcattctgcccagcgggccctgtccacagtgcacaacaaggcacagaatgagttgtcttacctaactcttatcactcccattatatggatgaggttcagaggtcagcagcttgcccaaagtgctcaactagtgggtagcagggctgagctgtgagcctaggcagtttgatgccagagtcctagcatctaagtcatctcactcctcatgcaagtctgtggggacacgggagggtctctgagacttggtccttggaaagatgctggcattgtcctctctggctccactgggagccctggcagccccagctgggccctgagtgatgctgccagtgtctacctacatctgctcagtcctcctcactgtatggaactctgtgccagtgattggacaggtggcagtcccatgaggccagcacacaaggaccatgatgactgtgaaggccacctcagaaaggtcgtgtgccttttcccaggccttgtgagtctcagacaagtgcagctgggcagagcccagagcaccacgggcaggaaatcagactggtgagtgggcgagtggaaactgtatctgggctgggccagctaggagaggcttcctggaagaggttgccagtttaattcagacctctggtttgagaaggatgtggatgacagaggaaggcacagggtgtatgtgtgtgcctgtgtgtgtgtgcactcacgtgtgtgtgtgtgtgtgtgtatgtgtatgtgtgtgtgcatgtgtgtgacaatatgcctggtttagacattcagcacctgctgtggagtaccagtttcccactcgcagacctgtgttctggcaggatgtggttgacctcagcagggccggtgtcaaagtcctgacaaagactgggaagctgagggaggaccagaggaatctgtggaggaagaggcgtttgtgtagggccttgaagggtagagcaccattgctgagggtgctgcagggactcctgggtcacttgggctgttgttcagactatatgggaaggactcagttttcattacaacagaggtctgttgtatctcttctgagcttcacacctggggaagtggagttagatccctcattttcctctgctggggacatcatcatggaagatctctgggtggaggcagtagttggaacatctggctctgtaagcccgcaacctcccttggctccaggctgccatgtctaatggtgaaggcccatgggcaagagctgaggacatccctaggtgagaggcattccaagcatacctgtgccatgagagtgtgcacaaagcgcttcctggagagctggctctgctgctctcaggacagtgagaccatggctcctgtgagcactggtgttttccctggagaacattagttctactgctctccctccatctattggacatcttgtgtggtcccagatgaaaggccccatcttggggttgagagaggaacagtgctctcggcttaaaatgctttctgtgacattctccccaagtgactttggactaaaggcagtttcataatcttttgcaaaaccatcatctttgtggtgcagttgaaccctgggtttgaatatgtggtggggagtaggatccagtctcggtgactgttactatccctgcattcatgctatgagacaacataggccggcagacactcagaaggcagggctctcatttggggtggcctgggtgcatttgctggtgaaacattattggtttttatgaggactcacttgggtgcgccctgcacctggggaacccagccccttgagggacaggaaagaatggcgtgaagggagctctgggtcctgggctcctccccaccctcctgcccgtttggaactaagtggattaggccctgtgcaattgtgattaaaatcctgctgtgtgggaaccgtggaggtttggcttagagcaggaacacgaggctcccgtttggggaacaaggagcctcaggaggccctttcagcactagacaggccagagatgctgaaaagattgcttttgtttttgaggcgggtttgggattagggttgcctttttctttagactagggctttgtctttgctgccttctcctcatggcactagcgatctttctgtcctctgcctcctcgtccctctcatttctccttttccacctgtttctcctgctatcgctctgtccccgctctcccgggccttgccagtttgcctgtctcgtgtgtttcaggcctcatggcctcttttctgcagcctggcaggctgagggcaggcggaggacagagcagggccaggtcaggtgctaaggactcatcctggtcagcgggcagctcactcccccacccccaccccaggggagggtgggggtggggaaggaaggaggagtgagtgctgtacccatgccactcacagtgtcccctcctgctgcccgccttgaccaggtgtcagcagccttggcagtcagaacagtggactcaggagttcttgggctgagctgtaacctgaggaggtcccccgccaccccccccatggcttgtgtgaagtcaacttcagctgcagtctctgctgttgggtctccttttatggcccaatggtctgagacttttgcttgggacaattgtgtgggactaggcacagtgcgacccccaagggttccctagccacagtgaggtatagacagggctgagatctgacctgagtcagagccttagagccagccagaggagctggtgggagtctgggagggctcaaggtatgaggtgcaacctaccgccatttttacagagggcagagctgagtgtgagctgcacctgcactagctggtgtgaacactcaagactctctagctggcaccctgcacctgaccacccttgccctgctaaggctcagaggctacattcaggggcctgagggaccaggaccttgagctgccacactcatttccccattcttaagggttcagcctccacaagagacccatagctcatccacagatgctcacccaacattaacagcccccttctcaggatgtggtagaaggactggcaggtgttctccgtgctttctggcaggcagtggcacagggggcagggggatggcaataagggcacccacttgctgagtgcctcctacatgtcaggcacaaacactgcagaatcagaatggattatcacgcccatgccatggatgcagagacaggttcagaaaggcagagtaactcacccagggtcacgtagtatggacatggccctgtgctggaacccaggcctggctctcagccattcctctctgcgtgtgtgctcctctggggatcaggagccacagtctgctcatcagcaaaatgagagcctgggccgggcgcagtggctcatgcctgtaatcccagcactttgggaggctgacgcgggtggatcacctgaagtcaggagttcgagatcagcgtggtgaaaccccgtctctactaaaaatagaaaaattagctgggtgaggtggcacatgcttgtaataccagctacttgagaggctgaggcaggagaatcacttgaacccgggaaatggaggttgcagtgagctgagattgcgccattgcactctagcctgggagtcaagagtaaaactccatctcaaaaaaaaaaaaaaaaaaaatgagggcctgggtgctctgcttggcaaaggcctcccttttggctgtgaagacatgttaggtgggcaatgatcatcggcagtgccagggaagcaggcaggtcgtgggggcctgccttgcccactgctggggctgatcttgcaagtagatagacagcatagagactggtcagagggtgccccaggatgcctctcccacaccagtcagcaaatggtgttgtcaggggaacatttggctatggtgatgccaccagcaagggctatattctgccagggtcaggagctctgagggttatgactcaggtttggagaccccttccgctgtacttcatggactaattaagtgcttgagtcaggctgagccagtaccagggtgtgtccttaccctaggcaggcccaggagagggggagtgagtcactgccgcctagtctcatggcaggaacaggcagtgtccctcagagctgccaggccaccaccctggtcccctagagggcagggcctccccctcttcctcatagctatggctccatggtgtgatcagagactaggaaagccttctgggagtaggctgggtgtcggtgccttgggagtcctctggctgaacgtgagcaggaggggagaggggccaggggccaagggagactggaagcctggatggctagtgcccctgctacccctgggaggagcctgaggagagcgatggctgcctgtactcacccaggcctgtgtggggagctgcagagacatgaatgaagccaaaggatgagggagagatgctgagcagatatgagatagaaggtcagtgttgggggtggggatggaaggttccctagggcctctgtgccatgcctctgggggtgagccagtgtatctccccacgcccacttctgattcctttgtcatctctgtgacatctcctccaggcgagagagaccagctgtcattcttctgaaagctggagagttttgggtcccctctctccagagctggccagaggcctggcctgctgagtgcttcagcaggggtcacctaggcgtgacctcacttgccctggccacccctgctagggagggtggtatggccctttgttaccctgtgtcagctatgtgggcatcactgccacacaactggccagttgggggcacatatttcattgctgctgtggggtctcttcatgaagagagaccactgatgggacattatttctgagattacaacaaaacacttgtgtttgctaaaatgttccagtcttatgatgaaaatgtcctatttttacactgtcatagaagaaataaaaccagggtaaagtttcacagattatgtagctgattttgatagaaaaatccccttttcctctttgaagttaaaggaagataccagaacctggatcttctgagtatgtactcagggggctcacaggtggtctctgtggcctcccccggccctctgtgggaaggctgtgggcagaatcctgggatcccacacctgtcaggggcagagggagttgtgatcctgccactttctcactgtagaacctctgggggaggggaggaggccatagctgtctcagggcctctttccccagctataacacaggagccatgtgggaggagagtgggtgcccagttcacagatgcaagctggggcttgggaaggtgaaaggactggccatggtcacacattttgcaggagggacattgttcaaaaggatgcgcagagttgtcgaggggtgtaaaggtgtctgccacctgggagagtagggggctgccacaaagaagtgaagatgggccccctcctatagttgaccaagcttgagagctgggtgagttccctgttgtgggtttctgttctttcagtcttggttcccattccccagggtcgctcccctaagatcagccaccctctctccaccctggagggtcttccccttccttattgagcctttcacagcaaaacaggattcgtggactcaaggttcttggtccacctttgaagagcccagtctggctgtgcccctctgaggatatgagaccatttcctgtgacctgctgaattggagaggttctgcctcccccaggtccccaaggctgcacctagctttccctgaattctgggaaacaaggaggggaggagtgtaaggccatttcaggaagacccaggggaatcctaaagccaggggtccccaagcaaacccaggaactgttttcacccataccatcatggcccccaataccttcagtgtgcactggacaccaagttcatctgagctctttgtgtgtgctctcattccctccttgtggctccctgggaacaggagtattagcactatccccactttccagattgggcctgtgaggctcagagaggctgaatggcctgcccaaggccacaggggagttgggaatagacctggacccctgtggctgcagctagtcctgctgtgcatggtccctggtctggggcactgggaccctctagcactcacgttcccactgttcttccctcttccttcctgggagcctcgctcaggtccctctttctagaagcatttccctccactcttcccatcccccagacttagcatttcagcctttgtttccaggttgtctggggctggtgggaagcagaccaactgaggccatcaaaatttagtaaattggaggaatcttgtcttcctaagacttgatgatttcaaaatttgtgttggctatcctgtcccagagcttcctgggaagacactaggcttggaacctcagctactccctcccctcccaagaactctggtgagaagtggtcaggtggaggttcccagcctgtcaagctgccaccctgccccccatcaggtgtcctggccttggcctagaaggggagtggttgtttaggggtcctcctttcttgtgagttccctcagaaggggctggccttctccatcttgcctgttctgccaggttctggttctggaaagaaaggagaagggaagggaaggagccaggaccagtttcccaggtgtagatgtcatcatcaagcatcccagttggcagtgactcatccatagacccctaaatccttgaggacagagtgcccatggcagcattcccagtcccagtccaggtctagcccccagacagggccagtacatgtttgcaggagttgggaggggatctgtacatgggcaggcctgtacagttgaatcctggttcccaaagaactctgactcagtggtggccatgtgcaaaccacgtgacccagagaatccacaaagcctccctgaccctcagtttcctcatctgaaaatggtggctaacaatgcagttgttgaagggcaagagctaatgggtatgacatgcctggtacagggcggggctccgtgaacatctgccattgttgtaacagccaccgagtagcagggcctggtccagaccaggggcgtgggccaagctctcggaaggagtggcagggccttctctgtttgttttccccaggctggtgttgtggggatgagtgcctgctccaagccttgaagctgcatggaaaaggggtgaagcagctatacatggtccccagtcttgactctcactgcccagctgtgtgactttgggcaagtcacttaacctcccagaaggacatttccccacaggtagaagggcgctgctgatccttgttgggttatggtgaccactgtgtgaggtggcctctgcacagtactggcccagcaccagggacagactgttgtcctgtagggagcgctaatcccacctgactccatcattccctcagcacctacctggggcctggacgtttggggtcagtggtatcatgtgagccgccctccttggaaccgagcctctgaggaggagaggtaaatggacagggtgagacagaggacaggatgtggtcggaacttaatgaagcgaggtctcatctggcaggaggccaactcatccatagctgcaaaattggttccattagctcctttaatgagctacgaaagctcggagaatgagtttgtgagagaataatggcacatgtctgcagctctgatttgaaactgtggctaaaaagttagatattacactaccttccagctctccaaatagcaccagtgcccttgtcgggagggagagggaggacatggggggcaggagcggggttctggcattataaggaagatgctgaagctttaagaaggaaaagtctgcttctgaactctgaattcagggtcaatcccatcctgacgtcttccctgcagagcagaggctgaggctgtgacccattctctgagtgggcaaagcagctcacaagggtcacactggctggcagggccgtgtgtgttaatagcccacacaggtgccagcagcactggcaggggtttcaacaactggctgtaaaataaattctgctattccagtggtgtctcttatatcatttgagatgtgatcctcatgggaaataatcccaaataatcatacaactgggagctgggagagatcttagagatggctgagtcgaagacttgtcaaggagggagtatggtaggttcaaagtgttttgtcttattcacggcctgcctctgtaagaataggggttcccaacaatgaaacctaaatttccctacaacattctctacagttttgctgcctgagatttcgtgttgagcacgtgcactgagatttaatcttcagcattctggcctgcctttgcctgaggctgggatgagacccttaggtgggacaggtgttggaggccatgctggtccctgctgctcctctcctatctgtcctctggcacaaaacaaagctggaatcccaagaaaataaaggtctggtgatgttacctcagcactcctggcccacatgccaggcgatagctgaggcatatgtgctggcctcagtcttcatggaggaatccatattagatatgttcatttgagtctgtgtcttttgcagaattgctgttgaaggtgttgccagaaggttttctcctatataaggtttgatgtgaaatcccttttagaatttcgtcctagaaaatgttcagtgaatatctgtgctcctcttcatgggggtaataaaagcagcagagcctaactggtttccttctttgcaagacttccaggaagctcagaattaaaatttgtcctcatttatagttatgaacttacatgggtttctggtgcattttgtctttttcttcattctaaagagaatctgctgtttttgtttggtttggcttctgtcttgttttagaattataaaatgtctgaaatactgttgttaataagcagggcttgcagaaataatggtgcttggagggcctcaaggggtggtgagaggaactagatccttggcctccaggaggaagttccctttgctgtagggctgatgtctctcatactgtgagttgtcacaaaatccagagcttcagcttcttaatttattactgcctcgttgatgggagagataagtcagctctcttaccccggaaacagtgggtgttctggcagaggccatacaacagcctggccggggctgcaggttaattggccaggggtatggaggttggggtttggctgcaagaggtgttggggaaactgcttgtccaagctggtagcctcggcgcttcctgtatgtgagagatggagatactgtgggcactttaacttgagaagagcccagcactggggtgagctggatggggacacccatgtgtgggtgggtggacctggatagggggcccttcctgggcgaggaagtggctggaggagggtgttggggactggttcccaagagtcactgcagacatcccagctttgttcgatctctaagaagacagacagagtgattttctagttctgggcaacaagaaatgttaggccctgccatggtgatggggtcccagtgggagaggaggtctgaatggaggcatctgggcttggtcaccttcttgcacaggctgtcttaggttgagttgtagcaataagaccccccaatgtttcttgggcacctctccgtggccagttctctgctaggtactttggagaagtagaaaatattagatgaacaaatggacagatggataaatcctgttctctgcgagttcaaagtcaatattgcagagactggagacacacatatgcccacgggcccacacacccacccccatactccccacacacccatgcacacacccctacacacgatgtatgcatgcatgcacacattcatgttcccatgcacacacacacacccacatgccctcctcatacccctacatatgcactcacccacgcactgatgtacacatttatttcagaacaagcttcctgagtcttgtgcaagctgtggatttggccagtgctgctccaacttggggccaccccctcctctcatctcccctcagggaggggttgtctgggtgctctctcaaaagtcctgttctccttcctcctccagccttgccatcctgcagccaggtggccacagggcaatgacttcatcctcccaagcccgtgtttcctcaatctgtaaattggggctaatggttcccaccctgcttgcctcacagggtggcaccaagcattcccatgagataagggacagcagagtgttttgtaaactgcaaattgttttccaaacaggcaaatggtgctgttgttttcccagctatggaactcaagaattcctccacccacaagtaaaccctgtccttgggtggaaagggatatagtggtgatagtgaggggcctggcctgttttgaggcccccacattccacctggtgatgctagaggggcacgggcccttctgctctcaaattttgctggggctcactagctggtgaagtcagtaggggtcttggccttctggctgctggctctgggggcaagagagagaatttggcaaaggaggatgaggggagaagggaaagtgaaaaccagtatatcagagcctgaggcctgtggtcactcgctaaaggaaacatcatctcaaattcaatgcttgttgagcttcagtggggacccacacctcaggtgcatggccaggaatccccttcctcaggaagaagcccagtttccacctcacaggggtgtgtgtatgtgtacgtctgtgtgtgtgtgtgaatgtgtgtctgtgtgtacctattgggcactagctggagctgtggagctgcccaagtgccatcacagaccctccagttctggtggacccctggggagctcagggaacataggagaggaatgaggcaagggtgggggcccgttgggttgtcagaaatcccctcctatcttcttcttctttttttttttttctgaggcaaagtcttattttcttgcccaggctggagtgcaatgatgcgatctcggctcactgcaacctccacttcccgggttcaagccattctcctgcctcagccttccaagtagctgggattacaggtgcgtaccaccacacccggctaatttttttgtatttttagtagagatggggtttcaccatgttggccaggttggtctcaaactcctgacctcaggtgatcctcccgcctcggtctcccaaaatgttaggattacaggcgtaagccaccgtgcttagccccttcctatcttcttgtcttcccagctgtgactgggaaccatgacatcattgcccatttcaggtagcccccagtgggctcaggcatgtggatatggaggccatggggacccagaggctgctccatgggggcaatgatgtgggagtggtactatggtaggtactttgcaaggaacgcctgtctagaagtctgccttgttacccacttatctcccccaccctatatagcccaagccctacagcttaactttggggaaacagaggcccagagaggaaaagggactggcctaaggtcatactgagaataggcatagaacctgggcctcctgtgtcctggccctgtgctcattctcatgcctgggaagatggagctcttactttgggacatcttttgtgaagaatagtgtggagtcatgtacctatgtgaaggaggccaacttgcagaaatgccttgtggaatggagcagtcatgatgggctccctggaagaggaggtaaagcctggttcaacagagagggtaggtgaggtacaggctgcccttgggcagcagggagaaagtttgccaggttgtcatgtctcccatttgttgagcctcactggggcctcctcaatttaatctttttttttttttttttttttttttttttgagatggagtttcattctgtcatctaggctgtagtgcagtggcacgatctcagctcactgcaacctccgcctcctgggttcaagtgattcttctgcctcagcctcctgagtagctggggttacagacgcacaccaccacactagctaatttttgtatttttagtagagatggggtttcaccatgtttgtcaggctggtctcaaactcctgatctcgtgatacacctgcctcagcctcccaaaatgctgggattacaggcgtcagccaccacgcctggccaatttaatcttatcttgtcctcatgataggttgtgagaggttttccccctcatccttactctatagatttattaaatctacaaatattgataggcacagtggctcatgcctacaatctcagtgcttcagaagccaaggcaggaggatcacttgagcctaggatttcgagaccagcctgggcaacatgataaaaccccgtctctacccaaaaaaaaaaaaaaaaaaaaaaaaaccaaaaaaaaaaaaaattagccaggtgtggtggcatgcacctgtggtcccagctacttgggaggctgaggtgggagaatcattgagcccaggagatcaaggctgcagtgagctgtgactgtgtcactgcactccagcctgggtgacagagcaagattctgtctcaaaaaaaaaatctacaactattacctgagttagtgctctgtgtcaggccccgtatcccagtactgggacctagaggtggccaggcagactggccctgccctgtgggcccacagtctgatgagggaggctgctggtgttggcctggctgggggatcagccatgtgatttggggccagttacttcccctctctgtgcctcaatttctcatccaaaaagtggtgataatgaagtcctttcctcctaatgtttataaagtactccaaacagagccaggcacattgaaagtacaatatctgtatgtgtgtttttgcttaaagagttatcaaaggaacaagctaattgtatgttgtgagcaagtgctgcacaggaagtgaaaagggcgatgatgtgagagctttctggggagctaggaatgttttctgtcttgatggaagtttgggtcccaagggtgtgtgcaatcatcaaaactcattgaattggacccttgagacctgggcattttactatatgtcaattatacctcaataaacaaagcatatattgaaagaaagaaaaacaaaggatgaagagggagggcttctgagaggagatgacattgaggtggaccacattgaggggaggcctggaggagaaggctctggctatggggaaggaagatgagaaaactgaggctctaggaggttttgggctcagggtcaactcaaggggtcaggagagacagctcaggggatttcttggcagctggacctgggcccaggctgagggctctggctcctgtgatgtactctgcagagaggccagtggggcgtttattatattttccggggacggccctctcccctgtccctatgcctattttcagggctttggcgtttgtagagggactattttaatccatgtgggaaatgggttcctaaatatggactcagtggggcagaagccttgagaggctccagctcagggcagctccacctgctcctctacctcagcaaagcacaggatgcaggcccaggctggaaggctctccagcccctccttggccatctaccgccctccttctttccctctggctcctcctatctccctccagtcctgggcccatcctcccatcctttgtttgctcggaagcccagtgtttcctgccaggccccagccagggacccccaagtgaacttgacctgcctctgccctcaagctgctcccaggctggtaggaggaacagaagcaaaaccagtaagaaaggtgctgggaggggccgggcgtggtggctcacacctgtaatcccagcactttgggtgggtggatcacgaggtcaggagatcgagaccatcttggctaacacggtgaaaccccatctccactaaaaatgcaaaaaatagctgggcgtggtggcgggcatctgtagtcccagctactcgggaggctgaggcagaatgacgtgaacccgggaggcggagcttgcagtgagccgagatcgtgccactgcactccagcctgggtgacagagcaagactctgtctcaaaaaaaaaaaaaagaaaagaaaaagaaaaaaaggtgctgggaggactttccagagagagaaagagagagagagagagagagagagagagatggagacagagagagagagagattgatcgatctgaattgagccctgaagtttccccaaaaagagggagttgacccaacagagaggatgaggcaagaatgcacatgacagggaccagcacagacctagacacagaggcctgggggagtaaggcctgtttgggaacaacatatatatttttctggccagaacaaagtggttttggcccagaggtggcaggaagtgaggtgggaaaggaaggcaagccctgcgtgctgggggaggacatttatctggaagatgtgaggaagtgtctgtggccacaggtggattagagtcataaggggagaggcagggctgaggaccctaatgaaagcattccagctgtgagcttggacttttaagagagaagaggaggactctgatgtgggagtgagatgccacaaggcaggcagtgaggagggagtgtgggagccagcctgggaggcctgacaggagatggtcaggtcagactggggaggagagaaccaggcagggggagggggaggaggcaaagaaggaacccggtgcagggagggaggatggtacctcttggctcctgtggctgaggattggggtacccctagctagggccgccacaggacatggtggaggcaagtggggggcactgagctttctggtcccagtgctgagaaagaagctggtgattgggaattgtgcgggcactaacctgaggggtgttctggaaggcaagggcagcatgagcaaggatccatggtgtccaggcaggagtgtctgcccacagcagccttgacgcacacccccagcctgctctgggtaatggagcaggggcacagagctgctagagggcttgtccagcccctggctctctgtattccttgcactgcctgtattcccaggctagggttgaggggagcagctccagaaaaggagggacagccaaggggcagcaggctcgagaaaccactgcctgcctctcccctctctgggacactgccctgacccagtttgtctttacctagagagcgtgcatggtcacagagcctgcccctaacagtgccctgtgtaaagtggcctggctctccccatcctgcagaggaggaaattaaggctggggcagcccagggtcctatggctgctgagcagtgctgatccgagccccggtcttgagcatcagccctggtccccagccctcctccattaggaaacacagtgtcacagatggtccttgagtgagcaaccctttttgggggtggcttgtccctgctgtccccattctgggccatctcctcatgcatgctgacttcttcttctccccctacagcagggccactgtgaggccttgttcatttctggtgctggttggcagccacagtccagggctgagttaacccgagcaaggatcctgatgcccgcccactggatgcttgccttggctgggacgcaccctgtggggatgactctgctattataccattttacagagttgtgggctgcagcttggagctgtgaatgtatgcctgaggtcacaccgagtcattggaggaattcaatcccaaacccacatctcactccactcagctgtcatctccctcaactagggtcctcccttcccccagtctctacctctgggtccttaccggtgatctgtaagcatggaatgagggtggaggctgggcagctaggtcaccttgagatggccccacctctctcacagtgcgatgacattgtcgccctggtactgcatagcagctcccaggaaggctataaagttaccttgggagctgggtactgactgggtggtcatgaccaagcaactcattttagaagcacttttcttggtagtgagagttttgttctcatgcccactcctggagaatctgaagtcttaattacttttacccctacaggagtgtggccttgtctccctccactctgggccagtttctttgtgggagatagattgacagacacaggcctcaacctctcctgcaggaagtcttccttctcactccagcactctcctgatcatgctgagtcctgtagggcagatttgcgtgttagtgcaccctctcccctccccagcctttccccagcaccttctgcttctacacttacatttctcatagatgcccagggtgagaatcacaagggaggcaccaagggcctactatgtaccaggtgctatcctgtacaatttacatgtacaatttccaaccctagcctaggaaatggaacagctgtgtcatccttatggtaaaaatgaggctcaagggatgtgtggcccctggcttggggtcccatggctgctgtgtgattagagtggggttataaaacccactcaatttccatctgagaagggaagcaagggcttctttggcctctgagcccctcgaagcagtcagccacctcctacggactccttgaactacctgccaagctgcttgagcccaggactgaccctcaagtccagaggctcactggaccacaagtcagagaaacctagattcaaattctcattctgctccttataagctgtgtgacctggggcaggtcacaggcctcagagcttatatgtttttgtctgcaaaatgatggtagagggctctgagcctgacactttctatgtgcacccacctacagctcctgtatgacagccccaaggcccggcaggaggtagaccatcactggcaggcttctggcggcccccatattgtctgcatcctggatgtgtatgagaacatgcaccatggcaagcgctgtctcctcatcatcatggaatggtatgctggcctgccctgtctccacaccccctcggcatccctgtggccctcaggctccctgccatgcttctaggggctttctttgtttttcaggtagcagatctgggtgccactgtagcccctgaggggcaatggagcaggcagccgcaggccctgcctgtggatctatggagttggccataaggacattccctcaagggtgggcaagaaaccataggggttaatatggcctccctgagtgtgatttctactctgtgaggaggactggaagagctgtcagagaaggctcccaatccctgaatatggatggatgggggatttggggaagaacaggacccacgcaattccctcagctttctctccttttgacctgggtatgtgctcccatggtcccaccaggaactgggtgcttggggcctagaaccaggagccagtggccttttccaccctgggcttcttcctgtaacaccatggctcagcaccagccatccttggaccggttagccagttcttcagatttggggttcagatcctgcctctgctacccactagctatgtgaccgtgggcagctcttaacctctctgaatctctgtaactcagatgtaagatgtgggaaagatcttaatgtagcatttaccctgtgcttgactccattctaagtggcccatgtgtattgcatattcaatctgcatgactatggggttggtgctgtcatccctatcatacaaaagagatagctgaggcacagagaggtgaaagaaccagcccaggatcacacaacagcgctcatgaaacgtggatcccagggcatggcacacagtaggtgcccagagaacagtggtcatatgatgataattaacatctcatcccacatttggggaaacagagacttgaatggggttgggagtacccaagccctcacagtcaggtaggggccgtgccactgggaacacacaggcttcttggcagggatcagagcccaccaccctcttctagttccaagagttcagttcaacccacctaagctgacaacccaccatgcaccaggttctacaagggacagggaggctgacagtggctgttcagtaggggaggagcggagcagcagggtctgaagcctgggcctatgatttggggcaggggcaagggtaggatgatgtgcagtttccccctctctgcttatagtcacctcttttacagcatggaaggtggtgagttgttcagcaggattcaggagcgtggcgaccaggctttcactgagagaggtatgtgcatgtagctggaccagcaggaggattcagggtgagaggtatggaccagagcgttgtgtgtgatgctaggcaagaccctgttcctctcagtcttcccatctgaataagaaagggtgagactcagtgtccatccccacaagggactctctgagtctgagacactttgtcgaacttggactctctatggctttgggatggaggcctcaaagcctcttgatgctgtctcgcagttgagctggggagaggtagctcaggactgaggaaagaagtttagatgggttgggggtatcctcggaggaaactggggtgtctggggtggcgtagacatcccgggatagagaacctggatagcaggagtgctgtcactgtcttcttgtcttgtgctggcctgttagactgtgtccaggagggatgatagggtgggggcttgacctttgactggcatcactgaccccctcctcctctgtttctgcagaagctgcagagataatgcgggatattggcactgccatccagtttctgcacagccataacattgcccaccgagatgtcaaggtgaggctccaggattcaggttgggggcccggggaagaggatattgtcccactccacaatccctgatggcatccaggacccactggatggaggccatgttccctagtcacattcaaagcctctgctctgtgtcccagactgcttttctcagcctcttctctagtttcagcatactcattctgttctcaccaggtgggtccccttgcttctttcaaacactgagtaatccaaatagtaataagaataactgactgcctgcctaaagccagcgggccctgacaagcaatctcatttcattctcacccagccttgtgagataagtgccattacccattttacagatgaggaaagcaaggctcagaaaaagattaagtgacttgcccaggggctgtgtagttgctgcactgggattcattcattcatttgtttacttgttcagcaagaaattttgtgtggatgcaatgtgccaggcctcaggcaggggctgcctgatgctgttggttttttttgttttgttttattttgttctgtttttttgagacagagtctcactctgtcacctaggctggagtgcagtggcgcaatctcggctcactgcagcttccgcctcccaggtttaagcgattctcctgcctcagcctcccaagtagctgggactacaggcgcacaccaccacacctggctaatttttgtatttttcgtagagatggggtttcaccatgttagccaggttggtcttgaactcctgaccttaggtaatccgcccgcctcggcctcgaaaagtgctgggattacaggcgtgagccattccacctggccctgttgcggcttttgtgaagtcacagccatagctttgacagatcaggccccctgataccagcattttaagggaaagaagccatttgctgagccctggaggaaggaacagaggtagtgccagttgttgggccaccttccagtcttgaggctggaagctcagctctccaaatttcctatcctgggaggactgggtcttagaggtcatctggatcagatggatgaaatgcaaaccaaggcagcacacacatgcatgtgcacacaagcatgtgtgagcactatcagagcagagtctgctcctcctgggccctctgccccaagcctagaacgttaccttccttggcttatttcctcctcagactgggcagaggcgagctgaggttacagctgctgcataaggtcctccctctggctgagcaccccaacctgtaaatccttgctttatttggaccctggcttttttttcccgaagagagaaaagccttctgcagaggagattcccttgaatagactaaaactgcttctctgtttttatcacaattgagaaggtcagatcttctcaaatggaacctgagaaatagcatccattggttctaaaccaccaccccatccttctaccaacaccccatccttctaccccggctctgcttgggggtctcttctgcccctctccatgggcctacatcctacctaccattcattaaaaaccagtttcagggacagacctccctactgccctcatctgccaggcccctggctactcctgggacacaggaagattgcccctgtgcagctcctggggtctggggtctgagcaaccagggccttctcccctgagcaacctcagatggggctgtccttctagccctgtaggattcactctgggctgggtatgggacatgtgcttggcaatactgacttatgagcagcctgccttcccccagcacccttgctctagcatttcatggcaatgtcaccaactcaggatcagaagttcctgctccgaggctttctatggcacttggtcattcacagccttggctgagcacctgccttgcttccccttttgtgaatgaaggtagcaccttgggtttctctatatttggcccatgttagtgggcaaggcccgggtctttttataaatggacctggctccttctgcactgggatggagtcggggagtctggctgaagatcaccttggggctctgctcctgcctggttcctaactccaaaccaatgttttctctttctggcccagcctgaaaacctactctacacatctaaggagaaagacgcagtgcttaagctcaccgattttggctttgctaaggagaccacccaaaatgccctgcagacaccctgctatactccctattatgtgggtgagtccttcggacatgagttgtaactcctcaccccaacttatacagctgtattatggggtagccagtgggttgcagaaaccaaagggttaaagcccagcaaggagggagggggagaattctgtctgcatggaggcgggtgacgtggggggccggaggctgcaaaaatattctcccaaacttcagcttctgcttttgaaaatagatccaggaaaattctggctgtggcctgtgagctgaatgacatcacagcagctctaaatatatatgtgataaaaggctgccatcagcttgggacggagcccaaccgcggttgtttttctctagtttttgtcttcctgggattcatattcagaaagtgggcatgcatttcctcctaacttggagggacaaagggtaccagtcacctgccttgtgggagacggtcactaaagccagggcttggaggtgtgcacatactcatgcttcctggaaaagttcactgcccttctgcaagtgggcaacccccggatctgaaaatgttccttgccaaaactgccccctaacctgagagtggggtgatgacagagggcttttctccctcagaagaggtcttcctggagggctgctgaaggggtgggaagttccctgagacagttgaaatggcactctgttaactaggatgtgttttgcactaagtattttaacttagaaatcttctagcctacccacctcattgcacagggaagacaaaggctccatggattggtagccaagctgatgatggaatgcagagccctgtccctggttcttccttgcctgtgacctaggctatgcattcagggaggcaagggacacaggacagctggcaggccaagaccctctcacctacggcagcttcccaccaagccccagactggccttctcttctcttctttcaccaaggttgagactggcagaggggctcaggcccaagggagctaggggtatgtctgaaagtggttgatttttttccaggagctttctcctcccccaacttcacacacatgctgcctttccaaaaggtgccagacgccagtctgctctgccctacctcccagcccaggtacctgctccccaccttgcccaggctttaggctcctgcctgggctccaagacccttgggtctgagagccctgctgtccctctgccctggcagcccctgaggtcctgggtccagagaagtatgacaagtcatgtgacatgtggtccctgggtgtcatcatgtacatcctgtgagtaccttccccaccccctgcctccatctcctgcccttacccccactgtgagccctcaggaccacttctgtccccccacccccatgtccttggtgaggagcttgtgtgtgtcactcctcatgcaggctgcccttcccttttggtcatgggacaccactccttcaggtgcctgagggtctccccatgccaagggctgatggcattcctgggatgtgcctgggagtccggagggctggtattattgctatggtgtctggttgtctgtctccccagtcaggggcttttgaggggaaatgggtccaccctggcactgctcccaccctatgccaaatgacttaccccttcccccagcctttgtggcttcccacccttctactccaacacgggccaggccatctccccggggatgaagaggaggattcgcctgggccagtacggcttccccaatcctgagtggtcagaagtctctgaggatggtgagtgaacctctctgtcccagcctgactcacctggcccctgcggctttcattctgggaaacatcactttggtgtcaaactgacctgtgttcaaatcttggctccccctcttcccagctatgggaccctaggcaagtcccctaaccttcttgagcctcagtttctacatctgccaaacaggctcaaaacttgcctcctcaaaactccctctaactcctattcctcattcatattttcccctttgaggaccacaaacaaggctgccctgtatgagttatctgctgctgcttaaccaattatcctgaacacttagtatttcaaaacaagaaatagttgttagctcactctttctgtgggttgggaatttgggagcacatgcagcccctgccccagcagagcttgtggtctgtggggaagggtggaggggctggctctgcaatctcatctctcccctctcttccctggcccccctagccaagcagctgatccgcctcctgttgaagacagaccccacagagaggctgaccatcactcagttcatgaaccacccctggatcaacgtgagcccctcctcctcccatggcaggcagggtgtccaacaggagtggggctgccgggcaggagggtggtggctctgctttgaggccccagtgcagggctggaatgggcccatgcacacaggtagatactagggcctcacctacaacctggctttgtcactgccctagtgaggctccttccccaccctgagccttggtttttccatctgagtctgggagaagaggatggagtggggggaaccagtgctgtcccaggtgcctccagtttctaatccacgggcgtggggctccttccagcaatcgatggtagtgccacagaccccactccacacggcccgagtgctgcaggaggacaaagaccactgggacgaagtcaaggtgggtgggctctgcctcagtctcaatacaggtgccaggatttgggcaaaagggacttcaggggggtggctacccagggtctggggtctttggcccctttctatacctggagcacagggtgtcagtgactgtcgcagtggtccaaccatggcactccaaggattgggcctcactacgccattcagtgtggtgctcctggctcacttcctcaatgaaacggggctttggtaccaagcttggatgatgacctctcttataaccaacaacatttgggagggtggtcagcctggtttagacccagcagaggccacgtttgaacatatggagtagcagctccagtggcacaatctccaggccccagtgcgctggttgcccagcgagatggcattctctgcaggtcttgtggttctgtggtggaactggtttagttcactatcccacttacccttggtgtggtccgagggagtaactctccttttgtgccttagtgaataagctcagtgtctaccacagaggacggtagtgaggatcatgtgatgcaaagggcttggcccagtgctgggcacacagtgggcacagaggcagcacaggctgtcactgacattaaggggctgcccaggcaggggggtgatggttcctaaggtcagtacatcctgacctcttagtgcccaccatcctgtctgtccccaggaggagatgaccagtgccttggccactatgcgggtagactacgaccaggtgaagatcaaggacctgaagacctctaacaaccggctcctcaacaagaggagaaaaaagcaggcaggcagctcctctgcctcacagggctgcaacaaccagtagctcatggggccttggaggagcctggcctctcagcctgcataacagactgaaatgtgctcaggccctggccaggagggcccagggtcattcttttaacaaaaggattattttgttgtgttttaatttgtcactcggaacttcaggatggaggaccctgaccctaagcctccttcagatctctggcccaggctcaagccctagagatgggcagggcctaggggctgggagctgcctgctgccatagcagcacctttagctaggttggcccgagtgaggcctctgtgctgtcctgccctggtgcatggccttagctttctaggccactgggagttgtggctgggcttcccatcttccacagagacatctccctgtgggatgggcagatgggcctggccttgagaaaggcattggccattggttgccatggtgaccagggaccacgttgctgcctgtgaatgctgagtgagcgagtaagggaggaggggcgattgagggttcacctctgccttggggaggctgatttctcacacactggctggccctctcattctcactcctccttgggccctgaggctgctggatccagtctgcctgcctccctgtgcagtccagccctgccttgctgcagccccagcccagatggcactcagcgctctcccctgagggagtccctgggcctagccatcccctcactattcccgacccaaagggtgacttttcatctgaacttaaggtgggagatatttttaacttttttccactttggaaaatgtcactgtgacaaaagccagcatactttccctgcacccatctgctcaccagatctcaggcaggaaagcccctctctgttgaagtcaggggctatcttttggtatacttgtgtgaaagtggctggttgggagcagagctaagtggcttcccattaacctgaggtctctttctttactctgggtcagacctgaggttggggaaggcgactgagccatgctcagaatgtctggtcctggcttgggcctgagtagggcagagagggcctttcatggctgatcagagcttaccagccccaccccaccatggtagccttagggtgctgagtgcctgatactgcctgacaagtgcctgacacgcagcctagttccttcctggcccctctctcactggctgggaaaccctagaccatgtcagataggacaacactgctgggttttacatccagatagtaataaacaccatttcatcattttctcttggctcctgggtttactctttgtctacaggggtggacaaaggtggcccaagggcagcttctcagacccactagtgatttcaccccagctggagggggtgcctcaggcctgataagcatgccatgctaactccaaggccagagtcctcgccaggcctagaaaggtcagaagagctgagggatggcagctgccacatgcccccagctctgtgctgcccctgtgcagtgtgtgtgacacctacccccggtcctgtgtgtgccagcatctgcccagagtggccacccccagctgtgtgccagcctgctgaagggcgggcagagtgcctgctgcagcgctgagctattttcagaaactgccagatttcatttggcagtgagaatatcgaggaggggagggggcggcatgctgcaagactgtcttttgactactccagtaagagagcactctcacccctccggagcccttgtgggtagcttcaaggagggccctaactgtggcatttctctcccagctcctatcttgagaaacctcccagttttccaagagctcatctgctgcctgcagcgctctctcctccacccccacttccttcagggcgtgggggagggtgcagagatgctggaaggcaggggacaggcaaacacgcctgagatgttctgctgcttcccagcctggtgaccttgggagctttcttggcctcagtttcctcagctgtgtcctggcgatgataatgcccatctcatggagtcatgtgggggatttgagcagatgatgtgtgtgaagtacttagtgaggtgccaggtgcgtggctcatgccccacactcattagctactctaacatccttagtcatcaggaaggagagaagtatctagagttatatctagagtatctagaagtctctagaagaaaaagcagccccaagtctgcctcaggaaggagagaatatctagagtatctagaagtctctagaagaaaaagcaaccccaaatctacctcaggaactttctatccagacaatcagggcttcctcacccatggggtttcatttccaagggcctgctccccagagcagcatcatgtgggcctcctgggctttgtctccagtactgggcttccaggagggtagccagataaattcaagagactccatggagcctgtggttcagcccagccttcctagtataccctacatttggaggaatgctggccagatgcaaaggtagatgtagtccatctagtctcaaagctgtggaggcacagatggccttccttgcttggctgccaagcatccagtgtacctgagatgctgtgctgggtgcaaggaaggctgcagtgagaacttcagacagggagttcacctcaaggtgtttacattcatgcgggagaaggtgaaaacatcacatgttgaaaaatgttaaattggccgggcgtggtgactcacgcctgtaatcccagcactttgggaggccgaggcgggcagatcacagagtcaggagatcaagaccatcctggccaacatggtgaaaccccatctccactaaaatataaaaagttagctgggcgttgtggcaggtgcctgtaatcccagctactcgcgaggctgaggcatgagaatcacttgaacctgggaggcggaggttgcagtgagccgagattacgccactgcactccagcctggcgacagagcaaaagtccatctcaaaaaaaaaaaaaaagtttaatcaaggtcttgatatgatctgtgatggaagaacatggttccaggagaaggaggtgtcatgggacagtttgagccaaagagagaatatatgcatcccagtgctgggaaaggtgcctgataggatacagggttgcaggcagaagtgcagggaccagggcctcagggacagagggtctccctgctctaggactcccgtctgccactctgctctgccagtctgtgcttcttcctggggctgtccttgatcctttgcctgcactgggtttttttttt

SEQ ID NO: 12403 - DNA, 17977 bp, Human
tcacctaggctcaggtggccactgagatatggtctgtacccaacctttgtctccatctgagccgagtacaatagccaaaagtgcagaaggtaccttgtctcctatttccaatgtcagccaactccggctgttacctgttttcattagtaaacaaactgtaaaacaaatgtacagtttcactggttaacggggagatccctgaaagtgaacgggaacgaaagaaaatccaccgctgtgaagcaaggactgtctagtcaggggagaggagaaggacagcatttcttagaaggagggctgggtgaatcaggtcactccagagacactccagtatccatggcctccgatcacggctggagatcgggaatatcttcagggactttaaactattctgcatgaataaggacgactgaggaaattactgttcaagaaaccaaagccaccctgccctccccttctttgtgcttgttctgtctcctcctctaacccaggagttgcagaagcaatgacatctgatggcttcttccttaaggaaaacactggacaggctggaagaggagagagaagggcatgtcctgaccttgctattcccacaggggtccacgtgagcggactgcggagcagttcccagttactggggctaccccgaccatccagcaatagacataaaaccttgaaacttcagttctttgcatcgctgggccaagacgttccttgagtaggattctgtgcacacactgctagttacaagacgtcacgatcttcaaaacatctgaggggtggctttgcaaatgaggcttccacaagctgccaggcagtggcttcctaacccggcggacgcccctcgaaacgattatcaagttgtttcactggacaggtgctgggtaaaagcttgttgagaaaataaaaaataaataaacgtgttcgacccgccgccgcaagaatgatttatctgtaaaatacgtgtcggtgtggtcacaaccgttccccggaggttaacagccggagaaggggcttaaggagcatcccgcggatgccagaccaggctcatgtcgcgcctgccgggcggccagtgcagggccgggccgaggtcgcctccgccgctcctcctcgcggtagctcaccggccgccgctcccggccagagccaccctcccagctgtctgagggcgccgctgtactggagctttagtcgttgacacaggccgtggtagctacctccgggcggccgccctgcgcggtgactgcgccggcgaagactgcgagcgcgcaaacgggggtgggtcacgcggactatgaccttcgggaatcgcggcgacgcctaccgttagtagaaaccgaccgctaacggccgcgcgctaacggccgcgcgccccgcccatcccctcctctcgcgcctcagcgcccaacacccgcccccgccccttccgttcgccgccccgccccgtccctcctctcccaccatccgcgcccagccccgcccatccccgccttttcccctagcctgccccgcccctcctctcgccccacctgcgcccagcacttcccggccccgccttttcccctcgcccgctccgcccctcccctcgcagcacccgggcctagtactgcccgtcccgcccctcctctcgagcctcagcgctcagcatcgcccggaccccctcttcccttcgcccgcctcgtcccgaccctccccttcgcccccgtcccgctccgcccctccctttcgcccccgtcccgtcccgccccgcccctccctttcgcccccgtccctccccttcgcccccgtccctccgcgcgtgcgcgttcgccttcgagcgcatgcccgcatctgctgtccgacaggcggaagacgagcccagaggcggagcagggccgtcgcgccttggtgacgtctgccgccggcgcgggcgggtgacgcgactgggcccgttgtctgtgtgtgggactgaggggccccgggggcggtgggggctcccggtgggggcagcggtggggagggagggcctggacatggcgctgaggggccgccccgcgggaagatgaataagggctggctggagctggagagcgacccaggtgaggaggggaccgggagggccaggggctggggaggccggatgggcccgggacgcgcctgcctgaccatcaccccctcctcttgtcgccccacccaggcctcttcaccctgctcgtggaagatttcggtaagagccttttctccctgccggaccggggctgtggcggcccacccctgcgccctcactcatcaggggctgtccttccctactgctttcctttcctcatcgcaggtgtcaagggggtgcaagtggaggagatctacgaccttcagagcaaatgtcaggggtgagtggctgtacaccagggctgccccttacacccagagtgctggggaaggtcccagagaacagggccccttagggaagacagtgccaggaaccctacgttgtaaaatctcacagaaagcagcagccttgctctctgagtgcccgctcctgatcaaactgatactttcttttctcccaaactttccttagcgcttccctttttgtagcagccccctccccacccctaagcatcctttggttcagctgctttcctggccttgcagcgggaagaccccggtcacacaatgccttttgtgcagttgtgtaatgtattaattttagtgtgcccatgtgtccttggctttaatcctgacacaaagtcatcctgtattgattggttggggtgacaaggcccctcctgggtgcccacacttagagtcttttcccagtggtcctgcagaatagatgtgtaagagagtagcaacagtagcaaccgtgactgaaccaagaagtctactttaatttcctggaacaaaagagactggtgtgggtgttcatttgctttcctgactgcattggggcccacaagtgagaaggagtgcctcagttcctcatcagagtttttgttcttgtcttactttgtgttcctaccctgtcccatccttggccctcagttccagcttttcttctcttacccagaactatagacttcataaggagactgggtggactcctggagcatcacagtcagaggcttatgctttgctctgcctgtggcaggcctttggtgtgtgagggcacaaggccacttcagacacagtgttgggaagaagccaggggagaggggggatcacagcaaggacacctgagtgatgacgcagtgcaaaggattaatgggagaaagaagggaatgctgattgtcttctcccctttggctgatctggctctgccccttacttcccccagccctgtatatggatttatcttcctgttcaaatggatcgaagagcgccggtcccggcgaaaggtctctaccttggtggatgatacgtccgtgattgatgatgatattgtgaataacatgttctttgcccaccaggtctgctggactctgtgctttgtttggagggtgggatgctgccatgtttttgcttgggaagtggaaatggaggaagacaggaggaggagataggcagattctaggggtggtagctacagaaatcctctggcagaacgaactgaactcttaattcattaaagggaacagctttagagtaggagggtgtctgagtccactctctgtgtcctcagatatccagtgggtatttggtaggtgcttgttaaatgaataaacattaggcaaagatgaaaggagctgagaaggggagttgtccagatatgactgacctgctctggatccccattcttgatgtatatgggcttggggcttgcagtgaggggtgctgtgtatgggtgactattcttggtttcacagctgatacccaactcttgtgcaactcatgccttgctgagcgtgctcctgaactgcagcagcgtggacctgggacccaccctgagtcgcatgaaggacttcaccaagggtttcagccctgaggtaggctgcagtgccttcatcctggctcacagccaactgggcagatctgaccctgagggccactgggaatgctaccacatgatattgggtactattaggctgtttctttttcaaatgattgtttatgttacatttgactcttaaataaattgtgtaaggccattgtttttagatgcagttgcggggaaaggacacaggcctagggagggaggagagtttccttaagtcagaccatgtcagaaccttctctgtcaggacttttcctctcaggccatgttgcttcctagtgtccactaattaccatgcaaggccagcacagtccatctctttggggctccagagctcttttctgcccccaccagccttttaagaaagttcgtctgtgttccttccgattcctggaatgcctccaggctgctctctgaagctttgccttccacccatagtcctacctgaggagaaattattctgatacggccttattttcttccccgtagagcaaaggatatgcgattggcaatgccccggagttggccaaggcccataatagccatgccaggtgtgtgggagctgtgggagctgatgtggggtgggagtagggggagtatcattttttgggccctgactctgtttttccccaggcccgagccacgccacctccctgagaagcagaatggccttagtgcagtgcggaccatggaggcgttccactttgtcagctatgtgcctatcacaggccggctctttgagctggatgggctgaaggtctaccccattgaccatggtaggcaccatgagctggaggcctgttgggtgtctctgcctacctcctagggagctggggctcagggccctctggtatgtggtacccagtggcaggggttgtcggtaccgacacccggctctggctggggtttcaccctacaccatattgcccgaccagctcctgattccctggctcaactgctcttctctgtcttccttcccactcctggcctgcccaaactcagggtttccttctcgctgattccttgtcttggtctccactagggccctggggggaggacgaggagtggacagacaaggcccggcgggtcatcatggagcgtatcggcctcgccactgcagggtaagggccctgtgcctgccctgttctactctctggagctgtacctactttgggagggacagagagtatccaggtgatttgtaaattgcaaggccatatggtgaatctggcaagatcaggcttagatcatgggttctcaacttgttgtcttatttcctgcctgggctgcctgtggcctgctcctgggtgggctgggggaggggcaggcctcagtggagccttaggcagcccaggtctgctggttcacttccagataggcccctcatacagcttgttggaaggtaccagctcaggtgcctggcatgtatggctagtcgctgcctgcctgttggggtggggcctatacctacagctgcaggtgtgactgcagggagccctgccaggatatctgcctcaacctgatggcggggccggggcgggagctgctctcacggctgcggctgtgactgcagggagccctaccacgacatccgcttcaacctgatggcagtggtgcccgaccgcaggatcaagtatgaggccaggctgcatgtgctgaaggtgaaccgtcagacagtactagaggctctgcagcaggtaggtgccctttcttcctggcctctgcccagcccaaccctccctgcattcctcctcccttcccccacagcatttgtctctgattcgtgaacatactctcttgtagatctgggcttcagctaaccacatcttttctttgcccccattgtgggaaaggtgggacttggagtggggagggagaatagcttctaaaaggaagtttgggtttgggtgttttatttccctgtgagtgaatgggtagagccaaggccattattcctttaggtcctcagcccttagctatttaaggtagaagcccgggtctaccctttctcctctgagccctggattctgttgttagctgataagagtaacacagccagagctgattcagacccacaagtctcaagagtcacagctgcctgaggagtccaagtcagccagcaacaagtccccgctggtgctggaagcaaacagggcccctgcagcctctgagggcaaccacacaggtactggggggtttgggacctcttgtggacctcagagccacccgctaatgtctgacatgggaggcctaaacagggaaagtctttttctggggatgtccttgggcagtgttcttcccccgtcagaaggtagagggagagcagtccttccctaaagaaaggcacctgtaaagggccgctgttaccacaggcccctgggcccttctctgtaatgtacactccctttcttgttttctctagaggcggttttttttttttttttttttttttttcttcctgcttcttttttcccatctcattctttgccctgtctcattgcgggatcatgacttagagcttgctgactcccattgcaccagctggctgggctgttcttctctgggaagtgctggttcacagggccggggagactgtgagcttttcttggagatcctactggaggtcctgcctgtgttcttgccctgtctcagatggtgcagaggaggcggctggttcatgcgcacaagccccatcccacagccctcccaacaaacccaagctagtggtgaagcctccaggcagcagcctcaatggggttcaccccaaccccactcccattgtccagcggctgccggcctttctagacaatcacaattatgccaagtcccccatgcaggtaagctgggagcacccttgcaggattctctacttgattctcttgagaggctgcaacaggcaattttcccatgtggttccttggtgttcatccttggcatggctgggtcaagctgcctgggcctgggttgctaggttcctctgcctgatatgaaaaggcccccacaacagcaggagcttagggaggcagggagagctcctttgaatttaatctagttacgtggctgtgggattaaatgtttaggtcacgctccttggtacaacttcatgggttgggttttactggcaaaataaaggcatgtgtttcagggcactctgtttctcttaaaacccctccgtggggttctatccagtgtaagtgggtggcagcctccccacaagccaaggacaggccatggaacagctggaggggttccgctgactcagtctggaaaaccatgttggctttctctctggctgtgagtgtctaggctcagcctgggccgagcagcacttgtttgtaactgccctggtctttgtcccaggaggaagaagacctggcggcaggtgtgggccgcagccgagttccagtccgcccaccccagcagtactcagatgatgaggatgactatgaggatgacgaggaggatgacgtgcagaacaccaactctgcccttaggtcagcccagctttctaaggctaccaggttctaggtgcttcggatcccatcctgaatatctcagtctgtgtctgagaatgccctgcagcagataatgttgagcacctgcggagtttggggccctgggggaggctggcatgatggggctgaccccaggtccccaggaagtttttggtgggctggggggtaaggctgagcacgtaagcttatatcatgtcctattggaagtggccttttagccaggccttgaaggattggttggggcagggatggaggagatgtgggtggtggggaggcagctttgctggaacacagggcattggcaaaaggccaggagtgggatggctggaatagaggaagtgtcttttgaggacacttggctgcagctgtcagaacttgatgccaggcttagcatggctagttcaagttgcttggaccaagtataaggagttttagggtcagcccctggaggtcgggatgtatttaagccattctgggtactgctgggtatggtcacctggcccgttcccttgcttcacatcttctcgggccccacaggtataaggggaagggaacagggaagccaggggcattgagcggttctgctgatgggcaactgtcagtgctgcagcccaacaccatcaacgtcttggctgagaagctcaaagagtcccagaaggacctctcaattcctctgtccatcaagactagcagcggggctgggagtccggctgtggcagtgcccacacactcgcagccctcacccacccccagcaatgagagtacagacacggcctctgagatcggcagtgctttcaactcgccactgcgctcgcctatccgctcagccaacccgacgcggccctccagccctgtcacctcccacatctccaaggtgctttttggagaggatgacagcctgctgcgtgttgactgcatacgctacaaccgtgctgtccgtgatctgggtcctgtcatcagcacaggcctgctgcacctggctgaggatggggtgctgagtcccctggcgctgacaggtgggccttggactggctcactggccacttggtgcacccaggagggaggagggaagtggccaagtgaccacaaagtgtcctgcactctgatgattttcttgtgacctctcttcccagagggtgggaagggttcctcgccctccatcagaccaatccaaggcagccaggggtccagcagcccagtggagaaggaggtcgtggaagccacggacagcagagagaagacggggatggtgaggcctggcgagcccttgagtggggagaaatactcacccaaggtgagcctccgttgtggttttctcctttaatcctggcagagggtaaggcctgagctcctcctgcccaggtgccaagttcttgattggaactttggtgtgaagattggtggctggagccatgtgccagaagactttctgggttgggtggtggcaggggccttgataggcatggactcgctgctcatccttgcctctagctgcctattgctcgtggggctttgttgctggcccgccccgatcagaggtgcaatgctgggttttggcaggagctgctggcactgctgaagtgtgtggaggctgagattgcaaactatgaggcgtgcctcaaggaggaggtagagaagaggaagaagttcaaggtgggtgatttctccagttgcctgatctggcctctcccgaggtccactggtggctgctctggcaagattggctccagtgctctcagtcttcttctctcctacagattgatgaccagagaaggacccacaactacgatgagttcatctgcacctttatctccatgctggctcaggaaggtgaggggatgcgctgctgtcttaactggaatgccctgctgagggccgtgtccttcagctcccctcccctggcctctcctgaggcttgagcagaccttggggcacagggagggccatgagagcctcagctcctggcctgaggcagccagcacctgctcaagggtctctacctcttcgcaggcatgctggccaacctagtggagcagaacatctccgtgcggcggcgccaaggggtcagcatcggccggctccacaagcagcggaagcctgaccggcggaaacgctctcgcccctacaaggccaagcgccagtgaggactgctggccctgactctgcagcccactcttgccgtgtggccctcaccagggtccttccctgccccacttccccttttcccagtattactgaatagtcccagctggagagtccaggccctgggaatgggaggaaccaggccacattccttccatcgtgccctgaggcctgacacggcagatcagccccatagtgctcaggaggcagcatctggagttggggcacagcgaggtactgcagcttcctccacagccggctgtggagcagcaggacctggcccttctgcctgggcagcagaatatatattttacctatcagagacatctatttttctgggctccaacccaacatgccaccatgttgacataagttcctacctgactatgctttctctcctaggagctgtcctggtgggcccaggtccttgtatcatgccacggtcccaactacagggtcctagctgggggcctgggtgggccctgggctctgggccctgctgctctagccccagccaccagcctgtccctgttgtaaggaagccaggtcttctctcttcattcctcttaggagagtgccaaactcagggacccagcactgggctgggttgggagtagggtgtcccagtggggttggggtgagcaggctgctgggatcccatggcctgagcagagcatgtgggaactgttcagtggcctgtgaactgtcttccttgttctagccaggctgttcaagactgctctccatagcaaggttctagggctcttcgccttcagtgttgtggccctagctatgggcctaaattgggctctaggtctctgtccctggcgcttgaggctcagaagagcctctgtccagcccctcagtattaccatgtctccctctcaggggtagcagagacagggttgcttataggaagctggcaccactcagctcttcctgctactccagtttcctcagcctctgcaaggcactcagggtgggggacagcaggatcaagacaacccgttggagcccctgtgttccagaggacctgatgccaaggggtaatgggcccagcagtgcctctggagcccaggccccaacacagccccatggcctctgccagatggctttgaaaaaggtgatccaagcaggcccctttatctgtacatagtgactgagtggggggtgctggcaagtgtggcagctgcctctgggctgagcacagcttgacccctctagcccctgtaaatactggatcaatgaatgaataaaactctcctaagaatctcctgagaaatgaaccctcctgtggttgctggcctgagatatggaggctgggccttactagacctcgtgggcctagggccctgggaccagaaaggtaagaagtatatgatccttgagtgtccagctgtcttgggccagagatccttggaatcctaggcctgggatttaggacctgagctgaggagggacttcaggtggactgtagacagggtgcactttctggggagagggccatggctttcaccaaatctgtggctttgcagcctggagaggtgctgggactgtgggtcaaagaggcggggctgcctctaatctaatctcgcctggtgtgttctccctgggagggcgctgggcatctcttccttgttgcttttggacaggtaaagcaggtcaaagctgccgcctctgtcccgctctcctctgccgactgcatcgtctgctgaggctgctgcagcccctcaccagccccctggcagtgagtcctgcagaggggtcctcatgcaagcagctaaggcacagctggactgcttagaaaattcagctttaatggccccagcccttctgtctgagtctagtagtccagggcacagatgagggccacaccacgctttatccagtgtcgctggggctgatgggtggggatctccacagcaatgacatagttggtagagtgtcctgtggttgatagtgttcctggaatgggcaaggagggggacgggttaggtcatgccctattactactagcagggatagcgtaggggcagggcagtgggcagactaagctgaggacagggagggggccctgacccaagaggaagcctacctgatgagggggtctggccagggttcaagcctgcccagggttactgtattggggactgaagatagggatggcagagttgatgccacttttcattctctgatggacctagtccaaacaagttcctgccctgggcctcagttacccctctgaactcccaatgacaggctggggcttgtaggctcttggggcccaaggtgggcctgctgagggaggcatgcaggataggagttcaggggtgctccccacagccagacggcaggccttgggcattaacctgcctgctgcttgctggcctggcccaaatctctgttgtccttccttgttcagctaacctggataagtgactggcttgggctgggctgggttagtcctgggtccccgcccatagtgtaggctcccatcccaggcctcataccagcacgagtcagtgtcttgtagatggggcacaggtaaaagtcctggtcctgggccttgcggttgggtgttggcaagagccagataacggccatctctgtgtacagctccttgggctgagactcagccagctggaaggcctctggatcccagcgggcaccttccaggaataatccatggatatagcaccctacttggggtctttgtgttaactctgatggtgcctcaaacatcacctgtgggtagacacagacacaccccacacacataacaatacccagaatctgggttaggaggcacaaaactcccttctgagagagctgcctaatgctgcctgcctgcccatcatcacgtacctaccactttagcccatggcctgtggtctgtgccctgcccctgtggatttctgatggacccagcccagacccgttcctgggactcatggcctcttctggcttgggtctttccatgccctggcttaggggtcccccaactgccaaccaaccgtggcctcagagcctctcctccctgggctgtaccctagcctgtcacctgacctggccctggctgtgcccagaccttgaaatcaaaggagatggtgtcaatggagatgacaaatttgcgggcaaaattctgcagagtgcctgttaagaaagcctgggggaagaagaatccactgatccagaagacagctgggatgccatcttggatccaggcctgcagaaagtccaggcgttgcagcaggtccatgacccatgatgacagaggcttgagcgatgggtaggccttggcactccagagctcaggcacagtattgttgtacaggctggcagccatcagctccagctgagaggacatcactaccagccccttgagtgccttgagtaggtcttgcagtgtctgtgtgatcacctgcagcagccgattgtacctgtgaggccagtggcaagagaataggtagtgggctggggtcacgtggcagtagctatgctccgcagctcaaggccacagagtgaaaaacaatggcaaaacatagaggctaagagcagagagctgggtcaggtggcctgggtacaaatcccagctctggcccttagcacatgtgtgaagttggacttggatagcttacggaacattttggggtcacagtttactcgtctacaaaatgtgaataataaaaatatggctgagttggccaggtgcggtggctcatgcctgtaatcccagcactttgggaggccgaggcaggcggatcatgaggtcaggagatcgagaccatcctggccaacatggtgaaaccccgtctctattaaaaatacaaaaattagctgggcgcgctaattaggtggtgtgcgcctatagtcccagctattcaggaagctgaggcaggagaatcgcttgaacccgggaggtggaggttgcagtgagctgagatcataccgctgcactccagcatggcaacagagagagactccgtgtcaacaacaacaacaaaaaatagctgagttagaggatgtgtagcacttggcatggcacctggcccatagtaacccctgttgtcatttctctacagtccagtggccgctgactcggggcaggggtatggcggggtgattacctaatgacctcttgtactagtactgtgttcattgattcctcatacagcactgggtacttggccatcacccattgcaagttgataggctcaggcaccttgagcagaatgttttgggtgacgtcctccactatctgcaggggcaaaggaatactgtggggtcaaggctgggcccccttatcccctgtgggattccacatgcataggggtccttcccacaggggagtgggcaggatggtgaagcccagcccgtccagcccttgggccccttactctgacaccacccacctcctcccggccctggctgcctgcagaagatgatttgggttgcagctggatgatggtgcccaggagggcgaacgtctcgttctgggcaaaggtgatgttggcattgtcatgcaggccaaagatctcaggcatatcattgagtgggaggctcttgatgtaggagaggtagccctaggagagaggaggccaacatggaagcccctggcttgctctgccccagccctcagagttaccctccaatggagcacatccccacttgtcacattccccacttgtcactcctgctcataacccttatgcatgtccctgctcttgggactccaggcctctgaggcactgtgtggtgtggcccttgcttccctcccagcctccttgttactgccatccattccctgcccctctattcagtggcccaaatttgtcaggctccctcctgccacaggccctttgcactgatgacccacacaacccagccctggctcatggcttctcctcacacatcttaggggaagcatcatttctgtggcagccctccctgactgtggagtctgggcctggttactgccttggaggagctgccccaagccttcactgagtaattccacccagggagtggctgaccaggagttcactcacagaggcaagccccagtgggcagggtctgactccctcgccaaggctgtctttgtgggatgggatggattgactgatgaaaagacagctgatggagggtgggggctgcatctcctcccacccagcaccaaggtgctcatggtaccccagaaccccaggctggcaggcccctcctgtgcagccctttgggctggactcacgtggaggtcgtaggtaggcgggatctggtggtagatgcccgaggcgctgtagctgtgctcaggggagagcacgtcagggttgtagaagtcctccaagatgttcatgatgcagcgccggtcccagtcatcagtgacacggcccccgtaattgatctcccctgccgtgtacttgaggacctatggggtgggtgggtgagggctcccctaagtgcccagtcccccaggccccagtctgccccaggcccaccttgtaggggatgtcatcatattcgtccaggaacatcttgagctggctgatgcagatgcgcagatctccatccgtgaactcataggggatgttgaagcccaggggcccaaacttacggcgctccagggcgttcccatggaacaagcacagagacagcagcagagacttgaactccatcacctgggggaggtgggaggcaggggaggtgaggagcggggacgggggcaggtagggtaggcctgcaccaagtgtgcctcaccttgtggcaggagttgaggaagtcttcaccaaggctactataggacttcagcaggttggccctgacaccgcgtggcggctcaatggtcatcttggagccgttctgcaggatggacactgggaacttgttgctgggcaggctggtgagccagaggcggaagtccctgtgtacctggtggccatggctccacgtgagcattgagacccatatctggtggccaccctgacaccaggctccctcctgcccagggaccctgaggtgggtcaggcgaggctgcacagacaactggttaagaattgggcttttggctgggcgcggtggctcacgtctgtaatcccagcactttggaaggccaaggcaggcgaatcacgaggtcaggagtttgagaacagcctggccaacatggtgaaatgccatctccactaaaaatacaaaaaattagctgggcatagtggcgggttactaccagctactcgggaggctgaggcagaagaatcgcttgaactcaggaggtggaggttgcagtgaaccgagattgcaccactgcaccccagccccggtgacagagtgagactccgtctgaaaaaaaaaaaaaaaaaagggctttggcaagtcccaggtcacggtctgtgctgggtgtccctggacaagtcacatcaccgcttgtacaggtaactgggggtgggggtggattgagaggattaatgatgtcgatgtgtggcacatgtcagttgctgagcacttgccacgtgctagaggctgggcagagtgcttggcatgattctcttatttctgcctcattagtccctgatggatgcagaggcggccccactgggtctgtgatgggcagggcaacacaccttgtcggggttgatgtgctcgatgaggcgttctagggctggcatccagcttggtgccaggtggcagttctggaagaagacccatttgcccctctctatggagctgcgcatcatggcttctgcccgagggccctgcaggggcaagagcactgagcagggggccagcttgcccaccccccagcccactcccttcctccctgcctagccctgacctgcccctggcccagggagatggcagagagctttttggagaacttcatttcttcggcaaacttgtagaggtcggcagcagggtctgtgccgggtgacagcacaaagatgaggggtgtggtggagttggagtctttgaacaccactgacagattggctgtctgcaagggcagggggagatgctgagaccacctggggctgcagagagatcggggcaagggagggggatctggggttctcagagtggtccccagtgggcttcctggtgggggctggaacctcagagcctttagggagcaagcaggggtcctggcctggccaagtagtctatccagatgcagccagggccctgggacccagggtggggacaagctcaaggtgccagtcctgccagggttccagcacttgcctggggttcaatgaagcgtggctccaggttggtggccacaaagtcctgcatggcgttggtaaccttgtccccacgcaggcagcggaggactagcagcttctggaactggtctaggtactggtcccagatgccaggcaaaggctccctgcaacagtggcccacacctccctgagagccagcctgttggaaggaggttggtggccccagggattcggccagccggacagctggggagagtgggctatcccaggggtatggcactggaggcacagaggagatgtggccacagccacagggcaaccctgggtggccccttagagaaggcgcccagacaagcctttcctagggactcatcccctcgatgggctcatcctgccatattctggggcccagctaaccggtggggctcaaggctgtcgaagatgacccggaattctgagaggtgcttcacgaagtcggaagagaaggaggaaaaggttggcaggttcgagagtgctaggatgtctcgccaagcccggtctgacagccagtccggtgccggattctcagtcatgatcgagatggagcccccagacaggaggtatcgccactcactctggcaggggacaggaggaggctgatgcccaggccctggccagctcctcctgctctgggcacccccacccagtagtgcctctctaaccaccctcacctggagaaactgagtctcccttggggatggtagtcaaacaggtctgggttagtgttcccaccctgccttttcctggctgtgtgcccttagggcaagagatgtgacttctctgggcctctgcctcctcatttgggagtagaaagaatcagaaggctgactgcttcccaggccagagtcctgtgccaggcacgcagttagggctctgacagtggtggctgtcactctcactgtctcggcagggctttccgctgcaccacgaaatgcatagggcttcatgagagtgtgagttcctggccaagcaggtgtgggaggctcaggacagtccgtccctggggacagtctttgtgctcaccagcacactcaaggctcgagaaggcctgtgctcacaacattggccttcttgaaccttgagccattggttggagcacaatt

SEQ ID NO: 12404 - DNA, 36456 bp, Human
tagagaagctggtgtttaccggaaactcaggagaaccagccaaccacaacccctgggttaccttggcaattgcagaataaatgcattatagttactaaagtaaaaaattagatatgcctgtttgcagattgaactataaaaataccattcaaagacaaatagatctaaaaataaaatggaaaaacataaacactaattctgtaaatattatacttaatgcacaactgaaacaaaatttgccagcttactcaatatcaaaatctatgaacagtttttctattttatataatttccctctcctctctctggatctcgctccccagctcattttttcttttttttgctctgattctttatacacctctgctgcctctgtgataagcagcttcaaagatggttcctaatgctttattggatagaatacaacaaaagcgatgaggtgttgcttccccaattacattacgaagcatccgtggcttccatctccagtgggttcacttgctgtctggctctaagggaatccagataccataatgcgggctgccctatggtgaggtttgcatcactaggaactcatgtctctgggcaacaaccaatgaggtcttgatccctgccgtcagccacatgagggagcttggagctcggaagtgaatcctcctggagtcaagccttgatatagctagccctggcagctgcttgactgcagccttgtgaaagagaccttgggccagaggcaccagctaaactgcccctggattcctgacccagagaaagtgggagatgatgtatttttgctttttgaagctgctgaatttggggataatttgttatatagcaatagaaaatgagtaactcttttgtattcctctttgtcctggcttccccattttgaggaaaataaagtaaatcaaagtgtagagctgaaatattcacatgaaaataataataaagttttaaaattatttgaatgtcttgtgttgacattccaaaatatatgaattccaaaaatttatatgttgaagtcctaactgtcagtatcttagaatgtaacttttttggaaaaggggtcatttcagatctaattagttaagatgaagttatactggagtacagtgggcactaaatcgaattggtcctatgattgagtctcagtctttcagtgagcctgtacccctgggtttatgaccttcagttggcttttttcttctgcccttatttggcataaaaacaaagcaggtggatcacctgaggtcagcaatttgagaccagcctgcccaacacggcgaaaccctatctctactaaaaatacaaaaaattagcctggcgtggtggcaggcgcctgtaatcccagctacttgggaggctgaggcaggagaatcacatgaacccgagaggcggaggttgcagtgagccgagatttcgccactgcactctagcctgggtgacaagagtgaaactccatctcaaacaacaacaacaataaacaaacaacaacgatgacaaaaaaagctagagctgggattttccctttccctgtgttaaagattagagtggtgtcctcacaaaaagggaaaacttggatacaggcacacacatggggagaatagcatatgaagagacacagggagaaggcagccatctatgggtcaaggagagaggcctggaacacatctttccttcaccgccctcaggaggaaccaactctgctgacaccttcatctgggactcccaccctccagaactgcaaagcaataaattttttattttttacaccacccagtttattgtattttgttaggcagccctagcgaactaatgtacatagagttcttgagttaatcttcacaaattactgcaataaggtagggtcttttgttatgtaacaatgctatgaaatcatagcgttttcttaattaacttccgtagtttaaggtactaagttctggacaccacgtgtcttctttctataaataccaggacatgctctgtttttcagcactcattggacttcagcatgactactcagttgccagcttacgtggcaattttgcttttctatgtctcaagagccagctgccaggacactttcactgcagctgtttatgagcatgcagcgatattgcccaatgccaccctaacaccagtgtctcgtgaggaggctttggcattaatgaatcggaatctggacattttggaaggagcgatcacatcagcagcagatcaggtaccatctctaccatctctccagtgtactggattctatgagaaaggagggggtcctaggagacagggccactgtcagggtcagttacacttttagatgatatatgtatcagagtagccaagaacctttattttacagttagaattctactttcctctcaaaattagagcaaggacttccctaaaagtaagaacaaagttaagaaaagaacaatttgctcattatcaagaagcagcagacctttgaggaactggccataaattcaacatctttgttccccttttctggtacagatggaggatggaggataaatgggtcagggactaggtgctattttcagagtattagtggccttcatgtactcatgtgctattaaggctttgcaggttttcgaataaatttataatctgaaaacaaatttaagttttcaattccttgccagcatgcattatatacttcacacttcattctaattacaagataaaagtatatgtaatgcattgtgagtccttaagtttagtgaaggtttcagtttgaagttaatcatacagtataaattgtggtttacacaaatattattttaaaagctattgatcgattaggtgtagaccaggaatacatgaagtgtgataaaagtcatggataaatgtgtattacatatatctataaatatatattcttttgtgttgttgagttaaggtctcactctgtcacccaggatggagtatagtggtgtgatcacgtctcactgcagccttgacttcccgggctcaggtgattctcccactacagtctccagagtagctgggaccacagatgcatgccaccgtgcccagctaagttttgtattttttgtagagatgggattttgccatgttgcccacgctgtacttgaactcctgacctcaggtgatccacctgccttgggctcccaaagtgctgggattacaggcatgagctaccgtgactgccctatattcttatatatactaatatttaaaaggttatcaggagttctgatgttctttttcatccttagtccaactatttccttgaaggtcacagagctttttaaggtgactctctaattggaaggtgcccaggttagctcaggcagtacttgtaggcatgggacagttcaagtaaccagtttgtggctcctctttttctgagaagcaggaatcatgtttgcaggggaaagctagggcagaggaggaaataaacagaatatttaagttattaatcagtcttgacacaggcacagtcatcagcgaaagttcaaggagaggcttggttccaggataagctaggtttatagttaacgactgccataggaaacaacaatggcaggattagaaaattaaaatgcttgactaagccaggtgcggtggctcatgtctgtaattccaacactttgggaggctgaagcaggcggatcacctgaggttgggagttcaagaccatcctgaccaatatggagaaaccccatctctactaaaaatacaaaaattagccaggcgtggtggcagatgcctgtgatcctagctacttatgaggctgaggcgggagaatcgcttgaacccgggaggtggagattgtggtaagccgagatctagccattgcactccagcctgggcagcagagcgaaactccatctgaaaaaaaaaaaaaagagagaaaaaaaaatgcttgactagaagcccaaacctcaccattatgtaacatatccatgcaacaaacctgcatttgtaccctttgaatctaaaattagaaataaagaaaagaaaagaaaaagaaaaagaagtgacagtgcactgaaaaaaaaggaaattaaaatgctttggaaaagaaaataaattataaaaatatagaaaacaaaataagatttaaggggtgtgggggaagcccaaatagttgttactcagccactcagctcctcagctcctcttgcaggcccccctttggattaagttgcatttttaacagggtgcgcatattattgtgactccagaagatgctatttatggctggaacttcaacagggactctctctacccatatttggaggacatcccagaccctgaagtaaactggatcccctgtaataatcgtaacaggtaaagaaacaacttgtgaaaaattcactagtaaacatcaacttgatttacctgggaaaactttgttgatgatcattgcatagatccatgatcaattcttaagtttcagtatagcttatttttcatctactatgggtatatttactgggagagcaaatatgaattatgaagtcacagaagtcagagctagaaagtagcttagaaatcatcacattcagtgtgaacatctctggtctctgactcctcaccagtgaacagaaaaatatttccctgtgtaggtctgtgatttgaaaactatatgagtaaatggcaaaagagagtcacatcagtttaagattaatagttttcctttctcattgctaagatagctgatgaggttaatgtagtaaagtccttaaagtgtaagctgattgtaatctaagaggtgatatggcaggattttaagtggtttaagtcaggtctcggctacagagatattaagtgtggtgaaagcagcactattaattttaatgtaaggaaaccaatatcttatacacctaagaaaatcatgtcgattcacatacttctttctgaatacacatggctaaaattattttaggaattcctcttttggaactattctcaaaaccgcacaacgccagttagaatggtgatcattaaaaagtcaggaaacaacagatgctggagaggatgtggagaaaggggaactcttttacactgttggtgggagtataaattagttcaaccattgtggaagacagtgtggtgattcctcaaggatctagaaccagaaataccatttgacccaccaatcccattactgggtatataccaaaggatcataaatcattttactataaagacacatgcatgcatatgtttattgcagcactgttcacaatagcaaagacttggaaccaacccaaatacccatcaatggtagactggataaagaaaatgtggcacatatataccacagaacactacacagctgtaaaaaaggataagttcatgtcctttgcagggacatggataaagctggaaaccatcattctcagcaaactaacacaggaacagaaaacaaaacactgcatgttctcgctcataagtgggagttgaacaacgagaatacatggacacaaggaggggaacatcacacaccggggcctgtcggggagtcgggggctaagggagggatggcattaggagaaatacctaatgtagatgatgggttggtgggtgcagcaaaccaccatggcacgtgtatacctatgtaacaagcctgcatgttctgcacatgtatctcagaacttaaagtataataataataatactaaaattaaaaatcccacagaaactggctgggtgtggtgactcatgcctgtaattccaacactttgggaggccgaggcaggaggatcacctgaggtcaggagtttgagaccagcctggccaatttggcaaaaccccatctctactaaaaatacaaaaattagtggggcgtggtggtgggcacctataatcccagctacttggaaggctgaggcagggagaactgcttgaacctgggaggcagaggttgcagtgagccaagagagtgacactgcactccagcctgggtaacagagctagactctgtctcaaaaacaaacaaacaaacaaacccacaaaaactacttacagagacaccttgattttgacaaggtggattttgataaattccagtgttatttatcataatcatttactctattcttatttaattgtaccataattatttcttatttaatcatgtcatatgtcagtgcttcagtttctaaaaggcaagcactctattatcacttccactatgaattgaattgacttatttctgaatggcctttccctagaacctcatctccaagggcctcctgaacatccccacaaggatgtcccattcacttcatttcaaggaacacggttgcccatttatgttttccatcaactaatgatgtctgaatgtcttgccttaattctctctgtctctctctctcttttttttttttttgagagagagactctgtgtcgcccaagctggagtgcagtggcgtgatctcagctcactgcaacctctatcccccaggtccaagcaattctcatgcctcagcctcccgaagatgacaagtgtgagccacaacacccagctagttttttgtattttcagtagagatgggtttcaccatgttggccaggctggtcttgaactcctggcctcaagtgatccacctgctcggcctcccaaagtgctgggattacaggtatgagtcatcatgcccagctgccttaatttattaactctgcaaattttttttgagtacctattatgtctaaacattgttctgggcaatgaagtgaacaaaacagattaaaaattcctgtccccttgaaatttatattctagtgtggggaggtaataaatgttttaaaaagataattatctatctatcatctatctatcatctatctattatctatctacctatctttatataggtatctttcatctgtctacctatctatgatatgaggtggaagtaaatgttatggaaaaaataaagtggggaaggtgaatagggtggcaagcgtggggctgaaattttaaaaggtcgtctgagggcatcacagtgagatttcagcaaagacctgaaagaaatgaggcaatagatcatgtgagtatctgaaaaaagtgcattccaggctgaaggaattctaaattccaagatcctgtggtcagagtatgtgtctaacctatggaacagaaaaagggttagtgtggttacagtgatgtgacagaagaggagaaaagtaggaaatggaggcagaagggcaggaggagcgcaatgttgagaatagactccagggtataggtcaccaaagaagcagagggcagttcaaaagctgttgtgatcattatggcatagagatgatgggtctgagaccaagaaatggtagaagtttaggtattgagaagtggacagattccgaataaagtttgaaagtagcactggcaggttttgttgaaagactggatgtaggatgtgagagaaaaggaggactcaatatccttccctgctctcatagaatcagatctcatcttattgagtatgtttgaagtatgcacatagttgattgctttctcttctcatattcaccaaacttttgggacctacatcacctcttagactgagcgttaaaggaacaggctctcatcacttttcttttttatttaatttatttagcatttatatgtcatatcgttccagaaggatttgaagtttctaattatatctaatataattaaaaataggatactttagttctaacaacaaactagaacccatatgaatagaggaagcagttgttatgaggcatcatggtaaagagctgctcattacaactggatgttaagtatagttctaagagtttctgagcagctaagagaagtacaattttgttcagacactttgattgcatcatagaagaaagcttgcatatttcttcagagacaaactatgtctaataacctaacttaaagatgaatttacttattcaactgtttttgttaattattttatttttaactttcatgggtacatagtagatgtatatatttatagggtacatgagatgttttgatgtttgtacacaagcatgcaatggtaacaatcacatcatgaagaatggggtttccatcccctcaagcatttatcctttgtattacaaaccattcaattatgctcttttaggtatttaaaaatgtacaattaagttattattgattatagtcaccctgttgtgctattgaatactagaccttattcattcattctaactatttttttgtacccattaatctcctcactttctccccactcctcccctaactacccttcccagcctctggtaaccatctttctattctctatctctatctccatgagttcaattgttttgattttcagatcccacaaataagtgagaacatgtgatgtttgcctttctgtgcctaacttacgttatttcacataacctaatgatctccagttccattcatattgttgcaaatgactggatctcattctttttgtagctgaatagtactttattgtgtacatgtaccacacggttgtttccaaattttggctattgtgaacagagttgcaataaacatgaaagtgcagatatcttttctatatactgattttctttttgaggagtatatacccagcagtgggattgctggatcgtatggtggctctatttttagttttttgagaaaccttcaaactgttctctacagtgactgtactaatttgcattcccactaacagtgtatgagggttcccttttctccacatcctcaccagcatttgttataagtcattttaacaggtgtgagatgatataattgtacttttgatttgcttttttttttttttgagacagagcctccctcttgttgcccaggctgaagtgcaatggtgccatcttggctcactgcaacctctgcctcctgggttcaagcaattctcctgcctcagcctcacgagtagctgggattacaggtgcctgccactacacccagctatttttgtatttttggtagagacggggttccaccatgttgtccaggctgatctcaaactcctgacctcaggtgatcctcttgcctcagcctccagaaatgctgggattacaggtgtgaatcaccatgcccggttgatttgcagttttctgatgatcagtgatgttgagcaacttttcacatgcctgtttgccatttgtataacttcttttgagaaatgtctgttcaaatcttttgcccatttttggattggattattagattttttttcctatagagttgtttggacttcttacatattccggttatgaatcccttataagatggatagtttgcacatattttatcccaatctgtgggttgtctcttcactttcttgatagtttcccctgctgtgcagaagctttttaccttcatgtgattccatttgtccatttttgctttggttgcctgtgcctgtggggtattactcaagaaatctttgtccagaccaatgtcctggagagtttccccaaagttttcttttagtagtttcatagtttgaggtcaaatatttaagtatataattcatttttatttgatttttgtatatggtgagagataggggtctactttcattcttccgcatatgggtatctggttttcccagcaccatttattgaaaaaactgtcctttccccaatatatgctcttggcatctttgttgaagacgagttcactgtagatatttgggtttatttctgggttctctcttctgtttcattggtctatgtgtctgtttttatgccagtaccatgcagttttggttactagagctctgtagtataatttaaagtcaggtaatgtgatttctccagttttttttctttttgcttaggagggcttctggatcttctgtgtttccacgtaaatttcagaatttttttttctatgtctgtgaagaatgacattggtattttgatggagattgcattgaatctgtagaatgctttggatagtatgggcattttaacaatattgattcttccaatctatgaacatggaatatctttccatgttttgtgtcctcttcaatttcttacatcaatgttttacagacttcattgtagagagctttctcttctttggataaattaattcctaggtattgtattttatttatagctataacaaatgctattcctttcttgatttctttttcagattgcttgctgttggcacagaaatgctactgattttttatgttgattttgtatcctgcaactttactgaatttgtttgtcagttctattagttttttggtggagtctttagggttttccaagtataagataataacatctgcaaacaaaaataattttcctcctttccaatttggatgcattttatttctttctcttgtctgattactttagtgagaacctccactactatgttgaataatagtggtgaaaatggacattcttgtcttttctagatcttagagaaaagctttcagttttccctcattcagtatgataccagccatgggtctgtcataaatggctattattgtgttgaggtatgttccttctatatccagtcattgagggtttttattatgaaggaatgttgaattttaccaaatattttttcagtgtcaattgaaatgaccatttggtttttgttcttcattctgttgatatgatgtgccacatcaattgatttgtgcatgttgaaccatccttgcacccttgggataaatccgacttggtcatgatgaataattttttaatgtgtcgttgcatttggtttgctagtattttgttgaggtttttttgcatcaatgttcatcagggatgttgggctgtagttttcttttttatgtgtctttgcctggttttggtatagtataatactagcctcattgaatgagtttggaagcattcctttctctattttttggaatagtttgaataggatttgtattagttctttaattgtttggtaaaattcagcactgaagcctttaagtcctgggcttttttttgctgggagatcttttattacagcttcaatcttattatttgttatctgtctattcaggttttggatttctttgtggttcaatcttggtaggctgtatgtgtctaggaatttattcatgtcttttaggttttccaatttatcggcatgtagttgctcatagtaatctctaatgatcttttgaatttctgcagtattggttataatgtctcatttttcatctctgagtttatttttcttctatctttttttcttagtctcactaaaagtcaattttatcttttcaaaaagaaactttttagttttttttggatgttttttatttcaatttcatttatttctgttcagatgtttattatttttcttctactaatttcaggtttggtttgctcttccttttctagtttaaaaaaatatatcattaggctgtttacttgaaggttttcttctttgttagtgtaggcacttatagctataaactttcctcttagaacgattttgctgtatcccataagttttgatatgttgcatatccattttcatttgtttcaataaaaattttaaatttcttcttaatttcttcattaacctgctggtaattcaggagcacattgtttaaattctgtatgtttgtatagttttcaaaattccctttgctattgatttctagtactattccactgtggtcagagaagatacttgatatgatctcaattttttttaatgttttaagatttgttttgtgacctaacatatggtctctccttgagaatgatccatgtgctggggagaagaatgtttattctgtagccattggatgaaattttctgtaactatctattaagcccacttggtctgtaatgcagattaagtccaatgtttctttattttttttttccttctggatgatctgtccaatgctgaaagtaggatgttgaaatctccagctattattgcattgggatctatctctctctttagctctagtaatatgtcctttatatatctgtgtgctcaagtgttagcacacttgtgtgctcaattgttatatcctctgacagaattgacctctttatcattatataattaatttctttgtctccttttatggtttttgtcctgaaatctattctgtctgataaaaatatagctacccctgctccttttgttttccatttgcatggaaatctttgctatccctttattttctgtctgtgtgtgtctttataagtgaagtgtgtttcttgtacacaatcgaccattgccattgattttttttcttttttatccatttagccactctatgtcttttgattggagagtttagaccatttacattcaatgttttattgttaagtaaggacatactcctgccattttgtttttttgttttctggttgttttgtggtgttgtcttcctttcttcctgtcttcctttttgtgaaggtgtttttctctgatggtatgttttaatttttgcttttcattttttgtgtatctgttgtaggttttttgatttgatgttatgcagcttgtaaataacaacttatagttcattattttaaagtgatgacaacttaacattgattgtataaactaacaagcaaagagaaagctaataaaagcttcatactttaacttcatcccccatacttttaatttttaatactttctatttatatcttatactgtctatgtcttaaaaagcttttataattattatttttgattggttcatcttttagtttttctactcaagatatgagaagtttacaccacaattacagagttataacactccatgtttgtctgtgtacttactagtgagttttgtaccttaagatgctttcttattggttattgatgtctttttctttcagattgaagaaatttctttagcatttcttataagagaaggcagtgggttcttttctggctcagggtgggtctagaaatgccatccaggagctaagtcctggaattgaggactttaggagtctgcttggtgcttcatgttactgtggctaagttggtacccaatttgtaagacaaagtccttttactcttccctctcctttcctccccatgcctccccatggctacaacagctgggaatgtgctgggtcacacctgaaaccagcatggtactgggtcccacccaagcctcgtggtgagtactgcctggctatcactgatgtttattcaaagcccaagggctctttagttagcaggtgatgattcttgccaggactgggtccttccatttaaggcaagaagttcccttatagcctagtgtatgtctagaaatatcatcagggagctagggcctgggttgggggattcagtactctacttggtgctttattttactgtggttgagctgttatccaagttgcaagacaaagtcctctttatgctcctgtctcctttcttaaggcagagggacggagtctctcaaagctgtgagctgtgctgcctggagttggaggagggttgatgcaaccactcctttgactactccagctggtgtctcactaggttatgtgcgctccaaggctactggttctgagctcagtacagcactaggacttgcctaggaattgtagtccttgtggcctaaatcagctgtccccaacgtttttggcaccagggactggttttgtggaagacaattttttaatggacagggtggagtatgctttctggataaaactgttccaccttagatcatcaggcattagttaaattctcataaggaacatgcaacctagattcctcagatgcacagttcacaacaggcttccattcctatgagaatctaatgctgcaactgatctgacaggaggcagagctcaggcagtaatgtcactcatctcctactgtgcagccagtttctaacaggccatggactggtactgccgtgcagcccaattcctaacaggccacagtccatggcatagggattgggaacccctggcctagactgcctttcaagtttatttagaaccccagagaactttatcccacattggtgatccttggtagaactcaggttctgactgctgggtaggacaattcctctctgacaagagctgttctaaatgtgccctctgtgggcactggctgaattctgtgccatgttgctttctgctgttacatggcaacactgacttccaatgtaaagtcccacaatcactgtactttccttcccccaagggcacaaattttctctccacaccatgtggtaacctggaggatgggggagagtggtattggcaattaaagactttctttcttacctccttcagtgcctctttccttgatatgattttaaaacaaggtactgtgattactcttctgatttttggttcttatgaaggttcattcttgttgtggatggttgttcagtttggtgatcctgcaggaagacaattgctggaaggttctatttggccatcttcctctgcttcctcctcatcttttatttcttcctcttgcctgattgctctggctaggacttccagtatgatgttgaatagaagtggtgaaggtgggcttccttgtcttgttacagttcttagaacaaaggctttcagcttttccccattccataggatgttagctgtaggtgctgacatatacgccatctatagcctttattatgttgaggtatattccttctgtataataaagtgcacatgtctgaattatatattacttgccttgtgggtgccaagaaactatttatactgcctagaatattaacctttattatgcctaaagagttcattagtcaaatgttggttttgatgtagacctcatagtttaaaatttaacatttaaattaaatgggttataatttttaataccacctaaatacaatatattgatccaatatagaaagttagatcaatgttagaaataaagagtcacagtgtacctttccagacttgtcgttagcatttcatatttatagttttagctttgatttgaatgtttcacagatgaacttaaatcaacacataattccaccatagcataatagtaattaggcagtttccctaaatttgagaacattgccttaatgtagttgtgatgttttgaggcttcatagcttaaatccattataccattatggaatctatagagcagggctatggagaaaggcttcagagaagttttttttgctactataaccttatttaaagaaacaaacagaaaaaaacccaaacgtatttgaagtctgcttaaatattactgttaaatgtgaagtgtttatatctaacattcataatcatatgaatgtcaacatttagtttcgagtagaaaaagataaatcattactgtgagttaagaaatttaaatggagatgtgtgagggagcatgtccatttcatccttcccatctccaccctccccagagtttcatccccagggtgcccttcttggtttccagcctctggtgttctgcttggggtcttgacttcttcccatgccactcaggctcagccccagactagaacagggtttgggaagcagtggggatagccaagatgggtgtcagtgggtggcccagcagtttctgtcccaggagtggccacaggccaggggtagtggtggctgtgcatgtggccagcctgctgccattgtcccatccttgtcagggccctctctttcaccttacagcatctgaggggcagagctctagagggtttgggcagacaatgcctctgaaaatttttttttaaataaaatttagatgacaagtatatatcatatatgcagtgaccaagcatataactactttacagtcatctaactgctgtagcaatgatatgtaactacagtgtcaaaacaccctgacagttttcagaaacccaatgtggagaccatctgccatatcttactttttctttaggtacaatattcaaattcatattgattttgcttacatatgaatagtttcaaatttgttcacatatggtttaaactttttgtccctattgtcttactcaggcttgtgtaacttaaaatgagcctgagcatgggtctacacacagcaagatgtgtaataaaaacacaattttagtgctactttcaaaattcatgctattaagaaagatgctgttttcaaagctgaaaagatcatgaaatggctaacttacatatcagaggttggataattccttactattgaggtgttatattttctgtgtagtaaatgccttcaaatattaactgaaagatcagtgaagtcattttcccctttgtgattccaacttcattttgtttattttgaagataattaatattttaattgcaaaagaaaattatagcattggaaaattttctgtatatggagaataacaatgaaccaaatttaccaattagggaaccatttcaggaattgttggatggtgaatttttcttcagtaactatgctttagttgcaatgcagtatgcccagaaacaatccatttcaacttctgaatgtttgatttggaacatttgtttgatgagtattcagttaaacacttggatacaaactctttccagaaggtcacatctctaccatttatcttggaatgtttctgaagacattctactcattttattaactgtatacacttctgtttttggatctccaatatgattatagacaatatcaacatagaaggctttgatttagactccaaagtttagagcatttgatcttgacatgccttaaattgggcttccagtcaaaattgaggccacttctcctttcaaatggcaagttcccttgaatgagtgaatagtggagttgtagaaattgaaaggcagtagtagctttcactttacattacaacttctccaatgcaatcttttccattctcatcaagtctgaaaccgtgaacctatattcacctatttggaacacatcagttgccaatgggacatccctttcctcttctattgattttacagccgaatagaagaagctcagttcaacacatccaaggtgcttgggctgcaccttcatttaacacaggaatctgtccagtaaattcacagagaaaatgcctttgtgttaaagccaaagaactgaattagactaacatcttgtacttcaaagtcctgtagccttgcagtcattctgaggctattgtctatcatgtgcaaactcaattagtctcaaaccacagatctttaactgacatctagacttcagttccaacaaggcattcagctggtgtagcagtttctgacagtcaggtttcagtacctctatcatcttgatagtgattgagcctcagtggtaaccacccttcttgggcctgcactcacctcaccccacgaaatccaatctcagaggcctaggaaacaaagcaaacagagaggcccagggaggggaagccttcctgggtggatgtctctgcagagccaccaagatcatattgccctcatcagggtcagcttggagctgaagggctgaaaaggcattttgatatttgattgcatattatttcatactgttatttcagagttttgtgtgcacacattgtttcttcagtaagcctaatgctttataagcatagcaaccacatctgacatttctatgtctctcacattgtatgcttggacagctctgcctggaatattcttcccccagttgcccacatgtccaatatagtgctttgtgttgtgtcaaaacctaatgcatatttgttgaatatttaacatgtgctgattttagattagtaaatatctttccgataattgatgatttttgttatacctaaagattgaacactttgaaagcagccttagaaaatgcatttcaattattctctttcacctcctccttctgtgcccagggcaaaactctgcatggattaaggactcagcaaatatcatggatgaagcaacaggcagatttcaggcaccataagcaaactgaatttttaaaccctaaattaggacatgtggtctaattttggagcattttatgtatacgccaaacagcctgagaaatgtagcttgaattgaaatatattagaatacatgaagactaatagagtcagtaggaaaatatgtttgtcatcagaactgtttcagaaatccaaaacaccaacctacttattccaccacttaaggtgatccaaaaagactgggggtaaacatgtttcaagtggttcaatgtgttgtaatttatatctatgcatttcagatatcaattgaagcaaaggtgggttaaactattgaacggttgttctttcttacaaacacattgaaataataattttctatatgtattattatatccttttccaatctttttcaaggatatgttttatagatgattgctatggctttccttatattcattatacaaatttgtttgtagatctagtagccaatatttgatgtcaccaaatttttattcatacaacagttatctcagccttctcagctattcttcaataaccatttatcatttcagagttgtgcaatagaggataaatatagcaatatgttaaatattattttcaaaattgtattttaattgctttactgggacaattattggtaactttgtaaaagaataaaaaaatcaggcattaacaaatgctccaggatttccatagtttcatactagctggtactgccctagccaatccttgttacctcttatttgaacaatggcaacagcttcctaatgaatcccctgcatttagtctctcactgttccagtacattctgcactccgtgttctatttatctttatgaagaaaattttgaccaggttgcttctgtcttcaaaggctttaatagtacctatttattactaaatttggaacaaatcttagcctcttgtgcaaagctcaatatccatccttccttccttccttcctccctgcctcccttctttctttcttttttttaaattttttaaattttttatttttttgagacagagtctcactctgtcacccaggctggagtgcaggggcgcaatctcagctcactgcaagctccacctcccgagttcacgccattctcctgcctcagcctcctgagtagctgggactgcaggcacctgccaccacgcctggctaattttttgtatttttagtggagatggggtttcaccgtgttagccaggatggtctcgatctcctgacctcaggtgttccactggcctcagtcttgcaaagtgctaggattacaggcgtgagccactgtgccctctcctctcctctcctcccctcccctcctctcccctcccctcccttctctctttcctttcttctcaaatctgagaatgtcttcatttctccctcccttttgaagggcagttctgatggatatagaattcttggttgtcagattttttttttctttcagtactttaaatatatcagctcaatgctttgtggtctccaaagttattgatgagaaatctgccgataatcttattggggatcccttgtatgtatgagtcacttctgtcttgctgctttcaagattctcattttgtctttggctttctacaatttgattatagtgtgtcttagtgtgagtctctttgaattcattctcttggagtttgttgagcttcttggatctttatattcatatctttcttcaagtttgggaagttttcagccattatttcttcaaataatctctcttctccttctgagactcccacagtgcatgtgttggacactcaatggtgttcctaaggctctgttcaattttctttaatattttttgttgttgttctgcagactcaataatttcaatggtcctgtcttccagttcactgtttcttttttctacatgcctgaattggtcttcgaatcctcctataaaatattcatttcagttattgtaattttcagctccagattctttttaggttttctatctttttattgatatttctactttgttttgttttttgattttctccacatcttcctttattttcttaagcttctgtaaaaccattgttttaaagtctgtgtttagtaggtctgtcatgtggtccttttcagggatgattttcgttggtttatttttcctttcttttgagtgagtcatactttcctgtttctttgtatgatttgtgatttttttggttgataactagacatttgaatcttatcacatggttactctgggaatcagattctctgggtttgctatgtttgtttgtttgtttgttttgttgttgtaggatgtttgtgttgaggatcagcttgagatgtaaatttaaggtcttcttagaccttttatgagtctgtacctttccctgggcatgtatggcgactttctaaatttccctgtatatttaattgcttattccttaaatgtctcactatccaaaggagaaaaagagaaaataaataaataaataagacactggttctttaaatctcctggaagccacttcagccagaaagagggcctgcaaaaatggtgtgtctgtatgtatacacaacaatagctgcttgcctttgcatttgtacctccatgatcagaagcaacaattagtgatcagaatgcagatctcgtatatttgaaagacaaggtcattattgtccaccctgctcccataagctgcctgcaagctgctttaggaacacagacatggcagcctgtcacagggacaggggatgaggaattggtaaccactattgagctaagagctaaaatggactgaaattaactgtaagttaccttccaagcattcttctggaagttgcaagcactagagctccaaaatagtaatattagacagattccaacagtgcaattgttatctaggtggggagaaaaattccctgctctgctatcttcccagcatccctctacctctaaatttttgttaactcattcaaaaaaatttttttttgagatggagtctcactcttgttgcctaggatggagtgcaatggcatgatctcagctcaccacaacctctgcctcccaagatcaagcaattctcccacctcagcctcttgagtagctgggattataggcgcacgccaccaggcccagctaattttgtatttttagtagagacggggtttcttcatgttggtctggctggtctcgaactcctgacctcagctgatccacccacctcggcctcccaaaatgttgggattacaggcatgagctaccacacctggccccccaaaatttgttttttgagacagggttttgctctgttgcccaggttggaatgcagtggaactcactgtagcctcaaaatcccaagttcaagcaatcatcccacctcagtctcccaaatatctgagactacaggcacacaccactatgcctggctattttttttttttttcattttttgtagagagacagtcttgctttgttgcccaggctggtctcaaactcctgggctcaagcaatccttcctccttggactcccaaagtgctggaattacaggcatgagcaaccacacccaccccaagatattttttaatgcctctcttctgttagacaaaattttagtaaacgggatatgtaagtcattgatctatgatatccacaggatgctgcagacattataagacaaacacgtaagtgaaaatatgactatagattacgataaatgctatgaagaaaaaatacgtggtctggaatcttatcctacagtaggttcctacaaccaattttactcaagcatgggcttcctctgaactcctttcttgtcttaatacttctcttctaattattgttatttagaatttacttttgcatatatcaaataataggtttaggcaactatcattcaggattttgttgagagttaagattgatttacaaagatttttttcctccaataaacatgtatcagatttggccagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataaggtaaaattaatttgcaaataatccaattagttaatgcctaatgaaataaagtgggcaaggagaaaaatatgttattgataatgataagcacactttagaaatcgagtaggggcaaagcatagaaagtaatgataaagcgtggaaagctcctataaagaggcttaaggggttccgtgtacatataagaacacaggagtgtgttttcaggagtgtgtagcagtcagaaagtgccgcatgcattatgttgcctaatgttgccttttggactttgtccttttaaaggcataccctggcaatgggtcaaggctagaatgaaaaactgcttaccacatagactctgtcttgaggagaatggaacaaacaaagttccttgccaaggaaaacagttaagtctacttggcaaacagaagtaatctattttatgtcttataagattccagtgggtctttatagataaagatacccatgtacatatttgtaatgtggagactgaactaaaggcccagtttagctagaatggcctctgattctctaaagcaaactcatttcccatgaaaacactgatcatagatgaaattggcactaagatgtgagcttgtactttttcccacactgtgatgtccagatcaacttcctaaaataatttttttctctttatcttctgtttattgcagcaaaaccttttcatgggtgaaaatcaattcaatgtacccaaggagcctgagattgtgactttcaataccacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggtaatgtgtgatcttaaagatatgcaggctgatgtaatcagaaaagaaaagaaaaaaaaaacatgtttttctagctaacgcatactccttaatacaatgttttccagctcttaatttttgaacatctagctgttaatatgctatagaatcaatctcagtctaaattgttttgtagatttatttggttttatttaacttgatttttttttcaaaatatatgacttcttacatacaactctcccttcttggcttcttggtttcatactttaattgatttcctctcacttctctgtctttatcagcatgttttactgaaattaataaaacatataacttagagagagtaaaatgtgaatatgaggttaaaatagtaataacaattatgaaatccctttttactttccaatttcaaatgatgttttcaacttattacttccaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacaggtaatattttgatgtcagaagagttactggataaaataaagacactcagttaaatatacagtttagataaataatgaatgattttttagtataagcatatcacacttttggggatttatgtatgctaaaaattttgttgtttatttgaaattcaactttagctgggaagcctacaaatacaggctaaatttatttgctaaatcttttttttttttttttgagacagagtctcactctgtagcccaagctggagtgcagtggtgcatcagctcactgcaagctctgcctcctcggccaagcaattctcacgcctcagcctcccaagtagctgggactacaggcgagtgccaccacgcctggctaatttttttgttgttgttgtattttagtagagacagagtttcaccatattggccagggtggtctcaaactccccgagctcaggtgatccgcccacctcagcctcccaaagtgttgagattataggcatgagccaccgtgccctgcctatttgctaaaccttgaaaccttagatgtcagttcaattttaagctgattgggaaaaggcaggacatttacttgcagtagcagtattaaaaataaatattcaaattacagatcattataacaggagttcattgaaaacccattttatttcctgcctgaacaaattaagccattttccttatatgttcacaaatgcctatcttgctttataaagagtttgacactaagtatatcctggatatgaatggggttgaccaccaagatagttcaatggaatggtttattgctgcaaagatccaatctctcattgctcgcaagtggcctccatggtcctctcattcttctcttctcttccttggtctggcccccatcttatctcacttaacagggcttcctattgacagtctgacaatctcagctccatccagtcagttctccatattgtagttacagaaatcacaaaaagctgtttttgattataatactgtctggcttaaaattcttcactgacttctaattgacaaatcaaatttcttaacatgaaagacacacaaagtctagatgtgtggtcccttcctattctctatcctctaatctcacttctacttacaaatatcctgggcttctgcaatattgaaatattttcccatctcctatttgctagcatatgcagaacctcaaggtgtttgcacagattgtttggtcctttatccgtggcgagccccacctactaatctttcatagcacttttctggtgttatcgtcaccaagaggggttcctggatatttcccacagagctactcctacctctccagatgagttaagtacatcctttatgtgctcccaggacaccctatgcttagctttatcaaagacatattatgtcatagtattcacttacttatttgagactgagaaccccttgagtgctgaaattatgccaactgcacagtattttgtttgctctatgataactaccctaacaatactttttcgttttagcaaatgaaggcctactatatgccaggtatttatttagtgttaatgatatgaagataaataagcatagatcctcctcttgaagaattcagtctttagtaatggagaaagacatttgaacagataatttcagcataggttggcatgtgattgtccgtagaatgcacattttgctggaggagtactaaagagctctacttagattaatttgggaatgcagggaagtttctggagctgatgctattatccaggtgaaaaagagtaggaggggattctttgtggtgtgaagagcatgaacaagggtgtggatgcaggcaggagcagggtctgcagggaacagcaacaggtcagtgctactaaggcaactgaggcatggcttgcgaagctgggtttggtgggaaataagcctggaagcaacatcctgtcctgcaggatcttacctagcacacttaagattcagcctttattctgtgggtgatggtcagctggtggaagtggtccagtgaaggaatgatgtggtcagatctacctttgaatatatcatttttactactctgtagatgatggagcaaagacccaaaagactagattattaaaatagtcttattaagggtctggaccaagactgtgtttgttggaataaaagcagggcatggagtctagacatatttagaaaatggaactcagtggccaatttgatgtggaacaggaaaacggaatggagagtccagaatgtggcagatttctggcaagaatggctgggtgggtgagatgcatctgacagatcaggaggcaagagaggagcagactcactgacagtgggtagaggctgagttcagttatagatgtgctggttttgaagtagttatgagacattcagctggacccagccagttgtctgttgaatactttggtctgatgcttaagggagatactagaattagaaatattgtttcaaaaatcagcaagatacaaggggcaattaagcaaacaacagtgaatgatacgacaaaggagactgtactgacagtaaagaactattgacaaagtagaacctttgggagcttcggtatttggggcaggaaaggacagaggacaagaaacctgcaaatacaattaagaaataaaggaaaatttaaaaagagaacatctggtagatgccaaggaagtagagactcttggaggaaagaaatcatgaggtgtattaacacaatacgttgaccattattagcatttttgagtataattttggcagaattttctgagctcataatgataggatgatgggcagattatattgggttgaaaagtcaaagggaagtgaatgcatttttttccccaagaaatcttatctgagacaagaagaagagaagcaagacaatggtttaacagagactcatggtcaggagaaatgtgtgtgtatgtgtgtatgtgtgtgtgtgtgtttctcaacaaacgagagagccttgattgcctttgtaggtctaagagaaagagctacaaaaggaaaaaatacataaaatatgagaggaatcaggtccagtgcagtggcctgtaatcccagcactttgggaggtcaaggcgggcagatcatctgagatcaggagtttgtgacccctgtccaacatggtgaaacctgtctctactaaaaatacaaaaattagccaggcatggtggcaggcgcctgcaatcccagctacttggaaggctgagacaggagaattgcttgatcctgggagatagaggttgcagtgagctgaaattgtgccactgcactccagcctaggcaacagagtgagactctgtctcaaaataaaataaaatatacaaggaatcattactcctactcagtgttccaaggtgctggaggaaagagggaaaaatagtatcatgaacacaggtacaaaatgtccaacaactggaaattaaatgaatcatattgtagaagaacatttattgccataaaattattaccatataccatatgttatattaacatatatagccttatatatgtgacattcatatggtattatattgctatataaatttttaaaattaaaatataaattgtgatgtattatttttaagttaaaaaaagttggtcacaaaacaagagagtaatctcttagctcttcttccctccttttccttcctgcctcctcaatcttttcctacctttttacctcctccagagtcttggctctacctaaagagagttgtgggaagttctttcttagtgttgtgaggtaggttagctttgtcaagtaaaaccaagctttctgtttatcttgctagacggtgatatttcatctaaacgattggtaccagatatgttttggaatcttcctatttaaagataataatacatattacttgatattaccagcagagtctgggaaaatacccagaatcaaacatattaatatatctattggaaaacatgggattattcaccttaaatagcttgaataaaaatgttatagccttatgttaattcaagttaggtcttaatgccaatgtgccagtgggttacaaaaatcctttattttcagaagattttggatttttgtattgaagataaggaattttggtataatattatatttataatttttcatagtctaactgtgatgatatattatgcttgaaaaatctcgattatcaccaaaagctacctccaaaccaagggaagagacacaaagagaggtaaaagtgaaataaacccctatcttgccacacagattttccaagcattttatagcaaatatgcataattttgtttatatcagtatgtcattgcaaacatcactcagagttttgcttttatagtttttctttgtttttgctaaagttattaattgccttatttttttaaatttcattaattttctttgactttttgttaaaaccccatatcttccaacagcatctcagaataatttttccacaatatcattttcataagtttatcttgagctaaaaataataacctttctctgcactggtttccctctagtcattctgcacagttgtcatattgagatttcctttactgtcatcctaggaatgctctcttagctatttccttgttttaggttctctgtttttctccttctacctttatttgctcctttgttctgttgtagtcaacgctgtctagtcacattgctctaatctgaactggctgctctccatgccttgtatacgataggagtcatcctggaatctccctttatcctcatggtgaagatttttctttaccacttccctgtgtggatttcctgttttctgttccccgtcttccttgttttgggcttgtgccctctttcttgttgttaacagtttccggaaagagagtgatcgggatgcaagatttttgagactcactggtctgaaactgcctttcctcttaaatttagttaagtatttccctgggcatggaattcaaaggtggttatgacttttcttcaggattgtgaatgtatttatatcctcccatcttacgttgctattgagaattctgaagttcttctgattcctgattctttgtatgtgtattcctcattccacaccttccccagaatgcatgcagaatttcttcctttctattttcttttctctttttctgaaactcttattattgggatcttctgcctcttggtttagggctctaattttccgacattttctctgctattttttactactttatttttctcctctactttctgagagatttcctcctcttgatcttccaaatcttgtactgaatcttttatttttgttaacatgttcttaatttccaagaactcttttttcttgtcttcggagtttcaacacttattgttgttttgtgcatgtattattttttcttctctctctgaggctatttaggaaattttttattgaagctcctcccccctgcttccttcaagttgcttttatctgcttttttatttgctttttcatgcaataagtttttctcacatgtctggtaactcttggggattaccaaaaactcatagaaaattctgaccatgtgagtaacacttgccaattttgagcttcatgatagaatgatctagctggaccttttgctgcggggaaatcggaggtaagtgtctttggagacttcctcttgggatggtcaggtctcccaggtttcaagattcttctaatttccttcttgaatcagttgcctaatttaggaaataaaaatacaggatctccaggtaaatttgaagttcagataaactttgttttttttgagagagtctctttctgttgccaaggctggagtgcagtggcatgatttccgctcactgcaacctctgcctcccgggttcaagcaattctcctgcctcagcctcccgagtagctgggattacaggttcatgccaccactcccagctaattttttatatttttggtacagatggggtttccccatgttggccaggctggtctcgaactcctgacctcaagtgatccgcctgcctcggcctcccaaagtgctgggattacaggtgggagccactgctcccagcccagataaacattttttttaaaaagtgtaagtatgtcccattcaatatttaagacatacttatactaaaaaattatttgttgtgtatctgaacttcacatttaactgggagtcttgtcctgtgttttacctggcaaccctattcctgaaagataaatccttgctgacagcattagggatccaagtgaggaaaatggccttgcaaggtgtgggtgggggtggagggggaacgttttcaacattcagtgttatttattcaggtaatccccttcaactatgtctcttaaactttcatctaaagaccatccactttaccctctctggaaacattctccgttatttactggagtaggggaggatcagttatctggttttttggaggacttagtatccaaggcatccttcacaactttctgctcatttattttcctttgactgccacaactttactcctagctctaggtatagagcagtcccagtgattaatttgagtgctttgcagtgtagatagggattcttggctctttctactgctagtttaggacctggttttcttgggtctgctgaatcaattactactttttgtatcaacatcctagtttttaaaactgtgttgtggtctatcctcctattttcctacctttgtgggttaaaaaaaatagtgttcttttgaaggattgtaggaaataaaattgaagcatatgttcattctacctttacctgaaagttacttctatcccatcttaatacacttgcactgaagtgattactttccacctgcaaagtggaaacaataagaccagttagcggctgctgctttagtcaagcaagagatgaaggtgacttggaatatgctgtacagatggcattaaatgaatatggatctccttttggaaacttttcatctgcatggtgagatgactcacatacttagattttatattcaaatagctacgtactatagtggaagaaaaacttaatggagaagtgtttcagttcttgcgcagtatagaggatatgacttttccagattacaggggttgcctctaggtcaactctagggctcattacaactctgaagctcttttattgtgtgaaacaggcaataagatatgatttacacaggtgcctaaattaaacctttaaacacattttaaattcttgataattaaaatcattagtaacttgagaacaatgaagatatagctgttcatggctataggccaaggatctgattgcttttacagggctaatctttttgacagtgaattgcaggaggcactggggcttaaagccctttatttttattattagttgtattaattattcagtgataaactggatgactctaatgaagaagtaacattattttaccaaataaagtggcataggcatttttctagatcaagagagtatttcagttgactttctcatgttttttttttaagagcatctagcagtttatttaattattttattctattttttatctttaaaatttatcctagctttattgtcattaacaaatgaaaattgtatatctttacagtgtatgatgtgacgttttgatatgtgtacacaccgtgaaatgattaaatcaagcaaattcacatatcccacatgactttcttatgacttactggttttcatgacttccctagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtaagaatcttcgaatattgccaattagtttcatgtaagaggaagcactttttgatataaaaatctgctcaagtgcttacaaatatcataaaatttccatttagaaaggttaagattatccttggggatcatgaaggacattgagcaggctgcatttcttgtctggaaattcttaacataataattactgtgtccttcagaataaaaaaatatatatcttattttggggattatagggagtttaaagtcttccaagtagaaagaagattcaacgagagtagtttcagaaccagtgccattggagccccttaggaccactggggagtgatggcctagggaagttgaaaggagtccctctcgtcgagtgagtcaaggctctgtgtgatggtagaaggaaaagagacaaggaaaagctgaagaagagagaatttgacagtggcggatgttagcaaaaaagcaaaaactttttaaagttcagaaataatcccttgcttcacatgtgctctgcccagccacattctttcgctgacttcctgcaagttctcctcccactccccgttcctggtagaaaccactgctggggtgtgggaggacaatggaatggtgaggaggttgtggtgagcaagagacaggagatgacagatgctcagttcaaatccctgttagtcaattgcttcgggccattgtggggagtctttatcttgtctgagaggactaggtttctcttctgtatactgccaaatccactggtttgtgtttattaactcttacggcgcttccacaggtaagtaaattagaagacattgattacgggcatctcactaataaatgaatcagtgccagtttcatagctccaatttttcttgtacttggcaacatttcaaatttttctgatagaatggaatttggccagtatttttgtttcttcattctgttatagtaaattttaaaagtgatttatgggattgtaaaacttgaaggtagcctttgcctacttttttgttttaatcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctctttttgttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttagagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaacatcctaagtgtttcttttttgctcaacgttgtcaactatagtaggtctcccttgtggtgtaatgaattgcccccaaactattatcttaaaacaacaaacatttattatcttatagcatttctgagggtcaggatctgggactggcttagtggagttgttctggatcagggcctttggaaagttgtagttaacttgtccccagggctgccatcatctcaaggctcgggtggggctggagaaaatctgcttctcagctcactcacggcggttgccaggcctccattctttaggatgctagaaaaactttcataaaatgtcatctggcttctcctagagcaatgatactgagagagaaagcacatgagagaaagagcgagggaacttggatgtaagccacagtctttgaaaacctaatcacagaagtgacatctcttcttccacatgatgttggtcacatggaccaacaatggcacaacgtggacagaatcaaacagagttgagaatatcaggaggtggggcttcatgggggccattttggatgctatcatagtgaatatatgtatttatatttatatctgtatatattgcaatgtaatttaaaaaataggattgttttccttttctttttgctatatgtgatatgtatttcaaaatacactcccaatagttacgtctgaaaagcactacactaaaaaactttctatacattgaataattaaattaaataatctaataatctctacttttggtccatagtaaatttaagttaactgtttgccttaactacagtttgtggcaaaaccatctccttttaatatacacaagggacttttttttttttttttgagacggagttttgctcttgttgcccaggctggaatgcgatggtgtgatctcagctcactgcaacctctgtctcctgggtttaagcgattctcctgccagagcctcctgtgtagctgggattacaggctgggattacaggcatgcgccaccatgcctgcctaattttgtatttttagtagagatggggtttctccatgttggtcaggttggtctcgaaacccgagctcaggtgatccacccgtctaggcctcccaaagtgctgggattacaggcgtgagccaccatgcccggcccgtgggacttttgcattcatttttcagaagcttactttgtaggggaacatacattaaaaggtaacaaaataaacagcataagttccagaattattaattcatgaagtgcaaccactaggaaaaggggtcttaaaaacatcaccctctttactggattctttgaagaaaccaagatttttttcctaataatctgttttatacacaatatataccaaaaatatataaatatataagtatataacaaaagtgaaagaaactgactcttaatcacaatgttctgaatagcaagaggaatactaaaaaagtcaactagaaagtcatgtcaacgtcaaaatctgttctgaaacacatcactttgattttatactgaaagccgatacctcgaatttcctctgcttcgctgtcctgtggttgtactgggcatgttccaaatgtatcacttttatttttatttcaataatttcaagtgttattttagattcaggaggcccatgtgcaggtttgttacatgggtatattcagtaatgctgaggtttggggtacaaatgatcctgtcacccaggtgataagcataatacccaaaaggtagttttcagccctttccccctccctgtttcccagctgtagtagccgctagtgtctgttgttaccatctttatatctatgtgtaccaaatgtttagcttccatttaaaagtgagaatatgcagtatttggttttctgttcctgccttaacttgcttaggataatggcctccagctgcatccatgttgctgcaaaagacatgattttgttcttttttatggctctgtggtattctatggtgtatatgtaccatatgttctttatctaacccatcact

SEQ ID NO: 12405 - DNA, 8678 bp, Human
agccggtacattttggaggaggaggggtttggccagtggtggcaggagggaggttgtggaagccagggttcttgttacatatgtgaagcctgtaatatgcttcagaaagaatagatggcatatgtacctcaaaaggtaaatgaccttaaacggtgtcagactcttagttaaatctctcccggatcagagaaagacctggaaagggaaggagattgtccacagaacacaaatttccctcgcaaaagatagctttgcacaggaccattccaaaatatgtcagaaatatattttggggtaaaatactttgatcgcccttagggctgctacctgtcatgtgatgctataccagaatcaggttggaatttgttttgagacaggttctcactttgttgctcagattggagtacagtggctgtgatcacggctcactgcagcctcgatctcccttgatgtgggaggctcaagtgatcctcccacatcagcctcccaaatagctgggactacaggcggccaccaccacactgggctaaatttttttaaagtagagacaagttctccccatgttgcccaggctggtctctaactcctggcctcaacctccttattctctaggattacaggcgccaggctagacctcacaggtctttagacttctacgcaccaggtacctggtagggggagggattatagtggcagaagagcagtaccagtggcccacaccacacaccctggcctcagctggctggggcacacaaaaccaggtgctaccgtcaacgactaggcccatagggtactgctgtcaaaacctgctgccaacaacttccacacactccccaaaacgctcggtaggcggtggtgcgcagctttcaatgcatccgccgccaggcgctcacaggcaagggagaaagaagccagacggagctcggagatgtggagggcagacgcaggcgcatttggaaaagggactggcggtgggaggcgcagagggaaaaaggaacgacacaatcgggcttcctagccgctggcggacccgatggggcgtcctgcgagggttcggcgagggttctgccaggatagtagcattgcgcccaaggagtgagaggcacccggggctactggagccagaccctcaacccgccctagtgggaggcgaagaacaacgaaagcctcgtattcccatttctctaatggctaatgacattaaaggttttcatatggttatttgccatctgcatatcttcagtgaaatgtctgtttatgtcttctgactattttctaattggatttttaaaaataattgatttttgagttatttacatattctagatactggttgtatgccagatatatggcttgtaaatattttctcctaggtaaaccttttcagtatcgttacagggtctttcacaaagcaaaagttttaaatttatggagtctaattcatcaacatttctttttaccggtcttgccactaatgtcaatttaagaaccttttgcctagccttagacaatagtttgttgttttttaaaaccgttttgtaattttactcgtcacagttatatctagccacttaatttttatgtaagggttatttttggcgggggggaatctatagatgtcctgtcttttcagtatcatttgtggaaaagattatctgtcctgcattaaactgcttttggactttcgtctaaaatcagttggaccggtttttgttggcaaagttttgcctgaagcttattccaacaggtgagaaaaagtccacagtttaacagttcctccccaacctgtaaccccgccttgaacttctggactagcccctcgattgttgtagatgccaagcggacctcgcgccgctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggtaagtctttctttcgcttttttaggggtacttgaaaacaacaagtgtcagacaaagcagcagatgctgttgcgcagtagaagtttatgggcgagttgtccctgaaactggaaccaggtctttcttggcgcgattacgcaagaaccacccgcagccctgcgggctcctggcaggtcctgcaactgcactttggatagtcccgttgggaagctagcactttttaatatagaagaacgaggtttgataagtgtgcgagcttaaaggttgacacagtgtccactattacagctgcgtaggtagctagtgttcaggaagtaatagtggagtcatgtagtgtgaaagtaagattgaaatgggcgaggagggtagcagccgccacagccaccagagagaaacctgaccttgcaggtgcgtggtgatgtccatgagccaggctggtgccgcaacagcagcggcgggaccttgagctccgcacggccgctgggtttggacgccctctggttcctggaaactttcacctccccctcagcctgaggccaggtggcctgggaaggtggaaggagtgtggaggggagtggggggggggggggtccactgcctgagaatgagaattctcttcacatctggaaacttcagttatcacgtgtgtcctttaccaattttttttcttttattttctttttgatagagacggcggtctccctatgttacccaggctagtcttgaactcctgtgcttaagcgatcctcccaccttgacttcccaaagtgctggaattacaggcatgagccaatgcgcccggctgctttaccaattttctatgaatgaatttgtacatacatcccctagagcaggaagtaatgtaaaacagaataattagtaatgcacatttcctaatgtgggatgttggtggccaagagatatttggtctttactggaactcttgatactaacatggagtttataatagttgtggagagtgcagacaaggctaggatttctgtgactagagaactcttagtgcgtgaagacctaaggaaagctggattgttgatttttgttaataaataagatgtgaaagattgcatcactgtagcagaaatctcctagttttttaagctaaattctattaaaggtcatcattgctaaaggaattgtgcccaggatttggatagctgatgtcattatttaatattagatgatatcaactaaccacatctcatagactggaataaagtgctagattttacctgaaagctgcaaaaatgaatggtttagatatatgtatgtatttattttatatcaatttcaaatatttactgtattaacctccctggccccctttaatcaagaatataaaatcatctacttaaattttgccacttaagtttagaacactcttagaatcacactatcttaaagaagccagactagaattagaagcaagttaagtctgaagatataacaaccagcaacaacatttttttttttcaaatgaaaactctaatatggggtgggtatgttgtgtcacacctgtaatcccaacactttgggaggctgatgcaggaggatcacttgaacacaggagttcaagaccagcctggacaacatagcaaaaccctgtccctacaaaaaataagaaaattagctgggcatggtgtcacatgcctgtagtcccagctactcgggaggctgaggtgagaggattgattgatcccaggaggttgaggctgcagtgagtcatgatcgcatgactgcactccaacctgagggacagagcaagaccctgactcaaaaaaaaaaaacaaaaaaaaaaaaaccaccaccaaaactctaatatggacatattactctctcatgggacttgcacattctaaaaagggtccttttccccagtactgggagagtatgtgttcaactacgcagccagcaagacaggctagtttatatagggagtgtgctattcacaaaaagcctctcttctctttctggtattgtacatgacacaatcatagctgtacctgaagagaagtgcattttaaggaccatcatcacctagaaacatgtataaatttctatacctagtgccacaggaatgacattgccttgtactattcctacctctgtccagaggccagctatgtggtctgtctgcatggtgcctagaactttttccatctgacctaggatgcttctgaagcagtccccctgggcagctgtctggtatttaggatatacctgtgagaaaagtttcttacaaacctaatctactatgtttattcctgaactcaaaaagttcattgactgttcaaatcctgaaattttctctatttccataaggctgaattaaaagtactttgttaaaggtagtagccatggcaaaagaaaaaccactgttctgtagaaaaactcattcaatatttacaatcttttctaatcagagattagatcctgaagagaaaggttcatatatatatatatatatatatatatatatatatatatatatatttttttttttttttttttttttttttttactccactgtcattgtgactaaggattcatgaactaagacccctccctcagctcttggtggcacatggtgacagcatgctcagagcaaaggtgctccccatgcctcttctggggctgcactgactgcaggtacctcccctctctacatcccacaccactgataccaaaaaccccctcctttctcctgtactgatgactctgtagctttaaccagggcgacggtgtcactctaaatgtcaccttggcattcagccccatagagtggggaaaattccctcacctgtttctctttgactgttcagtcctcttcaattaaaatcttaattttacaagcgaggaaatgagagtgtttcttgtaggggtgtagtgagaatttaataaaacagtttaaggaaagaaaacaaaaggtagtattgctgcactttctagatggtaaaaagcaaaccaccatgtctgtttaatatatatcacctgctggtccctcggtctagcaggctgaactgtgtgcctgggaattttcttctcgctgtgtgcacccctttacgtcacagggtggactctcttcagagtcctagtggagcagctggccaggctgacatgatctgacaacattgtaggttaccactaccatctctcaccgtctcactttcttcctaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaatcagctgtaagaatttgtctcaccagaaaacaaaacattgcccattgtattaaaatttaaaccatatctgttaaaagtttccaataagaacttcacacatggatgtccttgccatgttgaaattatccaatatgggaggggggtgttttagggaggtctctgcaatacagagctgttttgtgtctttcctgaactgacatcccgaagaactccaggcatctttgaggaagatggtcacagtgttgctgtctcagaggaagcgggtgaaaagcaagcctctgccttctgcctcttcctatattctgaaatactggatataggcaatagggagcagaatgaaagacaaggggaggaatgatatttgagagactcccccataagggagtttttaaagagattatatttgaacataattttttgagcgagggaataaagtatacatatccttgcttttgagagttttttttttttttttaaattgggagaggttcaggggaggctcttaatctagtgatttttttccccacaaaatattattgaacaaatatctattgaacaatgtatgtgtttctagacgagaagcacattgttgagaaggaatcgtaaacatgattttttttttttttttttgagacggagtctctttcgcccaggctggactgcagtggcgctgtctcggctcactacaagctccgcctcccgggttcacgccattctcctgcctcagcctccgagtagctgggactacaggcgcccgccaccactcccggctaattttttctatttttagtagagacgggatttcaccgtgttagccaggatggtctcgatctcctgacctcgtgatccgcctgcctcggcctcccaaagtgctgggattacaggcatgagccactgcgcccggccgtaaacatgatttcatggtactatagacattttcaagcttagaagatctattcagtggctcgtttttaaataattattttaaaatttccctattcattttcatagcaattattctcaaccacttggaaaatacccaaatggttctaccatatagcttcttatgaattctgttcctaaaaaccaattctttgctgaagtacctaatgtagtaaatctacttctaaaagaaactactctaccttggttattctccagggtaattctccttcaaaatgtattgcatttattgttgctcctaataggtgagcaaacggattattaaattcaagtggcaaatactaaccttgagaaaaggaagaacatgtttttaatgttacaagtaatagtttaaaaaagaatttttgttcctggggtaacacctttatataagtaggtagttgagaatgattttattttccattaaaacttgtgctaaatgacaggattttacccctctacttctatctttgcccaaataggaaaaatataatcagaataattacatttttaaagacaatctaattacaacgtttttccctcccaataaccaactaaacacatcaaaggtctcttatgtttcagttcaaatcaaataacatgcattaactttacagttctctgacttctaaatacctttgctcttgctacttctgagccctaaacacttatcaacaggttggatttcagccagggaatcagaatatttttggatcatccaatatcagctcgccacctagacatacttagatatactataatttctttcttcccaggatgcttaagaaacagtttcattttcatgaccagcaaggggttcaggaagcatcctaccacagggtccctggaaatgaaacctgaatcttctcatggctgaggtggtctccatgttaaattcggtcactggcactcccttggcagacatctggtgggcaaacacagctgcggggtacaccacagggggagtatgtgccactagacatagtcacaagggtgagctgtctgtcaacctcctccagaaaggcgggatccaagtttttgccaaaccacagggcg

SEQ ID NO: 12406 - DNA, 25281 bp, Human
aggtgagctccaccttgggatccagagcaggcgtcgggggaacttaggggagggggcgcggggatgggtttgtaagagggcatggggtggctcaccttagaagaagggaaatgagaagatgtgggcggtcccgtagcccagattcctgaaagctcctaaaggtccctggagtagggtacgccctcctacgaggcccagggtccgcggggagggaggaggctgggcttgtgggcggggcccgcggagccgccccgcctctacctccgccttcccgccgcggtcccgggctctcccctcgcctggctcccctcccttctgcactcgtgcgggagggcggagctgggcccgctccattgtggagaggaggggagaggcgcgcgggagccgcgcggaggcccggccaccagcgccctagcctcttggccgccgcggctgcacctggcgagccccgcagccgggatgcggcgggcgcccggggctggcgggcagcgcagcggctccggggacatgtgcgctggcccagaccgcccgcgaccatgagcctgaccgcccgcgtctcctgctccatgcttagctgcttcgtaagtgcccaccctgcctttgggggcctaggaggcacccgcagccccgcccagggtcagccctcgatttcagcccatcccccttcccgaggcccctggcccggccccgaacgtttggggggcagggaaggtgggttaacccttttatttcttggacttgcttcaatctttgggtgccggagatggtcgaaggccaggaatggaaattctgtggtccatcctggccccgcagccactgcccttgactgcagatctctaggccccgccctgcaggggtacatccctttacctccgcctctccctcttggtcccacccgctgaatccttgcttggggatgtgggatgtggctagtaggctgaatgggatgttaggaggttggtcggggagcacgggatgtctttgagctggcttggggctccagtcccttccctcttccaccattccatccctcacctggcatgccagccttttctccttgactgtcccccagacagcctctcttctccatcttccctgcctctgcagggttccgtacctctgcatcattcccggtcctcccctcctcccgctctggctgatgctccttcccagcttcccccatctgtcctctcagctgtccccccaccttccccgtgggtgtctgccgggcctcctctctctctctcccctggctgtccttgggtctcctggctcctcccaggcgcgtggatccccccgggtcccctccctggtggttgggaggggagttccttttgcttgctgtgggtattcctcaggaattcccctctgattagcaggcagagcaggttacttggcaggtaatgggggcttgtcagcaatgtgggtctaacaagaagataagcccagctctcaaacacgtcttccttttgaaagcgtcggtgaaggccctctagaggcgtgggactgaatccccccacccactcctctttgtctccttcacccaccagattgaagcttcagtggcttgtaggcgcctgatttcccttctctctgaaaccagctgccatacctggctccttttcctcaggacagcactttcccatccccactcctgccttacccttatgcgggtctaagggaaagagtctttcttttccttagttttctctcctccatttttgaaatgttggttctataggagagtccctctttgaagagtgcagattcccaattcctcctggggcctcactctttccttaggcttaataggctgatatgctctccatttcacccttccctgtctccaaccaagtcagatctcttttcccttctctggtgaccagaacctttagaggtgtgtgtgtgtgggtatctgtggatttcttggtggggagaggagcagaatgagcctgatgggctaagtggagcttggtgacttaggactgtggccttcctacagggtgaggaggggccccccagcctggagtacatccaagccaaggatctgttcccccccaaggaactagtgaaggaggaagagaatcttcaggtaaggaggagttgggggccaggatagatggggctccctgcccagttaaaaaacaccctcccttctcccaaaaatcctcaagggcatctggtaccagagctctggcttcatgttccctggtctctggaggaggagggtttgtctgcgcatcctggagcctttggccgcagggaaggaaaggcagctttcctgtacagctgttgcctggtgctgttaccgtggagagaactctcctctcttgccttggcccaccttttccagaggggatcccacagatcaggggctgtagaagaggataaggtggtcactcacttctggactgaaggtttctctgccccttgacaggtccccttcacagtgctgcagggtgagggagtagagttcctgggccgggcagccgatgccctcattgccatctctaactaccggctgcatatcaaattcaaggactctgtcatcaacgtgagtttctgtattgttctcctacccctaagctagaatccctatgaagttcaaggtgggattgttccaaggctgtccttgatcatgtcattaaaaaagttggaggccgggcgcagtggctcacgcctgtaatcccagcactttgggaggccgaggcgggtggatcacttgaggtcaggagttcgagaccagcctggccaacatggtgaaactgtgtctctactaacaatacaaaaattagtcgggcttggtggtgcgcacctgtaatcccacctactcgggggctgaggtacgggaatcacttgaacctgggaggtggaggttgcagtgagccgagattgtgccactgctgtccagcttgggtgacagagtgagactacctctcaaaaaaataaaaaaaaaaaagttggggatcccttctgtttctctctgacctcatgttttcctgcctcattttcctagctctgtttctggctcattctcctttctcctcttctctctttccattattctattactggcccttctaaggagcacagtggcattgttggaagaacacaggctttggagtcaggcaaacctgggctcttttcctgcgttgccactcaccagctgggtgaccttggtcaagtcacctaactgaggcttgatttttctcctcgtaatatgggctgaaagcacctgctgtgcaacgttattgggatcattaattgggatcacatatgcagaggactccgtacagttaccaggtgcttaacagaccctcagtaaatgttggtttccttcctgctattgatacattagtgcctacgctagggtgagggtgaggagtggtacccagtggggagtctgagcttcagtttgcccttcctctacaggtccccctccggatgattgacagtgtggagagccgtgatatgttccagttgcacatttcctgcaaggactccaaagtggtgaggtgagaacaacggagcctcactcaggtcccctggccctagtcttgtccagttctctgtgctgcagggtttctctggtgcaagagaggaaagatcctgcctcactttccccagttggaagaaaaggtgaagaccatgttctgggttgggaggtcagtttactgacccataggatcttgacctgaaaaaatgggggtaatgcctagttcatggagtcatcgtaaggattaagtgagataatgtgtatgtgtatgaaagcaccgaggacaatatctggcacagagcactcatattattgttggtttatttatttattcatttgatatacatgtattgagtaccctactcaatgccagcctgttttaagccctggggatacagcagggaacaaatagacaaaattttgccgcctcagagagcttacattccaatgaggagataccaaccgtaagtaataagtaaaatttgtgaaatgatagtaagtgtaaaggaaaaaaataaagcagggaaagggaataaggagtgctatgagggtgaagattgtaaaacaatcaggctgggcacggtggttcacgcctgtaataccagcacttcgggtggccaaggtgggaagatcccttcagcttaggagttcaagatcagcctgggcaacatagcgagaccccatctctactaaaaatagaaaaaattagccaggtgtggtgatgcgtggggagatcacttcagcttaggagttcaagatcagcttgggcaacaggacgagaccccatctctactaaaaatataaaaaattagccaggcgtggtgatgcatgcctgtagtcccagctactcaagaggctgagataggaggacctcttgagcctgagaagtcgaggctgcagtgagctgtgattacaccactgcactccagcctggatgacagagtgagaccctgtctcaaaaaaacaaaagtgatcagagaagctgcaccgaaaaggtggcagtcgagtcaagacttgaagaaagtggccatgtggctatttggtggaagagtgtgccagagacagagaacggcaagtgcaaaggccttgaggtgggtgtgtgcctgcatattgggagactggcagggaggctggtgttgttggagtagagcacgtgtgggtgagggtagtgggttatatgacctgagaacaaagccgggtgtcagacactttggctgtcatgaagactggcttttactttgagggaactgagaaaccactggaggattttgagcaaaggagtgatgtgatctgattaatgtttcatagaatcacactggctgctatattgagactagatgaaagagaatgggggcaagagcaaaagcaaaaactgggagactagttaggaagctattgcagttacccagatgagagatcatggtggcctgtctgaggtggtagcagccaaagcggtgagaagcattcagattctgggtgtattttgaaggtggagatgagaagatttgctgacagatttgaagtgaaagaaagaggaatctggatgactccaaggtttattaaaaggatacctactttagagcctaccatgtgctcaggtctgtggggcattcagaaggagcattcacattgcccttcccttcaaggaggctaaactctagctgctggaagaagatttaacatgtggcaatatgctatgggaaaatgtgttgcttagtactccaagtaggccaggcacagtggcacatacctgtaatcctagtactttgggaggccgagggaggaggatcgcttgagcccaggagttcaagatcagcctggacaacatagagagaccctgtctctatgaagaatttaaaaagttagccagacgtggtggtgcacaattatggtctcagctactcaggggactgatttgtgaggattgcctgagcccaggaggtcgaggctgcagggagctgtgatcgtgccactacactccagcctgggtgacagagcaagagcaagaccctctctcaaaaaaaaaaaaaaaaggtatatatatatattccaagcacattaagaatcaagagaggaaggagtttctggaatagagtaggctgggaaggcttcaaggaagaggtgagactgaaactatcttcaaagcatcagtaggatgtggctaggcagagaggagacattatcaagcagaagataaaccaaggagatgggaaggatgtgagcagaacttcccgcctgaagcagaaggtttgagttagggagtcatgggagataacactggtccattagggtagggacaaggagtgcagacgttcagggccacatggtagcatttagatttgatacgagaaacagtagcgccccattcgagaggataagtatgcctcaaacacaggagttcttgggaagagaattatcacaagagacaacttctgttgggtgttggccagtgtccctcgtccccccaccctgggtccccactgctttacctcttgctttgcagccttctctcctcacagccttcctgtggctgtgtttttggccctgatagccccatggcacaactgcactttgcctcacctaggcctgtggcttcttgcctggcaggtgccacttctccacttttaagcagtgccaagagtggctctcacggctaagccgagccacagcaagacctgccaagcctgaagacctctttgcctttgcctaccatgcctggtgcctggggctgaccgaggaggaccagcacactcacctatgtcagccaggtgaggccagtctattttctttgggaggctgcttcttaccccttagttctcatccctcctccactcctgcacattggtgctctgggaagctaaccatcgtgggggctctgttgcaggtgagcacatacgttgtcgacaggaggcggagcttgcaaggatgggctttgacctgcagaacgtctggagagtctcacacatcaacagcaactacaagtgagagggttggggaccaaaacaccttccacaccaaactacttccgtgtttggataaagtgtggtgggcacagcttctgagtctgagagggaggaaggctcatggtttctcttcccacaaagccatccccagggatcctgtcatcacatgttttagacccagtgcagtgacccccacctggtctcttctcagattgtgccccagttacccccagaagctgctggttcctgtgtggatcactgacaaagagctggagaacgtggcttccttccgctcctggaagcggattcccgtggttgtgtataggtgaggcagtggggctgggaagtagggaggccatttcttatgcaacaaggaaagagtcaaaattggagattttgggtaacctggttgactgagaattgacactctatggggaagtatgaaataactttaaaacaaaaactatcttagttttttctcctaagaataaggctattagggagtttattcattccccccctttttttagagtgtgtgtgtgtgtgtgtgtgtgtgtgtgtgtataaaatagtacattattttatacacacattagtacaggggttggcaaactggcctgcagacaaaatctggcttatagcctattatataaaacggcttgtaagctgtgagtggtttttacatttttaaagggctatttttaaaaaaagcaaagaagaatacatgacagaaactggttgtgacccacaaggccaaaaattgttgtctggttttttactgaaaatgtttgctgatccctgcactagaatattgtagctaaaatagagtgagacaggaagtaaccctgaagtttggaattgttcctattcttggctcagccaggccttgttctcctgctgggtgtctgtacctggagcagttgctgtgcagatttgatgagtcaaggtcaccttggacatacagagcccatttgagaaagtatgtgtgatggtgctttgtaaacggtgaagcctgctagtgacgttggggcttttggttgctgttatggcctggatgagttggtagcccctgctggctctagagactttggtctaaccccctgaggtaggcctctggaggcttcgaatgccaagggcattacggtttcttctgttttgtcagacacttgcgcaatggggctgccatcgcccgctgcagccagccagagatcagctggtggggctggcgcaatgctgatgatgagtacctggtcacgtccattgctaaagcctgtgccctggacccggggacaagggccactgggggctccctcagcaccgggaataatgataccagcgaggcgtgtgatgctgactttggtaaggtgtggatgatgctaaccccccagggagcaggccccctccttggcttcattggctcccagggagtccccagtgagagtctgggaagatgacaacacacggggtgctggggtccctgccttgtcagaagctgtggggtatgaggggtctctagttgcatgttctgccttctgagagggagtgccagagggccagcaagaggttgggtggctggctgactcagggactccttcctgctgtgtgtttagattcttctctgactgcgtgctctggagtggagagcacagcagctcctcaaaagctgctgatcctggatgcgcgatcctacacggcagcagtggccaaccgggccaagggtggaggctgtgaatgtgaaggtattgctgttatcccagtgtctgcagccagcctgtgctctgggtggctttggtgaggagggggttgggggccatttgtatagtggaaagagcccaaacaaacctggcttgtaatcacaactttgctacctactagctatggctatgactatgctgaagttgcttaatctgtccaagctttattttctcttctataagaaggggatgttacacactttgcaaaattgttgggatgattagaagttgcatatgtaggctgggcccagtggctcatgcctgtaatcccagtactttgggaggcagaggcaggcggatggcttgagctcaggagtttgagaccagcctgggcaacatggtgaaaccctgcctctatcaaaaatacaaaccattagctgggcatgatggtgcatgcctgtggccccatcccagccacttgggaggctgaggcatgagaatcgcttgcatctgggacgcagaggttgcagtgagctgatatcatgccactgcacctctagcctgggtgaccatgagaccctgtcttaaaaaagaaaaagaaattgtatatataaaattattgccacagagcagctactatttattgagaattgattatatattgtctttctaagtactgctatcatttgtcattactgttactattattaatatatggcacctgagtctccagagatacaagtgtgattcagatttcaagactgtatttagttcctatcctggagtgctctgccctgccaggaaagctttgtccaccaggaccactcttgtcctggatgcctgtttccaggacgtgctttttttgtttgtttgtttgttttgagacggagtctcgctctgtcgcccaggctggagtgcaatgtgccatctcagctcactgcaacctccatctcccaggttcaagcaattctcctgcctcagtctcccgagtagctgggattacaagtgcctaccactatggccagctaatttttatatttttagtagagatggggtttcactgtgttagtcaggctgttcttgaactcctgacctcaggtgatccaaccgcttcagcctcccaaagtgctgggattacaggtgtgagccaccgcgcccggcctaggacgtgcttttatgtcccactctcctgtcatgtctacagagtactatcccaactgtgaggtcgtgttcatgggaatggccaacatccatgccatccggaacagctttcagtacctccgggctgtgtgtagccagatgccggatcctagcaagtaggtgttccctacttggattccttccagtctcattccttacccagtacctcttattcttggaagattagatggggagatgagaagtttggagagcaggagacctgagggcctgggtggagttgggtgccgtgggctagttccaagaacccttccacttctcagccaacactttggcgtggtcacaggacatggattcctttcgtttggatcagttgttctactcaaagaacacagagaactggggagaggaaatggctgagtgtgcatgtgatgcttctcagttcctcttttgagcttcagatgcttttatctgctgtaggtcctgtcttccctaccttcctgctagatacctcttgtccaaaaggccctgggttgtacctcttggtttcagttctcaatggggactttgttgggtggggctggctgtggatggtggagagactgctgtggcctcagcaccctttgtgaccgacttgatgtctgcttttgtgtagctggttgtcggcactggagagtaccaaatggctgcagcacttgtcggtgatgctaaaagcagctgtgctggtggctaatacagtagaccgggaaggccggcctgtgctggtacactgctcagatggctgggaccgcacaccgcagatcgtagccctggccaaaatattactggacccatattacaggacgttggaggtattgagaggaattcggtgggaaaaccagaaggaatgtggcaggagggaaggtgttgagccctctggatctgtcctggggatctttcagtagaggacattggtggctctttttttctttttttttccaactcccaaaggcttggaaaattggtggctttgagtcctcttctaggtccagtcctatttttctttgaagctgccagcttcctgctttgggcagttcccaggggagtagcacatcagcatttccagagaggccctatgtttgaacagtttctttttttgcagggcttccaagtgttagtggagtctgactggctggattttgggcacaagtttggagatcgctgtggccaccaagagaatgtggaggaccaaaacgaacaatgccctgtgttcctccagtggcttgattctgttcatcagttgcttaagcagttcccctgcctgtttgaatttaatgaagcattcctggtaagtcctaagccctgtgacaacagggatggggggaatgacagcccgaggcccccaggtgcaagctctctctgctttctaggtaaaactggtgcaacacacatactcctgcctctacggcaccttcctggccaacaacccctgtgagcgagagaagcgcaacatctacaagcggacctgctctgtgtgggcgctccttcgagctggcaataaaaactttcataacttcctctacacacccagctcagacatggtgagtctgagcccttttcctgtaggtgctatttagaaacctatagggagaagcagctgagtcagtagggaaaatgtagagtcaagggcttagggaaagaaaaaggacaaggaactcttgacaaagcactagtattgggctgcttccctaggtcctgcatcctgtttgtcatgtccgggccctgcacctctggacagctgtttatctgccagcatcatctccatgcacacttggggaagaaaacatggatctttacctttccccagtggcccagagccaggagttctctggccgctctctggacaggtaagaaaagcccttcttcctttctcctctctccactaggaaggcagtaactgtttcccatctcatctaaatgttctctttctttcttttttttgagacggaatctcgctttgtcgcccagggtggagtgccagtggtgcaatcttggctcactgcaacctccacttcccgggttcaactgattctcctgccccagcctcccgagtagcttggattacaggcaccgaccaccacgcccagccaattttttgtatttttagtagagatggggtttcaccatgttggccaggctggtctcaaactcctgacctcaaatgatccacctgcctcggcctcccaaagtgatgggattacaggcgtgagccaccgtgcccggcctctttctgaggtatttaaaagcaacttcttgagtcatttgcaggaaaaacttggccaagacttgtagctagcctggagtgcactctgtgtgttttcaaggtcctctgaagataaggttggatactttctttcctggaggagctgctatcactctgtatgatatacccaagcaggggagagaacaaaacagaaaggactgttttaggaaggtttgtgggaatggtcttgatttttgttcactggtacagggcatggggagcttgctatattagtagcaacctttgttgtgtccagcattagcttccagaaacatctgactctcagggaaatgggttcccagcaggaggatggccttatattactccctcagaaaaaggccagaatttaaaagggagacataaaattaggtatcttctggctcaatgtttggggagaagtgagatgatgttggttaatttatgagagtaatacctatttcttgttttaaaaaaatagtcaatataaaagtagaaaatgaaaatcttcccttatgatccttgtccccacaggtgtccactgctaacatttggtacgtgtctttccaaatgtttatctctacataggtaaatccacactcacgctttcatatggaaacattttttataaacaaaatcagaatatttttacatacgctttttacttttttgcatattctgcaaattgtttttcccgctttgtattaggttgtcttctcatgacagcacatctaaattccctttcttgtttttattggcttcagagtagtccacaatttatataaccagattcctactcatcatttaggtaatttccatttttttttttttttatcattacagggagtgctttacatccttatatgtgtagctttttaaaaatttgtaaattacaggctgggcacggtggctcatgcctgtaatcccagcactttgggaggccgaggcaggtggatcacttgaggtcaggagttcaaggccagcctggccaacatggtgaaaccctgtctctactaaaaatacaaaaattagccgggcatggtggcaggcacctgtaatcccatctactcaggaggctgaggcataagaatcgcttgaatctgggggggtggagattgcagtaagccaagatcacgccacgcactccagcctgggcaatagagtgagactccatctcaaaaaaaaaaaaaaaaaattgtaaaatacacatgctatttaccatctacaccatttttaagtacatagtttagtagggttactttgtgtgttttttttttgttttgtttttttgtttttgacagagtttcgctctgttgcccaggctggactgcagtggcacaatctcagctcactgcaacctctgcctcccgggttcaggtgattctcctgccccagcctctcgagtagctgggattacaggcatgcgccaccatgcccagctaatttttgtatttgtagtagagacggggttttaccatgttggtcacactggtcttgaactcctgacctcaagttatccaccatctcggcctcccaaagtgttgggattacaggtgtgagctcctgcgcctggccagtagggttactttgtatgcatatttttgcatttgtgctagtatttttgaatgaaaatactgtgctcaaaggatatatatacatatatacgcgtatatatatatacacatatatgtatatatatccgtatacatatatacatgtatacgtatatacatagacatatacatatatgtgtgtatatatgtatactatatatatacacacatatatacatatatacgtgtatatatgtgtatatatatctcaaattttgatatttgtttattggctgagagcttttttgttttttagagacagggtcttgttctgtcactcaggctgggtgcagtggcacaattatagtaacctcaaactcctgacctcaggtaatccttctgtttcagcctcccaggtagctaattagctcattaggcatgtgccaatttttattttttgtagagacgggtctgttgcccaggttagtcttaaattcctggcgtcgagtgatcttcctgccttggcctcccaaaacactggaattacaggtgtgagccaccatgcccagcctggctgaaagtttttaaagttaaaatataacatatgttattggttgaatattataaaggaaaacaaaaagcccagcatcccaaattattggttttagggtcttttgaactaagtcattgtgaggggaccgtgataggtttcaggatttcagtgattttttttttccttccccaaactatgcagaatttggctacaggttcataggtttacttttcctgggagaggggccataacttttaatcaaatttttaataagctctgtgacccatttaataatcatttcattaacttagtatctgatttatcaattcaacaaatgtttctttaatacctacaagttgcgtattactgtactaggttttgtgggctacagcaaagaaatagaagatattggttctactttcaagataattttaagctgtaagataagacacagaacaactagagagagcaattcttttttttttttttttttttttttgagacagaatctcgctctgtcaccggttggagtgcagtggcgcaatcttggctcactgcaacctccgcctcccgggttcaagtgattcttctgtctcagcctcccgagtatctgggactacaggtgcccaccaccacacctggctagttttttgtatttttagtagagacggggtttcaccatgttggccaggatggtctcgatctcttgacctcgtaatctacccgcctcggcctcccaaagtgctgggattaccagacccggccaactagagaacaattctaagtcaacatctaagcagataagaatgtgtgtagttcaggctgggtgcagtggctcatgcctgtaatcccagcactttgggaggccaaggtgcgcagattgcttgagcccaggagtttgagaccaacctgggcaacatggtagaaccccacctctacaaaaaatgcaaaaattagccaggcatggtggcgtgcgcctgtggtcccagctacttggagggctgacgtaggaggattgtttgctcccagcaggttgaggctgcagtgagctgtgatcatgccattgcactccagcctgggtgacacagcgagaccttgtctcaaaaaaacaaatgtgtgtagttcaaagctttagagaaatgatgtgttttttaaaagggtcacttggtggctgttttactcaggaaattttcatgaaggaccagacaagaactgtgggtctttttgtgttctgtgtatctggcttagaacctggcacgtaataagtaaatttaaataaatttactaaagtaaaaatttacttaaaactggacaaatggctgggcgtggtggctcatgcttgtaatcccagcactttgggaggccgaggcgggcggatcatgaggtcaggagatcaagaccatcctggctaacacggtgaaaccccgtctctactaaaaatacaaaaaaaaaaaaaattagccgggcgtggtggcaggcgcctgtagtcccagctactctggaggctgaggcaggagaatggtatgaacctgggaaggcggagtttgcagtgagcagagatcgcgccactgcactccagcccgggcaacagagtgagactgtctcaaaaaaaaaaaaaactggacaaatgaatgaaataaagggagttgtgagctcagtaacaaggttagtggagaggggtccaaagcaagtggatacatgagaggtagggttttctcgctccattgcccagctggagtgcagtcacatgatcttctcagctcactccgcccaccgggttcaagtgattcttctgcctcagcctcccgagtaactgggattacaggtgtgtgccactacacctggctaatttttgtatttttagtagagacggggtttcgccatgttggccaagctggtctcgaactcctgacctcaagtgatccgctcaccttggcctcccaaagtgctgggattataggtgtgagccactgcacctgggtgagaggtagtttttttttttttaaaaaaaaaagaagttctgtggctggcaggggttgagaaggggctattttaaggaatagtggaaatataggacaggtcattgagggcattgaaggctttaaacattacagtgaagagtttattttgattcagttgtcaataggaagtcattgtaggaagttactgtggtctgctgacagtgggatccttggagaactaatcagtgagtacagggtagctggaggcacagagaccagccagcactgctgtagtagttcagatatgaggggaagagtccctggcaaagagaaaggattaaattcagaagcactgtagagaaccattggcaggctacagaattgaaagttggagagtagaagtgaaaagtactttgggtcccaagtatctgagcttaaaaagtaggagaatattagtaccactaatagacattgaaaggtcgagaagaccagccagtttggggagaaagcggagatacagggaaattgggattgaaatattagttgacagcaaagaaggaggtgtgttgtaggcagctcaagatggagagtagatttcgagaaataattggtataaagattttaaaggaaatggtctctgtaacaactgacctgacttacctttgattctacctttccctagatcaaaaatgtccttcttcttctccttcttctccccctcctccccctcctcccccctcctcccccctcctcccccgcttctccttctccttctcctcctccttcttcttcttcttccattaaagtcataaacacattcttctatacccatctcaaatcctaccctctctctgtagccttccttgacctcctagctggatgagctctctctccttgttgtaaactcaggtattattatctctgtcaacattgctgactaacctttggtacacatagaatgagttgtggaggatggcagaatgttgttatttgaatttggatgaagagcacatggaagttaattatattcttctttttgttgttgtttgagacagagtcttgctctgtcacccaggctggaatatagtggtgcgatctcggctcactgcaacctctgcctcttgcctcccaggttcaagcgattctcatgcctcagcctcccaagtaggagctgggtttacaggcatgcaccaccatgcccagctagtttttgtatttttagtagagatgggatttcaccatgttggccaggctggtcttggacttgtggcctcgagagatctgcctgccttgacctcccaaagtgttgagattataggcatgagccactgtgcccagcatattctttacttcttttgtatgcttgaaagtttccataataaaaaataaaatgaaagaagtcagctgtggcacttaaaagaatacagatccctaggccccactcttggccattcttattcagtaggtcttgggtggaccctggttgtctggatgtctaagaagatccactaagatgcctgatgtgtatcacacattcaattggcacctagcagtggaaacctgatgttgtattttgagctcattcattcatttctcaagtcatttgcccctggtactgtgctaggcgctggggattcaaataagacagagtcctgccttcaggacacttcagtagagggagttaaacaagtaaacaataaagtgcaataatgtgttataggaagcactgagcaatgtgctttgatgtggattcttttgtttaatcttcataatagctttaagagctaggtactttacctttattccatagatgagggatctgaggcgtagagaagttaaagtcacacagcaaagatgttgttaaattgggatttgaaccctgcctatgggactccaggaactataatgataaccactgttattgccttcctggaatttcgtaccattaaaaaaatcaaaattcgtcacaaaaggtatatcaagtatgtataaaacatttgttttaagtttcaaaaaccgattacttaaaataagctgcgttgtaactgcctttggggaatttttccgcataggctgaactgactgagccatctaaaaataggaggccagtgaagcctctactgtttccctggtgaatttcactcaagttttcattgctctaaggactttgaactgcattaataatcaggatggtcactcttgaaaatgtcccttaacctatctggtatatatgaatgcctctagaactctgagtgctatatactaggggaagtttcatggggccttgggaagcagaggagcacactgctgctaagtggttatcaagagcagtgttgagggagttgtgttgtcttaataaagtttgtggttattatgtttgtggttggttgcctgtattttgaattctcatagcatctctacaaggtatgatttattatcatcattgtataaagggagaaaccaagtatctgagaggttaatttacttatttgtagtcatgtagctaattagcgtcagagccaatattgtctagctccaaaacccatcttctttctgttttactgtgatggaggcagtgggatattgggtttgagtctcaggtatagtcctagctggaacagtagattcagaaggcattggcatagaaggcagctgaaaccactgtagtggttgagattgcccagggagactggtaggttgagtgctgacaaaagctgaggatagatttttgggttccggaggacacggtccatgtctcatgctttttttacagagtaaactttcagtgaacattggttatttgtgatcttaagggtccttatttctaaacttaagtgttcttaagtgtcattatttctaaactctggctttgatattgctccattgattcagttccatatattgtattgcaagtgcccatctcctgacctggaggtgttatatttgtctttccagattacctaaaaccagatccatggatgatcttctttctgcctgtgacacaagcagccccctgactcgtacatccagtgaccctaacctgaataaccactgtcaggaggtcagggtaggcctggagccctggcacagcaatcctgagggatcagagacaagctttgtggactctggggtaggagggcctcagcaaactgtaggagaagtgggtcttcctcctcctctgcccagcagccagaaagactacttgagcaataaacctttcaagagtcacaaaagctgttctccaagttacaaactgcttaataccgcagtgcctcgggaaatgaagagcaacacctctgatcctgagatcaaagtcctagaagagactaagggaccagctccagacccttctgcccaggatgagctgggtaggactttagatggcataggggagccacctgaacattgtcctgaaacagaagctgtcagtgcactctccaaggtcatttctaacaagtgtgatggagtttgtaattttcctgagtcttcccagaactctcctacaggtacgccccaacaggcccagccagactccatgctaggtgtgccctccaagtgtgttcttgatcacagcctcagcaccgtttgcaacccaccgagtgctgcctgccaaactcctctagacccaagcactgacttcctcaaccaagatccctcagggtctgtggcaagtatctcccaccaggaacaactgagttctgtgccggatctgacccatggggaggaagacattggtaaaagaggaaataataggaatgggcagttattggaaaatcctcgctttgggaaaatgccattggaattggtccggaagccaatttctcagagccagatcagtgagttctcttttctagggtccaactgggacagcttccaagggatggtgacttcattcccaagtggggaggccacccctcggcggctgctttcctatggctgttgtagcaagaggccaaacagtaagcagatgcgggccacagggccctgctttgggggccagtgggctcagagagaaggtgtgaagtcacctgtctgttctagtcattccaatggacattgtactggcccaggaggaaagaaccagatgtggttgtccagtcatccaaagcaagtctctagcacaaagcccgttccactgaactgcccttctccagtgcctcctctgtatttggatgatgatggactcccctttcccacggatgtgatccagcataggttacggcaaatcgaagcagggtacaaacaagaggtggagcagctacgtcgacaggtgcgtgagcttcagatgaggctggacatccgtcactgctgtgcccctccagcagagccccccatggactatgaggatgattttgtaagtagtcaccaactgccatacacccattatttactctgttcatccagccttccctccattcagcatttattcgttgggtacttgctgtgtgccactgagttaggtgcctgggctataggatgaaaaacaagtaagcaattagaatgatgtttttaagtgctatgattgaggaggcatcaggtgttagagggctggagtggagtgaaacgtcaaggaagactttcttgagaaggtaatgcttgagctgagtgctgaagaatgtgtgatacttagccaggtagacagtgaaaacaaaacaccatttgcagaagcgtagtggcaatagatactccaatgatacggcttaaaaagatgggacatgcgagtatatatgtgtacatgcatgcatacacgcttacactggggctatgagagacagtcaaatagggtggtgggaggtgacattggagaattaggtggagattacaagggtcaggttgagtgcccttcttgtttggattttacccttaaggcaataaaattttaggccagtgcacaatatgatcagagttgtagtttaagaaaatgactcttgcaacaatgtacaatttttttttttttttttttttgagacggagtctcgctctgtcacccaggctggagtgcagtcgtgcaatctcagctcactgcaacctccgccctcccgggttcacgccattctcctgcctcagcctcctgagtagctgggactacaggcgcccgccaccatgcccagctaattttttttttttgtatttttagtagagatggggtctcactgtgttagccaggatggtctcgatcccctgacctcatgatccgcccacctcggcctcccaaagtgctgggattacaggcgtgagccactgcgcccggcccaacagtgtacaattttaatgaggcagttgagacccagattgggaggctggtaaggtcattttggaataatccaggtgagagatgaagactataggctgtgcagtgttgggcagcctcaggttctggcaccatagtccttggggagcttctaggagccagcttcctctccatggtatcttgccatttacacagacactttccttccttctgttaaggtgctccccacttgcctgcttctcacttctctggtgctttaaacaggagtcagcaaactttttttttttttgtaaaaggccaaataataactattttaggttttgtgggccataccgtctatgttgcaactactcagctctgctattgtgcaaaagcagccgtagccaggcactgtggctcacgcctgtagtcttaggactttgtgaggccgaggtaggtggattgctttagccaagaagtttgagaccagcctaggcaacatggtgaaaccccatctctacaaaaattacaaaaaattagctggacatggtggtggacgcctgtggtcccaactactcaggaggctgaggtgggaggatctcttgagtccaggatgttgaggctacagcgagccgtgatcatgctgctgcattccagcctgggcaaaagagcgagaccttgtctcaaaaacaaaacaaaaagcagccatagacagtaagtaaatgaatgaatgcagctgtgttccagcaaaacctgatttacaaaaacaggcagtgggctagtttggcctgtgggccatagcttgccaacccctggtttagaacataacaagagtctttctatgctgtggtgtagcatatcggtaagagtgtaaatctgaagctacaatactaggttcaaatcccagctttactacatatcagctctttctctgtggcttcattttcttatttgtaaaatggggatattagtagtatacattgtaagactgtcataagaaataagttcatgtgtgtaatgcacttagcacagtgcctgacacatggtaaacagtaagcgttaatgatgatgaagataatttgttgtctttgccttttcatcagacatgtttgaaggagtcagatggcagtgatactgaggattttggctctgatcacagtgaagactgcctttcagaagcaagctgggaacctgttgataagaaagagactgaggtatgtttaggcacatatgtggtgggtacttacgtgagccagtgagtcatcatattttccagagatgaatgacatgctgtagactgagctgtcccccagaggagtgtcagcctggtaggcaaatggtagccagttatgaagataagccttgtctctttctgctggggtgctttcctcattgcaatgttgctcttccagtctgtcaacaaggaccaggaatttttctttgtgccttctattaggtgactcgctgggttccagaccatatggcatcacactgctataactgtgactgtgaattctggttggccaaacgaagacaccattgcaggtaagatgttttgtatgatttagtatgactcaaaaaacagggcaggccaggcgcagtggctcacacctgtaatgccaacaccttgggaggccgaggcaggcggatcatgaggtgaggagattgagaccatcctggccaacatggtaaaacctgtctccactaaaaatacaaaaattagctgggcgtggtggcgcatgcctgtaatcccagctactctggaggctgaggcaggagaatagctcgaaccagggagctggaggttgcagtgagccgagattacgccactgcactccatcctggcaacagagcaagactctgtctcaaaaaggacaaaaaacaaaaacaaaaatagtgtaatacatatgtatagaactaagtggaattagtttggaagtggacacctctttatagaaactatttttgtttgtccccaacttttcatttagtatcactcattctcagtatattggcatttcttaatattaattaattaattatttttttattagcgatgggctcttgctatgttgctcaggcaagtctcaaactcctggcctcaagcgattctactgcctcagcctaccaaagtgcagggattactggtgtgagtcaccctgcctggccagtatattggcatttctgatgaactcttccctctttctgctttgacagaaattgtgggaatgtattttgtgctggatgctgccacctgaagctgcccattcctgatcagcaactctatgacccagttctcgtctgtaactcatgttacgaacacattcaagtctctcgtgccagggaactcatgagccaacagctgaagaaacccattgctacagcttccagttgaatgccggggagaaacctgtccaattttagcaggtttgaagggaggatcttcttcagttgtagtttggaaggttccttggtgtggctcatgaaatcacagagctcagagataccatcttgagaaatcctccttggtatcatgaaactggagcagaggaattgcaatttagcaggaggtcctctactggtgataccctcaccttggggtaatggtcctaacccagacccagggtctggaagcttaatgttgagttggtgactccagcctctttctcctggaggtcacaagatgatgattgcgtagatgttgcctggtgcaaagtgccccaaacagcaatagaaaggcatatgtataaccaaactccaagtgataaccagacccatctctcctccaccttgacaaaagcagattatagtatacaaggtaggaattcctgtcctatttgagatgaactatatcctgtacctctgtgctctgtgtctgcatgaaggctcagcctttagaggcactccttctagttgcattagtactgtctttctgtggagtttggtttgaagactggctcagcaagtggaggtttcaatgtatttttcagttggctcatcagccagcattggtgaatattcagtttaggggaacagttctagggagtgagacatttttgggagcagaggaaaactctgctgatgttcggtcctggcaaacattgagttattttgagctgtgaaggcagtcgtctctgttacacagtggcagctcttgagttatgcactgtgaagaatgagaagggaaaagcaaaaattatccttgtgaaatatctgctgattgtgccctactctttgcacctgacttttcctagttgtcctggtgctaacacaggagctacaccttgatcctctcctggcatgaaaataaaacaaaggttttcgttgttgttgttccattgcccatttcccccatgttgtctttcccttggctgatgcctcctctgggtcacattgcttcttatcctgaacacttgacaccttgagggtagaatttagcgtttggtttttacctcctagcatatgctgtttggtatgtgagggtttcagtacaaatgctgctgtctatttctgtgcacttaacaatggaacccaaacagaagagaataaagccttgataccaaaattgggaaagaacatgtgtccatttggaccaaacgttgttggtttttaaaaaattttattttgtttttttgtttttgtttttgttttttttcatcttaatatgtaccagtggcacttaaccaaaagatacagtgatatagccatgtactgtgggtgggacagatacagtctccttggcctataatgaaaccactaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatggagctgaataatggagattttgtgtctgcaaaattcctgagatcattgaaaaagtaacaagctgttccttgtttctgatacataaaattattttaagcattttatcaatcattaaaatttactgccagttgtgagtggctttttaattaacttgtctttcattgcacttcactctgcctgttttcaaggggagtaagattggtaacatttggggagactgtatctgtctacttagcgtggctgttttgagggactgtcccatcagtgaacaaactgcatggccttggagagagactctgggctcttggctcagatgtgttcatcaaatactcct

SEQ ID NO: 12407 - DNA, 27757 bp, Human
  misc_feature (1)...(27757): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataacatgtattattacctcacatatcatttttttgtagtgagaatacttcaaatttactctcggcaattttcaggagtacaatacgttgttattaactacagtcaccattttgtacaagtagatcacttgaacttttttatatttttataattcttgaaagagaattgagtatcatttgtaatatcagaattgcaagctaaggttttcaaaaattagaggttaaaaacatgattcttttttctctttatctctcttataaccatagggaatgtgcagcaatcagttaaccgcaaacagagctggaaaggttctaaagaatccttagttcctcagaggcatggcccgccactaggagaaagtgtggcctatcattctgagagtcccaactcacagacagatgtaggaagacctttgtctggatctggtatatcagcatttgttcaagctcaccctagcaacggacagagagtgaaccccccaccaccacctcaagtaaggagtgttactcctccaccacctccaagaggccagactccccctccaagaggtacaactccacctcccccttcatgggaaccaaactctcaaacaaagcgctattctggaaacatggaatacgtaatctcccgaatctctcctgtcccacctggggcatggcaagagggctatcctccaccacctctcaacacttcccccatgaatcctcctaatcaaggacagagaggcattagttctgttcctgttggcagacaaccaatcatcatgcagagttctagcaaatttaactttccatcagggagacctggaatgcagaatggtactggacaaactgatttcatgatacaccaaaatgttgtccctgctggcactgtgaatcggcagccaccacctccatatcctctgacagcagctaatggacaaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtgggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggtaaaaccttttaaaatgtccatttttatacttaatcatctgtttgcttggtgtttattttaaaatattgtgtccagtatttttctttctttttatagctaaataaaatatattatcagttatggaatttaaaagtgaataaatattaaagtacttttgattgtagcattttattttagtatttcaatatttattcagaatttcctataataaaatctcgtgtaaattaagaaaaatataatttgcggtatacagtttaggtgtacataatacctttatatgaaaattggaggaagggttgtcttctaggcttcatacaatatcttacaacatttaaaaataaactagaaatatgtgggtctcaggctggggcatgggggctcacgcctgtaatcaaagcactttggaaggctgaggcaggcagatcatgaggtcaggagatcgagaccatcctgcctaacacagtgaaaccccgtctctactaaaaataccaaaaaaaattagctgggcatggtggggcgggcgcctgtagtcccagctacttggaaggctgaggcaggagaatggcgtgaaccccggaggcggaggttgcagtgagccgagatcgcgccactgcactcccagtgtgggcgacagtgagactccgtctcaaaaaaaaaaaaaaaagaaaaaagaaatacgtgggtctcatctcttgatatacttataaaacatttacttttagaaaatttggagtttataggtttattcatcacatatatcttattaaaaagtgtaaagaagtttccttcagttatatctcccttctcatttcatttttataatatactggagaaaaatgtgctaaaattatttagtgaaactatactaaaagggagatcagagtaagtaaacacactttaatctgtgttgtcattccacatagatcctcctagatattaaggtagtacgatcatcatttttttttttttttgagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattattgtttttatcatatgcttagagttcaaagatttgactcctaatcttacatctgtcactcacaatccaagaggcttaaccttgtgattaaacacctttatatacttgaaccattcttttaaaatgattttaataaatctgattttacagtattgttatttctattttatattttattaaatgagaaataccataataatttctatgacttatccatattttaattcttaggatttcttactaaagtctgcctatgtgtattttcttagtttatttttcctttttcctcttcactttcactaatagctgatttaaacttttatggtgttggaagctttgctgacttctgtagtctccattactgtgtaggcaagtaagattttaagagaaacagttctgaactaagtctggcatgccatccttcttaaaagattttgcatgcaaatgtgaatcctaacagaagcatgtggttgttctattttagtcttgtatttctagaattagaccccacttttccaactggatttcttttctatttaaaccctttaattaattctttattaattagccaaaatgtttctcccttctaaatccaggcattccatatctataatacttagaagttagtttttgtttttaatctattttttgatattttcatgagtcacactgaagtattcctaagtatccaaaggatatcttgtaaacaaccaggttgttcttttcgaagtaggagaaaccctttgcaatttgtgttagtggtagactgtgagtcgcacctttactctgatgccctgaaaaatagaaaaggaaagattattaatgactgttgtatatttattgagaatagggaaaggattggtgggttagaaaaggcattgttttgttgttctttggtacattaattttttagaataaatgagcctggagtggaagaattttttttcatgaaagacaaaataggaagaatatttgaggcctaggcattccaccaagagaagcatatacagagagataaatgaatatgcatgttaacatgttaacagatgtttgttgcacattgagaacctttttttttttttttttcggagtgcattagagaagagtagaaagcttactcatctggtaccctcttcttgcactccacagctgaatttgcataggtactcactttgaatatccttttaactaccccttaggctgcacttttgatcattaatttcctttgaaatgttttctagatttctaacatgctttattaaaaattatgcatttaacctttaaatatatgcctgaatttttcccaagctatttcttaatattcaatattgaagaagataattcttatttaacatctagtttatttgcctaggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtaagtaaactcataaaatttattttagtttgttcataataatgtaatttattgatgtagtaaaatataagatggtatcatcactggatgagagccagaagatgtgggtcaggtcttgattctgttggataaacttgggtgactccattaggcacttagacttatgaaatgaaagaatgtgctagacttgattgtttagacttatgaaatgaaagaatgtgctagacttgattgtttctaaatattattaacatttttgagtcacaccttttacattttatttgaaaatatgccagacaaacaatttttttttttttttttttttgatggagtctcgctctgtcgcccaggctggagtgcagtggcaccatcttggctcactgcaatatccccctcctgggttcaagtgattctcctgcctcagcctcccgagtagctgggattataagcacctgccagtacgcccggctaatttttgtatttttaatagagatggggtttcaccatgttggccaggctgatctcgaactcctgacctcaggtgatccacctgtctcagccacccaaagtgctgagattataggtgtgagccccctgcgcctggccaaaaacatttttaaaataattttttaatgaatcctcatatccaacattcagttaaagaactagattatcagtactttagaagcccttaaacaatcacttccccttttctcctccacaaagataattattatttcagaactttataatcggttctttacttttatcgatccttttatcacaaatgtgtatatctttaaataatatattatttcattttgcctactctttaacctttatttaaatataatctatatatattctttgtgttgacttgtttgaggttcctccatgttattgcttgtaacatttattttcactactatttaggatttcattacatgactgttacacaacttatataaccctaaacactttatgatccttgatcctattttatcctcacaatgtcactgtgaggcaggatgaagaaactgagacctagttagatgaagtaacttgcccaaggtcagacagaaatcaagtgtaagggctaggctttgaacccaggtttgtctgatttcagggcccatgttatttctactacaccacactgcctcaccaagatccctccaagcgctaatggaagtgtaagtcaatctaacatttgttaaatactatgtactaggtgcttaaccatatattctaatatgctcgcaacaattctctgaggtaagtattattagcctcctgtgcttctgtgaacacaagtagattgacattaaaatgggtagaactgagacaattgaacctactttaatgttcgacatagtggaatttagtgtcttcccagattcgactgaattattacctggaaagcttcttaaaaatatgattcctaggctctattcccatcttttgatcaaaaaatcttcactggggcatagaaatctttttgttgctttttgtttgtttgtttgttggtttttgagacggagtctcgctctgttgcccaggctggagtgcagtggcgcaatctcggctcactgctagctctgcctcccaggttcacgccattctcttgcctcagcttcccgagtagttgggactacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaccgtgttagccaggacggtctcaatcttctgacctcatgatttgcctgcctctgcctcccaaagtggctgggattacaggcgtgagcgaccacgcccagcctgtttgtttttttttttttgagacggagttttggtctgttgccaggctggagtgcagtggcgcgatctcggcccactgcaacctccatctcctgggctcaagcgattctcctgcttcagcctcccaagtagctggaattacaagtgtgctccaccacacccagctaatttttgtatttttagtagagatggggtttcaccatgttggccaggatggtctcaatctcttgacctcatgatccaccctccctggcctcccaaagggaaatcatattttaatcaaacatcccagataaatattacagttaggttaatttcttatattctaggtgacttcatgccatctatatgtcaatgaattccaaatctctctctccagaaatggcctttctctgaaattcgtaatttctctatccagctgcttcctggctatcttcacatggatttcaaataggcctttcaaacttcacatgacccataaagaacttttttttttaagcataaatcagatactgttatcttcttgcttcgaactctgcaatatcttctcactttacttgaggtaaaaggcagaccatttctattgcttgcaaaacccacatgtattcctgccgcatttcttacagttcttgccccatttcctacagttctcccctttatcagctgcgctggtcttctctctgttgctgttatttctgtgtggaatacctaatcctgatttataaatggttgagtccttcttgtttttttacggtttagctgaagtcaccttcttaactggtcttccctagccattcagtcttatgtagctatccagtcacatttgttacatcaccctgtgttgattctctgtgtagggtatgtcactgttccttatatgtgtaattgttttgtttcttttcctactagaatgtaaccagagctttgtcttattatcactgtcatttattgaatgaaagatggatctaatttgtttgaaagtttgtccagagtagtaacagggagtgggctaaataacaaactcttaatctccccatgactcatattgttgttatttaacattgcataaattactaaatcttaggctaattttttttaagtgtaaaatccttcctattgacatctcagaaaataggctctaattggtaataaacaccatcagtgatttggcatacattgtgtcttagtttgtcacaagggagaatgttgttaaccctaaaccacgatgtcagaagattaaatagacttcaggtttactgttgtcattgttgactttatttacttattcttttgttgtgcaggtgaccatccacggcaagatagcatggatttcagtaatgaatggggggatccctcaagctgtcgatgtggagacagactgaagccattagagcggagagctgcacgccagcaccagcgatgtctagcacattctttggttgggactcccaattatattgcacctgaagtgttgctacgaacaggtaaagcacttctttcatatatattctcagtagacctttagaccagccaaaacgacactagaatatgccttatttttcaggcttataataaaagtattaattttaaagtataaattggtgatttaatgttaatttttattgtattctgagcatttttaaagtgcttataaataactttgttattttaggatacacacagttgtgtgattggtggagtgttggtgttattctttttgaaatgttggtgggacaacctcctttcttggcacaaacaccattagaaacacaaatgaaggtaaggtatggcatctatatcaaaagaattctcacaaagttgctacatcattgacttttatttattagtacgtagagcattttagtctggagttaaagaatgaacttgggccgggtgcagtggctcacacccataatgccagttctttgggaggctgaggcaggaggattgcttgagcctaggagttcaagatcagcctggcaacaatgtgagaccacatctctacaaacaaatattttttaatttaaaaaaggaaaagaatgaacttgtaagggtataggaactcaccagaattgcatgcgtgaactccagtctccatgatgccatatccccataatcttgtatcccccctcactcatacagcatactcatatatcatatatcattctcaaaaaggtctttaggccaggcacggtggctcatgcctgtaatcctaccactttgggaggtgtaggcgggtggatcacctgaggtcaggagtttgagatcagcctggccaacatggcgaaaccccgtctctactgaaaatacaaaaattagcggggtgtggtggcgggcgcctgtaatcccagctacttgggaagctgaggcgggaaaatcccttgaactcagaaggcggaggttgcagtgagccaagatcttgccatcgcactccaccctgggtgaaagggcgaaactcctcaaacaaaacaaaacaaaacaaaaaggtctttagtccattttgaagatttagtccagtttactctttgtcacctactgcctcctggccttgtctccttctatgcaaactacaaacaaatgtttatatccccacttgaaaatacctctggcacttaaatgagaagttacccacaattttgaccatacactgtctgatttaatactctttagtgattgtccgtgggttaaagttgaaatttgccctctgttcataccgttccctctgtctggaatgtcctacttccatctctctcttctataacccttcctcctttctgaagtctaattaactcttggtcattctctctttttttttttttttttgatacagagtcttgctctgtcatcaggctagagtgcagtggcgtgatctcagttcactacaacttctgcctcctgggttcaagcaattctcgtgcctcagcctcccgagtagctgggattacaggcatgcgccatcatacccagctagtttttgtatttttagtagagacgaggtttcaccgtgttggccaggatggtctcaatctcctgaacttgtgatctgcccgcctcggcctcctgatcattcttaattattctttgagggccagacatgatggctcatgtctgtaatcccagcactttatttattttgagataaggtcaaaacatttcacctagggtgtaatgcagtggcgtgatctcctctcatgcaacctctgtctcctggctcaaatgacctatctcagcctcctgggtagatgggaccgcaggtgcatttttttttgtattttttgtagatacagggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgccctccccaacacctggctaatttttgtatttttagtagagacagggtttcactgtgttggccaggctggtactcaaactcctgacctcaagtgatccacctgcctcggcctcccaaagtgttgggattacaggcatgagccatcacgcccagcctaagttttcactatctacctagaatttatactttaccacttcaagttcaatgtagaaccatactgccatataggtccctttattctctactatttatgttgtagttatttgatttttcttcttttttccttttgacaaggtcttgctctgtcgcccacgctggagtgcagggtcgtgatctcagctcactgcaacctctgcctcccgggttcaagattctcccgtgtcatcctcccaagtagcctggattacaggcacatgccatcacgcttggctaattttattattattttgtaatcaagactagtcactatgttgcccaggctggtcttgaacttctgggctgaagcaatcctcccacgttggcctcccaaaatgttgggattgcaagcatgagcctgcacctggcttgtagttattttatacattacatctacatacgtttaaaacctcatccagccaggcacggtggctcacacctgtaatcccagcactttgggaggccaaggcaggtagatcatgaggtcaggagatcgagaccatcctggctaacacggtgaaaccccgtctctactaaaagtacaaaaaattagctgggtgtggtggcaggtgcctgtagtgccagctactcaggaggctgaggcaggagaatggcgtgaacctgggaggcagagcttgaagtgagccgagatggcgccactgcactccagcctgggtaacagagagacgccgtctcaatcaatcaatcaatcaatcaatccttatccagccaggtatggtggctcacacctgtaatcccagcgctttggaaggccacagcaggaagaacactggaacccaggagtttgagatcggcttgggcaacatagtaagaccctgtctctacaaaaaaatttttttaattagcctagcatgctggtgtgtggcagtacatgcctacagtcccagctacttggggcgggggcaccagtaagtgggaggatcccttaagtccaggaggtcaaggctgcagtaagagctaagagtgtaccactgcacaccagcctgggcaacaaaatgtgaccctgtctcaaaacctacctcatccaacaatgtaacaattttgctttcaaccatcaagttcttttaaagaactcaaggtgacaggctgaatgcagtggcttatgcctgcaatcccagcactttgggaggctgacgcaagaggattgcttgaagtcaggagttcaagaccagcgtgagtaacaaatcatagacagtgtctctaccaaaaaaaaaaaaaaatagctgggcatggtggatggtggcacatgcctgtggtcccagctactccagacacaagaggatcacttgagcccaggagtttgaggctgtagtgagctataatcataccactatgctgtagcctgagcaacagaatgagaccctgtctcttaaaaaaaaaaaaaatcaagatgagaagaatagtcatttatgtttacctggatatttagcgttttccttgctcttcatgctttcctggtgtttcaagattccttctctatcatgtctcttccatctgaacaacttcctaaagcagatactttagagcaagtgtgttgacaacagagtctcttaatttctcttcatatgagaatgtctttattttgccttccttagaatattatcacttgaggccgggcgcagtggctcatgcctgtaatcccagcactttgggaggccaaggcaggtggatcacctgaggtcaggagtttgagaccagcctggccaacatgttgaaaccccgtctctactaaaatataaaaattatctgggctggtggcgtgcacctgtaatcccagctacttgggaagctgaggcaggagaattgcttgaacccaggaggcggaggttgtagggagacaagatgacaccactgcactccagccggggcgacagcccgagactccatctcaaaaaatatatgtattatcacttgatacaaaattctgggttttagttcttacagcactttaaaatgtctacttccttctgtcgttcataatttgatgagacatctgcaattattcagatctctcaaataatgcattatgtttctctagttgctttcaataattttttttctgtatcgtaattatgataggtctgggcatggatttctcaggctttattccgtttggtattcaccaggcatcttaaatctgtaggtttatgtgtttgatcaaatttggggtgtgttcagccatcatgtcttcaaatatttatctgtaccacacattttcttttgtgatgttaatcacaggaatgttaggccttttggtgtggtcccacagattcctgaagttctacttatattttaagtttttgttttttctgctgttcagaatgagcagttgattgaattgcataattagtatccacctcctttttttttttttttttttttttttttttgagatacagtcttgttttgttgcccaggctggagtgcggaggcatgatttcagctcactgcaacctccagctcaagctcctggttcaagtgatccttccacctcagcctcctgagtcgctgggactgtaggcacaccaccacacccagctaattttctgtatttttattaagacagggttctcaccatgttggccaggctggtctccagcttctggcctcaagtgatccacctgcctcggcctcccaaagtgctggcattacaggagtgacaccaccgtgcacagccagtatcaacctatcttcaagttcactgattttttttcctctgacatcttcactctgctattgagactatccattgagttttttattttggttatttttccattataaaatttctttttgatactttatatcttcaatttctttgctgagacctatctttcatttcatgagtgttcatccttatttggagcatttttttttttttttttgagacagagtctcactctgttgcccaggctggagtgcagtggctcaatctctgctcactgcaagctccgcctcctgagtttacaccattctcctgcctcagcctcccgggagtaggtgggactacaggcgcccaccaccacgcccggctaattttttgtatttttagtagaggtggggtttcaccgtgttagccaggatggtctcgatctcctgacctcgtgatctgcccacctcggcctcccaaagtgctgggattacaggcgtgagccaccatgcccaacctggagcatttttataatggctacttttttttttttttgagacagagtcttgccctgttgcccaagctggggtgcagtggcactatctcggctcactgcagcctccgccaccgcctcccgggttcaagcaattgttccgcctcagcctcccaggtagctgggactacagttgctcgccaccacacccgggtaatttttttgtgtttttagtagagacggggtttcaccgcattggccaggctgatctcgaactcctgaccttgtgatctgcccgcctcagcctcccaaagtgctgggattacaggcatgagccaccgcacccggcctataatggctactttcaagtttttgtcagaaaattctagcatctatgtcatatcaatactgactttttctatgttgaaattttctgtttttgttttttgtttgtttgttttgtatactaagttattttggattgtatcctggacattttgaataatatgttatgagactctggattttttttttttttttttttttttggagacggagtctctctctgtcacccaggctggagtgagtgcagtggtgcgatctcggctcactacaccacccaggttcaagcgactgtcctgcctcagcctcccaggtagctaggactacaggcgtgtgctaccatgcccagctaatttttgtatttttagtagagacggggtttcactatgttggccaggctggtctcaaactcctgacctcaggtgatctgcctaccttggcctcccaaagtgctgggattacagcgtgagccaccgtgcccagccaagattctggatcttatggagaattttgaccttgttttgacaagcattaaacccggttgggttcaggccacaagttccaaccagtcttttttgatttcaatgtcagtttcaaaggcttttcctttctaggcagatagatctctttgtaggctgtggtcttttccttagttcagttctcaaagtctttggtatgctccttaggattagatccacatagttacagtttggagggggagcccagcagttcataagcaacttaatggggtcacttgcccaatctcctccctctctgtgatgtccccagtactttcctgttccctggggctccctatttagttctctgaccagaaagtgaggctttacttatccaactctgccaatatctcataactgcatctgaatccaggacaaggtggcaaaaggacacagagagaaaacgagcaacagagattcaacccatcttcttgggaccccatgctttattaatttatatatttatgagatattgtctcactctgtcacccaggctggagtgcagtggcacaatcttggctcactgcaacctctgccacctgggttcaagtgattctcctgcctcagcctcccggagtagctgggattacaggtatgcaccaccacaccccactaatttttgtattttaatagagacggggcttcaccattttggccaagctggtctcgaactcctgacctcaagtgatccacccgcctcggcctcccaaagtgctgggattacaggcgtgatgagccactgcacccagccccatgctttgttattttatttacaattggagaggaaggtttggctgtcagttttaggtgcatactggctcttattgccacctccgttgctaccaggaaactccttttctactccctgagcctgaactagagggaattctcctagagctctctgtgctcagcttcttccaagttttgggctaccttgagtccagcctgcagactactagagacaaaaaaatggagctgggtgtgctggcagaggcctgtagtcccagttactcgggaggctgaggtgggaggattgcttgaggctaggagttcaagaccagcgtggacaacatagtgagaattaattttttaaaaaaataattttttttaaatggtcaccaggtttaatggtacttcaaatttacatcttctcccctaatctacctgttattatttacttttcaggatcttgaagtagctgcttcctgcatcctgaccaggttttatagctgccttctgtgggagggagacaggagagtatatgtagtacatcttcctcaaaactgggacctctctggttgcttttagggttttcttctctttaactttggttttcttcagtttgaccatggtgtgcctatgtgtagttttctttgtatttttcttggttgagattcactcagtttcttgaaatgtacattaatgactttcatcgatttggggaaattctctgtcattatcccttcaaagatttattttgctttcttaccttttgagactctaatgattatacatgtgctattcctttgatactgtcctccatttctcttatgctttattctttcttttattctacatgttttctctctgtgcttcagtttatataattttattcatccatctttgaattatctgaatcttttgctgtgctcttttttttttttttgccttaaactgaaaaatcctaaatataccttaaaataaaaaatattaaacttggccaggcacagtgactcacgcctgtaattatagcactttaggaggccaaggtggacagatcacttgaggtcaggagtttgaaaccagccaggccaacatggtgaaaccccgtctctactaaaaatacaaaaaaattagctgtgcgaggtggcgggcacctgtaatcccagctactcaggaggctgaggcaggagaatcgcttgaaaccaggaggcagaggttgcaatgagccgagatcacgccactgcactccatcctgggcgacagagcaagactgtttcaaaaaaaaaaaaaaattgttcatctcattgtgtatattttttatttctcctgtttgaaataagtgatgaaactggaagcataaataactattattaactgtatcattttttttttccaaaaagggtttttaaaatattctattattagttgaagcctctccattttctaatctgggataagactttaaaaggaacaaataatagacgagggagtatatttttcttccctctatagtagctgactagctcctctacaaataaggaagattatactgttcatttattcagctttttaaaaaatatttattgactgcctaccatgcaacaagttgaagattttttttccctcttttgagacagggtcttgctctgtcgcccaggctggagtgcagtggcacaatcacggctcactctagcctcgacctccctgggctcaggtcatcctcccacctcaagtagctgggaccacaggtgtacaccaccaacctggctaacttttgtattttttgtagatatggggtttcaccatgttgcccaggctggtcttgaacttctgggctcaagcaattcatctacctcggcctcccaaagtgctaggattacaggtgtgagccacagtgcctgcccaagttaaaggtatctaaacttggttaaatgacaatgcattctaccacttaacagagtttgccccaaatccatttaatatcgtacttggagttgtataccaattcccctgcctccaagagttcagcgggagagactaggtagtcttaggtagtctggcttcacttggcattcctttcttcatcatttcattttattcataaccagagatttttctttttttttttttttttttttggagacagtgtctcgctctgtcacacaggctggagtgcagtggtgcagtcatggctcactgcagcctcaaactcctgggctccaggaatccttctgcttcaacctcctgagtagctaggactacagatgcatgccaccatacctggctaatttttaaagtttttttgtagagagggggtctcgctttgttgcccaggtttgtcttgaaccttcccggcttcaagcagtcctcccacctccgcctcccagggtgctgggattacaggcaaaagccaccacgcttggcaccagaaaaagttttatcaaacatgtattaagtatgtgccaggcaatttactgagcactaggagatacaaagaccactaaaacataatccctagccttaatggatatatttcagtaggacataaacataaataggtaccacaagctattagaaatatgatagaaataaatatatggtacaggggaggcagagtagaagtagtcacttctaccataggccaaaaggtttactaggggagattaaaactgacagtgagtcttataatgtgagtagaagttgcttggagaggatgggataggagaaaaaattattttccagcaaaatatcatgtaatttatttaaaatacaaaaatagcccagtgagacttttggtataaaacttgaaggaaatctttatttttctaatttatctcttccccctaattttaaaaaatctttaaaggttatcaactggcaaacatctcttcacattccaccacaagctaaactcagtcctgaagcttctgatcttattattaaactttgccgaggacccgaagatcgcttaggcaagaatggtgctgatgaaataaaagctcatccattttttaaaacaattgatttctccagtgacctgagacagcagtctgcttcatacattcctaaaatcacacacccaacagatacatcaaattttgatcctgttgatcctgataaattatggagtgatgataacgaggaagaaaatgtaaatgacactctcaatggatggtataaaaatggaaagcatcctgaacatgcattctatgaatttaccttccgaaggttttttgatgacaatggctacccatataattatccgaagcctattgaatatgaatacattaattcacaaggctcagagcagcagtcggatgaagatgatcaaaacacaggctcagagattaaaaatcgcgatctagtatatgtttaacacactagtaaataaatgtaatgaggatttgtaaaagggcctgaaatgcgaggtgttttgaggttctgagagtaaaattatgcaaatatgacagagctatatatgtgtgctctgtgtacaatattttattttcctaaattatgggaaatccttttaaaatgttaatttattccagccgtttaaatcagtatttagaaaaaaattgttataaggaaagtaaattatgaactgaatattatagtcagttcttggtacttaaagtacttaaaataagtagtgctttgtttaaaaggagaaacctggtatctatttgtatatatgctaaataattttaaaatacaagagtttttgaaatttttttgaaagacagttttagttttatcttgctttaaccaaatatgaaacataccccctattttacagagctcttttttcccctcataaccttgtttttggtagaaaataagctagagaaattaagccatcgtgttggtgagtgttcctaggctaatgataatctgtataattcacatcctgaaactaaggaatacagggttgaaaaaatattaatatgtttgtcagaaggaaaaataatgcatttatcttccccccccaccccccgccccatggaatatttaatctatttaatcttcttgcatttatttctcaagaattactggctttaaaagaagccaaagcactactagctttttttccatattggtatttttgatgctgcttccaattttaaaagggaacaaagctgccataaatcgaaatgttcaatactaaaagctaaaatatttctcaccatcctaagcagataattattttaattttcatatacttttcctgtatagtaactattttgattatatcatcaatgttacctgtttcctctttcagaacagtgctgcatatacagattgttattggcaaaggaaaatctggctatctggcaatattttacctaagcgcagattaattggtgaaaaaattaactcttaagatggccattaataattaggaaagtttacagagtggtcttagtagaaaattcaagtcctcctaatttatttaaggttcaataatgcgttcaacatgcctgttatgtataacgcttaggttctaaggaagattaaggtttcataccaaaatacatgtagcttatcttttaggaaggggaaaaaggctccattttgaccatagtaaaatttgtgttgtgttttatttccttttcttaagctccactgataagggattgtttttatcaaaagttactatttgtagattggaggcataattttagtgattttcatacttttagctttcttcgcataaaagctaattgaaaccgtatatgtagtaaaattaaaggcagagctgttgcagttgaattggagagttagggcaaagaacacttattagcccacacttcccacctttctacaggtggtcctttcagagctcagcctgaaaacccactactgtgttatcgtgcgtcttttggggttagtggttcttttgagaatctgaaggaagctgtggactcttcctagaaaaaaaaaccacacatacacatacaatgttgcatgcagtttcaagggattttggacatattgaaacctatcacaggctgtaggttatggacctctgtgccatgagaaaattgatacattaaactaagaactttgtttttaacttaccaatcactactcagcacatcttatataagctgataatttgtgatggaaaaggtctgtagcatgtgatataaggtgaccttatgaatgcctctcttgctggtacattaagttgttttaatatatcatttggaggggactgaaatgttaggctcattacaagcttgatacagaaatatttctgaaggatttctaatcagaattgtaaaacaatgtgctatcatgaaatcgcagtcttcacctcatggttcatggaacatttggttagtcccataaaatcctatgcaaaacaaagtagttcaagaatttttaggtgggtagtcacatttataaggtattcctcttactctttgggctttttcagtctgatttatttaaattttcatttagttgttttacttttggactaaggtgcaatacagtagaagataactttgttacatttatgttgtaggaaaactaaggtgctgtctcctcccccttcccttcccacaaaatctgtattccccctattgctgaaatgtaacagacactacaaattttgtattctttttttgttttttgttttgagacagggtctcactctgtcacccaggctggagggcagtggcgcttcacagctcactgcatcctcaaccttgggggctcacgcagtcctcccgcctcagcctcccaagtagctgggcatgcgccaccaagcccagctaatttttgtatctttagtagagatggggtttcgccatgttgcccaggttggtgtggaattcctgggctccagttatatgcccacctcagcctcccaaagtgctgggattacagacgtgacccaccgcgcctggcgcaaatatgtattcttttaaaatttcctctgatactataagctttttgcatttatctgaagcagtatacatgcctttggtatcagcaattttaacagtttggatatacttatcagctatcttattccaaaactacatctacttcttccagtatagaatctggtgcttcctgaccaaaaagatgagaaaaacaatgttaaaaatatagatgctttccattgaaatggagtgaaaacattggttctatatgttttcttttaaaataattttctt

SEQ ID NO: 12408 - DNA, 26510 bp, Human
aactcaaaaaagggctctctctcacagggagtgtgttggagtcagcaattaattggccttggtaaagcataaatcgtaacagcagcaagagctaatgggtactgaggccttaccaaatgccagtcactgcgatccgcactttacaagtaccataaattaaaccctccaattctgggaataccacctccatccccattttacagatctggagaaattcacgctctacgaggttaaattacgcctacaaggttgcaaagctgctcagcggccccttggctgtacactactggccatacaaggcaccctgtaccaacgaatcttctccccacttacacaaccagaacttgtcaacggcaaaggatggcatttaactcaggagagcctatcccaaaatggtgagagaactcagcgagcaaggaaggatttttattaaaattcagatcgccgactcctcccggtggcgaccctccgtgcatgcactcccaaactaggctctcttgagtttctgacatcagaaccacattctccgaaccccaatgaaggcagcagccggcgccaaagtctgcatacgaatgcaaataacatggcctttgcttccgagcagtttccaaatttgccctcgggatgtgaggtagagaccaagaagctaagtttgcgcccccgcaggctctgaaatgtctaggatctgacacatgctttgtccccatgaggagctcctgagatttcgcgtgcatcatccgcttagttcacggtgaccttggggtcggggactacgggatgaggggcacggactgtctaaacctccaggtcccttacagagggctccccgcgggtatgggagccatgcacctgtgccgacgccgccactgcctggagggtgcgcgcgcgccccgggccggggatgctgactcagcccggctgctcacattcctttcgcgcaacgcggatgctgttgctgccgctgctgccggtgcagcaaagtgggggaagcaaggcacccgcagcggcccggccgctcgctccctggggcccactgcgacactccctccccactgccggaaggggaactgtgggggtgcgcgagttgacgaaactgggggaagtgggcgctgcaggaggaactcaggcgccgcgcgcgcagctcacacccaaactggaaggaacctgttctgcccggggcgggcgcgaagccgccgcagccgcgagcgccgcgcgggatcagccccggcgcgcgcgtgttccccctcgccgctaaatccctaaatcctcagggcgcgggcgggactgggcggtgggcgcgccgggaaggcgcccgggggtggggacggggacccgcgcgctcgcgcctggccgaggtgctccgagacaggatgcaggcacccccaacaccctgcacgctcgcgctcctactagcgttgcagcaaagctccggggtctgggcgggtcacgcgcgcagaggcgcacccgggttgggagatcggggcgttgtgccaaggaccccggcggcgctggcgggggcggcccggccccggaccgcgacgcggttacctttcgtgacccccagcccaggcggcaggctggcgggcgcgcgaccggcgcggctcaggtccacgtgggacggcgcgcgcgcgccaggcaggccccctccttggctgcgctcagcgctcgcagcacatggtcggcggcggcgcgcccccgaggccggcggagaccggctgcagccggtataggataagagctaggcagcgacgcggggccggggcgcgggcggcagcacgcacggcccgggtcgcaggcggccggggtggggggcggggggagggtgtggctcgggtgcccgagtcgcgggagtgggtggagggcccgggcgctcgggcctcaccagcccgagccaacttgcgctagagtcgggcccgccccctaaggggttaatccttttctcatgttaccgagcggcttataaggagggggaggccaagcctccgccttattgggagcctttgggggtttattctcttcccttctaacttggtgagttggtttattattttacatgtttaaaagtttgattgtgggatgtgggttgttttttaaaaaatatgtgttggggcctttttttgtgatgggaggcggaggagaccactgaacatcttcacattttggagaggttattcccaaaaatattcgctctgacagttaggaatgcccagggccaccgggatgacgcgctcgcgccggtgtgggtagctgagagttgaatgtccgtgaccctggtacagttgggtcccggaagatacctaaaggcacgcctggcctttgagtgccccctgccccgggttgggggctccgggacgtcggaagagtcgggggctccaggctcagcccctccgcggattttccgcatgaagttgcctgcgcgtcgcaggagcgaaatgtcagaggtaccttcctaccccaggctggcgcgcgcacgcaggccgggcactgaggcagcgcgagggaaagtggggctccctgcctcccccgacccccaaacacagcactccctgcggcggccaccgtttgtccccagcgggaagccggggatttcccggcagagcgcgggtcctccacctggactgtcagaactgtcagcggctgacggccggtcccgcgcaacttcaaggttcccgggctgccaaccgcaggaaagcgctggtgtcgccaagcagttccgtagcaagggaagatggttttgcagaggaaatgggttatttccttctaggttgttgtcgtcttttctttttattccccccaccctagcaagacaggtcatagaagtttgttaggtggcgtatataaaatgtcaccaaacatggggggcgtcagtcttagaaaaagctccccggagccaactggggaagagcaattacaacttgtcaacctggaagccggttttgtttgcacggttagacactccgtgccagctccttctcgcaggagatggtttctaccccgggaatgagatttctcagtgatctgattgtttttgcaaatcatggtaagataggtgtcttgcttgtaaaaaagatgccaagtgcttatgctgaaatctctaaaccatgcatctccccatgtcccaagcaccgttatgtggcatttttggggtcaacaatacatccggccagatgatataatagaaacccctcttctcataattaagggaagagtgtccaaaataggaacttacagtgtgtaaataaacaatgcagccaagtggaaaagctccttccagtgtaatgagtaccactaaccctgagttttccttctgtggtttccgaaaaaggactttcctcagtggaactcctgaggaggacacttaaattaggggctcaggtttcaacaccatagtcttgtaaaatggtgactcggttgtagccagtgattcaacatcgtgaggcagctatccaggttaggtttggaaattttttttaaatagagaatgcagatgaactttagccaaatacagactggttttgacaacttgggccagaaacaacttgtcaaagctgttctccgggctacgcctttaagaagaagagaaatccgcagtgcttttgctcgaggtctgcctacaacagtagccaccccatttccatccagagcctgcgttttgaaacttgctcttagctgaccctggaataacactctgatggtctacaataatacaatttttttcatgccctcgggccaaatcttctctcgacaaattaaatcacagtgaaactcccaaggatagcggatttccaagcctttggcaagatacctacttatttatttgtttagaggcagggtctcactcccatcatgggagtgcagtagcgtgatctctgctcattgcagcctcgacctcccgggctcaagcgatcctcccacctcattttttaatttttttgtagagacacagcctcactatgttgcccgggttggtctcaaactcctgggctcaagtaatctgcctgcttcggcctccctaattgctgggattataggcatgagctaccgcacccggccaatactcatttatttaaggggacacttaaccacatgctactaggaaatcctccaaactgcccgtggattgtgtcattgtacttcctccagaagaacactagggtgaagggaagatggctgccgggaacccccattcagaattgtcgagttttgtaagttggaaaaggcttgagagactcccctgacaacccatgctttacagatgatagaagttctagaagttcaggattctgtggtttccataactgtgcagccagttaatggtacacagaaattaacaaatatggcctaagagctttaagaagaccaactcttcggccttgccttcaaagggcttagaaggattaaagcaagtgacggtcaaaggctgtcatagaagtatagactattagggcaggaagagatctaagctcatcagagtctagttcaactcccttttttacatttaccttgattttacattgacattgaaaatggggaagtgaagtgatttgcctaaattccatcatccgtaaagcaggggttgatgggcaggatgactcagctcgcctcaccagttagatccctacacagctgaaaaatatccctacccgtcagataaattcacatggccacagaccaaagtggacagataaacttttatattctggaacttacagaggcttctgcataaatgagttcaaaattcaggcctcagttgctttgtttgcagagacagaaggtttggccttctgctgaaggaatggaaaaaaagaaaaggagaaggccgggcacagtggctcacgcctgtaatcccagcactttgggaggctgaggcgggcggatcacaaggtcaggagtttgagaccagtctgaccaacatggtgaaaccctgtctctactaaaaatacaaaaaaaaaatcagccgggcgtggtggcatgcgcctttaatcccaactactcaggaggctgaggcaggagagtcgcttgaacccgggaggcagagcttgcagtgggctgagatcgcaccactgtgctccagcctgggagacagactgagactccatccccaacccccaaaaaaaaaaaaaaaagaaaggagggagggagggggagagagagagagagagaaagagagagagaagagaagaagagaagagaaaagaaaaaagggagaagagtccaggaagggttttattctgcaaccaagcactttctccccttatgactcggttttttaaggaaagacctgtgcatgactttacttaaatacaggcattatcacccaggaaggttcagaaaccaggttatcctgttattactttatattgtggtcttatcttcaaagctaaatttaataggacataggatgctttaggatgataaaggcataaaccttgggggtaggacggggttcagggtgtcatctttccttgatggagatctcagttataaaaagaaaagaaagcttctgtccaaaaacccaagaatgcaggtgaaagttatatgtggctctagctagagtagaatagctcagacataaagcagagttttttaaaaaaactaaggaattaacttcccagcagtggctcagaaaggaaatagaaatgaatagtccaccatctggctaggtgaggtggctcacacgtttaatactatcactttgggaggccgaggtgggaggatcgcttgagtccgggagttccagaccagcctaggcaacatagggagaccctgtctctattaaaaaaaaaaagaagaagaagaaggctgggcatgctggctcacgcgtgtaatcccagcactatcgtttagatactatctaacgtttaatactatcactttgggaggccaaagcaggcagatcacctgaggttaggagttcaagaccagcctgaccaacatggtgaaactccatctctactaaaacaaaattagccgggcatggtggcgcatgcctgtaatcccagcttcttgggaggctaaggcaggagaatcacttgaacccgggaggtggaggttgcagtgagctgagattgtgccatggcactccagcctaggcaacaagagcgaaactccatctccaaaaacaaaaacaaaaagtccaccatcttctaaacagctgtcatagaatagatctaagcaatgaccagctagctactttacacccatgtttgcaagaaccatctagcatttacactttctccgagctcagtttccttgggccaccaggcttcgcttaagccatcagttgattaatagaattcagtactaaattcaaaagtatcagctgtttctcacacctgtaatcccacactttgggaggccaaggcgggcagatcacttgaggtcaggagttcgagaccagcctagctaacatactgaaacctcatctctactaaaaatacaaaaatcaaccgggcatgatggtgggtgcctgtaatcccagctactcgggaggctgaggcaggagaatcgcttgaacccgggaggctaaggttgcagtgagccaagatcgtgccactgcacttcagcctaggtgacatagcaagactccatctcaaaaaaattaaatacaataaaatgctctcctgtaggcttgtacagcaggagccctggaaggcaggagattcagtattgggctatttcagtcaagtcccttcacctcttggggatcagtttcccgattttacaaaatgagtaagattttacaaaaaggaattgaaaaagataacctcaattttccccttcagctttaacattcaataattctaactctattcaggggttacagattcatcctagccccatcccttttgcaagtgtaaacatctgatgatacaggcaagggaagagaggaaaggggcagctggcaccagaacttcagtgctggccagacagagccttctcatgatggcaggtaatctcagctcatacaaaaactgcaatctggtcccactcatctaaatgcaacccacagcccggtccacatggtgagaccctgtctctacaaaaaataaaaattatgccaggcgcggtggctcacatctgtaatcccagcactttgggaggccgaggtgggtggatcacgaggtcaggagttccagaccggcctggccaacatggtgaaaccctgtctctactaaaaatacaacaaattagctgggcatggtggcgggcgtctgtaatcccagctacttgggaggctgacgcaaagaattgcttgaacctgggggatggaggtggcagtgagccgaaatcatgccactgcattccagcctggactccatctcaaaacataaattaaaaaaaaaaaaaattggctgggcatggtagcacatacctatagtcctagccacttgagaggctgagtagggtcacttgagcccaggagtttttttgtttttgttttttgagacggagtctcgttcttgtcacgcaggctggagcgcagcggcacaatctcagctcactgcaacctctgcctcctgggttcaagcagttctcccaccgcagcctcccgagtagctggaagcacaggtgcgcaccaccacaccaggctaatttttgtaattttagtagagacggggtttcaccatgttggccaggctgatctcgaaacctgacctaaggcaatccacccacctcggcctcccaaagtgctgggattacaggtgtgagccaccgtgccctgcacgagcccaggagttttgaggctgcagtgagctatgatcgtgccactgcactccacgtctctctagggtctttatcaaattttatcactatatgttttgtttcaaggtggtcctgagccctccattaaaactcttaagaccttctgggcacatttctgggttagaacaactgtgccaatttgaccttggtcttagtagctactgagtcctgactgcttgtcagaaatgtgctgaactctggcaagatgtggttgaatcatttacataggatgcatttcagatgcattcattttccttagcatcatcatcagcaaatattttagtccatggaggcagagaccatctcttggtcttttcactgtagtgcccctatagtgaaagcgaggacctggcacctgataggtattttgttgcaaaaataaatacaagctgtgtacaaggtacaggcagggtccggggacatggggttgtacaaagagaaatagacctcagattttgtgagcatataatttatgacatatcaacacacatcaaaatgcaaaggcctttgctgcaaagagcatactcatcttacagcatcttatgccttattttaatcaaccaaatatttagccgtaatagtgtataaagtgaatatatagtccttcccaagtactaggctacagtgggaatggcgctatcagtaggatgaatgatactaagttagatcagatttgctgctttttaagatttgtagagtaaattcagaacattagattttaaaaatagaaaaccagcaagtctgttggatagatgaggttgtgtcctgttatttttcagttgccttctactttcaataaaacctttgccttagtaactttgacccaacaacttatggctaggaaaaggatataaaggatataatgcaccctgaccctgaaaattcacctgtatacaattgtataattgtaaagaattttctttttacattttatttattattttatttatttattttagacagagtcttgctctgtcacccagactggagtgcagtggcacgatcttggctcattgcaacctctgcctcccgggttcaagtgaacctcagcctcctgagcagctgggactacaggcacgtgccaccacacctggctagtttttgcatttttagcagacaccgggtttcaccatgttggctaggctggtctcaaactcctgacctcaagtgatccacctaccttggcctcccaaaggattacaggcatgagccactgcgcccagcttttttttttttttttttttttgagacagagtctcactctattgctctattgctcactctaggctggagtgcagtggtgtgacctcggctcactgcaacctccgactcctaggttcaagtgattctcgtgcctcagcctcctgggtagctgggataacaggctcgtgctactactaatttttgtatttttagtagagacagtgttttgctatgttggccaggctggtcttttttttttttttttttttttgagacggagttttgctctttttgcccaggctggagtgcaatagcacgatctcggctcaccacaacctctgccttccaggttcaagtgattctcctgcctcagcctcccgtgtagctgggattacaggcgtgcgccaccacacccggctaattttgtatttttttttagtagagacagggtttcaagactatactttcagggatcatttctgtagtttgttagtagagacagcgtttctccatgttggtcaggctggtttcaaactcccaacctcaggtgatccacccgcctcagcttcccaaagtgtgctgggattacaggcgtgagccgccgtgcccagccttttttttttttttctgatacggagtctcactctgtcgcccaggctggagtgcagtggcgcgatctcggctcaatgcaagctccgcctcccgggttcacgccattctcctgcctcagcctccggagtagctgggactacaggcgcccgccaccacgcctggctaatttttttgtatttttagtagagacggggtttcatcgtgtttgccagaatggtcttgatctcctgacctcgtgattcgcctgcctcggcctcccaaagtgttaggattacaggcgtgagccactgcgcccggcccagtctggtcttgaattcctgacctcaagtgacccatccacctcgacctcctaaagtgataggattatgggtgtgagccaccacgccagccaacttaaaaaaaaattttttttagacagggtcttgctctgtcattcaggcaagagtggtagtgtgatcacttcttactgccgcctcaagcttccagcctcaactcaagcaatcctcccacctcagccacccaagtggctgggactacaggtatgtgtcaccacaccccgctaattttctttcttttttttttttttttgagacagagtcttgcactgtcacccgggctggagtgcagtggcacaatctcagctcactgcaacctccacctccggggttcaagcaattctcctgcctcagcctcccaagtagctggggttacaggcacccaccagcacacctggcctttttttttttttttttttttttttagtagagatggggtttcactatgttggccagactgctctcaaactcctgacctcatgatccacccatctcggcctcccaaagttctgggattacaggcatgagccaccatgcccggcactgctaatttcttcttatacttttttgtagagacagcgtctccctatattacccaggctgttctcaaactgcagggctcaagcaatcctccagcctcagtttcccaaagtgctgggattacaggcgtgagccactgcgcctggtcctatgtgtagtttttttttttttaagttctagggtacatgtgcacaacgtgcagatttgttacatatgtatagatgtgccatgttggtgtgctgcacccattaactcgtcatttaacattaggtatatctcctaatgctatccctcccccttcccccaaccccacgacaggccccggtgtgtgatgttccccttcctgtgtccaagtgttctcattgttcaattcccacctatgagtgagaacatgtggtgtttgttttttttgtccttgcgatagtttgctgagaatgatggtttccagcttcatccatgtccctaccaaggacatgaactcatccttttttatggctgcatagtattccatggtatatatgtgccacattttcttaatccagtctatcattgatggacatttggattggttccaagtctttgctgttgtgaatagtgccgcaataaacatacgtgtgcatgtgtctttatagcagcatgatttataatcctttgggtatatacccagtaatgggatggctgggtcaaatggtatttccagttctagatccttgaggaattgccacactgtcttccaccatggttgaactagtttacagtcccaccagcagtgtaaaagtgttcctatatttgtagttttttgaggaagctccatactgttctccttattggccgtactagtttacattcccaccgacagtgtataagagttcttttctccgcatccttgccagcatttgttatttttttgtcttctgatcatagccatcccaaatgaggtaagatgatacctcactgtggttttgatttggatttccgtaatgatttgtgatgttgagcattttttcatatatttgttggccatatgtatgtcttttgagaaatgtctgctcagattattcacccattttatttatttatttatttatttgagacagagtctcgctgtgtcaccaggctggagtacagtggcacgatctcggctcactgcaacctccacctcccaggttcaagtgagtctcctgcctcagcctcgcgagtagctgggactacaggtgtagaggtgcatgccaccacgcccagctaatttttgtatttttagtagagacgggatttcactatgttggccaggatggtctcgatctcttgacctcatgatccacctgcctcaggctcccaaagtgctgggattacaggcgtgagccaccgccaccagcctgttcacccatttttaagccagattgttggggagtttttttgctgttaagatgtttgagttccttgtatattctggctattaatcccctgtcagatgaatagtttgcaaatattgtctacccttctgtgggttgtcttttcattctttttttttttttttggaggcagagtctccttctgtcacccaggctagagtgaagtggcatgatctcagctcactgcaacctccacctcctggattcaagcaatcctcgtccctcagcctcccaagcagctgggactacaggtgtgtgccaccaggcccagctaatttttcgtattttcagtaaggatggcatctcaccatgttgcccaggctggtctcaaacgccttagctcaggtaatccacccaccttggcatcccgaagtgctgggattatagcgtgacacactacatctggcctcactctgttgatatgtttcctttgctgcgcagaatctgtttagcttaatataatcccatgtttatttctgcttttgttgtgtgtgctcttccagtcttatccataaaaatctttcctcagacaaatgtcctaaagtgtttcccctatgttttcttctagtagttttatagttttaggtcttacatttaagtctttgatccatttttagttgattgttgtatagggtgaaaggtggggatttagtttcattgtttgtattgatatccagttttcaaagtgccatttattgaagagactgaactttctccaatgaatgtctttggcacctttgccaaaaatcagttgggtgtagacatgtggattaatttcagggttctctcttctgttccattggtcagtgtgtctgtttttatgccagtaccatgctgttttgattactgttgtgttgtcatatattttgaggtctgttagtgtgatgcctccagctttgttctttttttcaggatggctttggctattcatgatcttttgtggttccatacaaattttaggatttttttcttctatttctgtgaagaatgtcattggtattttgataggaatccactctgtagattgctttgggtcatatataaataattctttttttttttttttttttttgagacagagttgctctattgcccaggctggagtgcagtggtgcagtctcagctcactgcaacctcctcctcccaggttcaagcaattctcctgcctcagcttcctgagtagctgggattacaggtgcctgccaccatgcccagctaatttttgtagttttagtagagacggggttttgccatgttggccaggctggtctcgaactcctgacctcaggtgatccacccgctttggcctcccaaagtgctgggattacaggtgtgagccaccgcgcccagccataaagaattcttaaacttgaagttggttgccattaagagcttgaagaccatggactcattgattattatagatatcattaatttttagttaggctaaaaatacacatgactgtttcaaagtatatgtaattacagaggctttgaaaaagacagtattcatgtgctagagcccaatccagaagacttaagttaaaccaatgtcaatgtcaatgtctccttagaagtgttaagacaggttggcttgttctgatgtttattgcagtttgaatggagaggcacagtgaggttaggggtaactcagttaactggtgtccagatggggccctacaggcttgtataatagtaccttatttagacaccatattctagagtatcatcatgtacttggaaattcaattgctaatatactaagtggtggtcaactttgaggaaattactcctgcttaacaaactcccagaagacagaatgccctcattttgatttatagtgacattgtgtctgtgtaggtacatccacatggaacaccaaatcataatcagaatattgcttactgagtagaaaatggcggggaagaagagttgactaggtgatcgcggtggccagggacatcaagcagagacgcttatggtatctcaaacacttactcggtggaaggtgctggatgcaccgccaatgtttgcttttcagcctccgttttctaggcttcatttctgatcaacattccttatggtcaattcagtctttttttgcctaagttgagtccttcaaggtcagcattaatacttggtctggtggccatttggtgtccttcaatatgcttctaaatattctgctctggttcttcatgtctgtttttcccatttaactttctttttgggaggccccatgtacaataccaagatttgtatatacatatatatgcataaaagtatccaaatactttatactgcttgtacatgatttaaatattcaacaatcagctgggtgtggtggctcatgcctataatcccagcattttgggaggtcaaggcgggtggatcccttgaggtcaggagtttgagcccagcctggccaacatggcaaaaccccatctctactaaaaatacaaaaattagccgggtgtgatggtgggcatctgtaatcccagctactcgggaggctgaggcaggagaatcacttgaacccgggaggccgagatttcagtgagccaagatcacacaactacactgcagcctgggcaacagagtgagactctgtctcaaaaaaaaaaaaaaaaaaaaggaaaaagaaaaaacattagctggctgtggtggcacatgcctgtagtcccagctacttgggaggctgacgtaggagaattgcagaggttgcagtgagctgagatcatgccactgcactctagcctggatgacagagcaagactccatctcaataaataaataaataaataaatattcaacaacttaagaaatggggtaagtagttcttatctgttgtttgcttaagagtatgagaatcatcgatcctcatgctattgctgatctgaattgcttttaactttttctttcagattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcaggttagtacatctttcggcctaaccatgacgtaagtatagggcccttttaatttggctaccttggtaatggtagtcgatgtgtttgtgatgctttcattcccttatacgcctgttggtccttcctagccctgactaacagggttttcagagcattgaggattggcaagaaacaaaaggcactgaagaaaaaaagccttatttgccagccatgacagccttcagtttaacacacatgtattaaacatctgctgtctgcacactcttaggattctgtagattcccttaaggagtgcagtcaacctccttttgtgaggatgtgaggatatagtcactgtctaagaagcaacatcaaaaagttgctgatggccgggcacagtggctcacacctgtaagcactttgagaggtcaaggtgggtggatcagttgaggtcaggagttcaagaccaggctggccaacatggcgaaaccccatctctactgaaaatagaaaaattagccaggcacagtgttttgcacttgtaatcctcagtacttgggaggctgaggcacgagaattgcttgaacccaggaggcggaggttgcagtgagctgagatcacaccactgcactccagcctgggcaacagagcgagacaccatctcaaaaaagaaaaaagttgcggccgggcgcggtggctcacgcctgtaatcccagcactttggaaagccgaggcaggtggatcacgaggtcaggaattcgagaccagcctgaccaacatagtgaaaccccctctctactaaaaatacaaaaaattaactgggcatggtggtatgtgcctgtaatcccagcactcaggaggctgaggtaggagaatcgtgtgaacctgggaggtggaggttgcagtaagcccagatcatgccattgcactccagcctgggcgacagtgtgagactccatctcaaaataataataataataattgctgacataccaggccccaatctcataattccaagtggaaacatgtaaatgtggatgcatgaagcaaaatgagatgtgtacaaggagataaggtgaaattacaaatattgttctgaggagaccttctgaattccaagcacctgtttccctaaaggacttcactgattcatcattacataatatactcccagacccaatcgcataaaataaaatggggcttcagtatcatttttaacatactaatcttcacttggtcctataaagggctattgaatatacatgccaggtctcatgagttcattggtctgtcagaaataattgccaagggttttctaagagaaaagggctgttgaactcacctcagaaagttaaccaagctgggcatggtggctcacgcctgtaatcccagcactctgggaggccaagatgaaaggattgcttgagccctagagtttgagactagcctgggcaacatagcaagactccatctctacaaaaaattaaaataaaaaattggccgggcatggtggtacacacctgtgatcccagctactcaggaggctgcagagcgagaattgcttgagcctgggaggtcaaggctgcagtgagccatgatcatgccattgcattccagcctgggcaacagagcaagaccccatctcaaaaaataaaaaaaataaagaaagttaaccaggctgaccttaaacttccctaagtttacacttacacactgtcatggaactgttatctctgaagttattgctgaaattaaagcccttctttaaatgtagtccatttttagccatagaatgtctttacaaggcagttctacatgtttttaccctttgggtaaggtagaaatttctcgttagccgggtgtggtggtgggcacctgtaatcccagctactcggaaggctgaggcaggagaatcacttgatcctgggaggcagaggttgcagtgagctgagattgtgccactgcactccagcctgggagacagagcaagactctgtctcaaaaaataaaaaaagagagagagagaaatttatcttgttagttctcatactatcccttacaagtttcatgaagtcattcctggttctattttaagtgagtatcaagataacttaattttttttttttttgagacggagtctcgctttgttgcctaggctggagtgcagtggtgcggtctcagctcactgcaacctccgcctcccaggttcaagtgattctcctgccttagcctcccgagtagctgggattacaggcacctgccaccacgcctggctaattttttgtatttttatagtagagacggggttttgctatgttggccaggctagtctctaactcctgaactcgtgatccacctgcttcggcctcccaaagtgctggatttacaggtgtaagccaccgcacccagccaagataacttcatttttaaattgtggaatgcttaattaccttcttagaaagataacaaatgaattaggactaaaatgttacatttggtaatctaaataaaaagaaaatcccaaagcttaagttttaggtcttttataactaaaaataaaaatgtagtcaacaagaaatttccacttaatactattataccagaagataattcttccaaatgctattattctagttgttaatgctttgagccaacatcctggctcaaaatgatgagagtggttttattatgagctacatccaagattactttgtattctaatagttaacatagtagatacatatagactaacccaaaaaaatggaatcctttttttcccacttccttttctagcatgttgttgttccttgacccaactctcaatggctcacttacgtcactgttgtcaagttaatattaagtaacctataactaggaaactaatttgccagatttaaatgtcctaggggatacagcttatagaagctaagcaaatgatgattcactttcaattatctatcccatagcaactctccttcaggagtgcataacttagaattcacattctttcatcctgtcaagaaactaactaggctgggcgcggtggctcacgcctgtaatcccaacactttgggaggccgaggtgggcggatcacctgaggtcagtagttcgagaccagcctgaccaacatggagaaaccccatctctactaaaaatacacaatcagccgggcatggtggcacatgcctgtaatcccagctacttgggaggctgaggcaggagaatcagttgaacccaggaggtggaggttgcagtgagccgagatcacaccactgcactccagcctagaaaacaagagcaaaactccatctcaaaaaaaaaaaaagaaagaaactaactagaatctgaccccaaatggagctttttaaaaagaatccaaagtagtgagtagagaaaaaataattcaagcaatcataggaaaaccaatttttattatagaataacataaattcaatacatatctaattttataggtgctcatggtgagtcagagtcatctaaaaatatagataaaagttttatactgttattctggctttctctttcaggagtctgacaaatcgtgttgaatttgaacaaatagtaaaataattcctgcactgactttgcatgaaatgtgttatggtttggttttgttttttcttgagacagggtctcactctgtcacccagtatggagtgcagtggtgcaatcttggctcactgcatcgtctgcctcccaggctcaaacaatcctcccatctctgcctgccaagtagctgggactacaggtgcacaccaccatgcctggctaatttttgtattttttgtagagacggggtttcaccatgttgcccgggctagtcttgaactcctgggctcaagcgatcctccgtcctcaacctcccaaagtgctgggattacaggcatgagccactgcgctcggccatatttatattcgacatcatctctccatgtgcaagacgtggaggaaggagtcttatggcagctaaccctgaagcctctgtgagttaaaatatcgttttgttctttcccggcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtaagtgttcctctttggctcagaagttgtctagacacttagtttgaagaacaaggaaggggaaggaggaaattaaagccaaactatatttctttctctttctttttttctttaacattaacagtgtctcagatcagtagttttgaactgagctatatggacttcaggggacctgggaatctgttctcaagtgcccaagggtttttgtttgatcttcaccaaagatgatgataatttctcttttgctgtatttgcagccaaaagatagcatttttacaaagtaagacgaatttctgtagccagtatttctcacatcagtgtctgaggatccagggctgtaggggaagtgcaacatgccagacttattcttgggggcctaagaaaacctttttccattcaaaaggagtagccagcatggtggctcatgcctgtaatcccagcacttcgggaggctgagacaggaggatcacgtgagcccagcagtttgagaccaactggggcaacatagggagactccatctctacaaaaaataaaaactagccaagcgtggtggtgcgtgcctgtggtcccagctgtaaccatcctatcactttggaggctgaggtgggaggatcacttgagcctgggaggtcaaggctccagtgagctgtgatcacaccactgcactccagcctgggcaacagagtgagaccctgtctgtttaaaaaaaaaaaaatgaaatgaacaataaaaggaggccatatattcctcatagatgatagatacacacacagttgttaagatttgcagactttaaatttttcctgtatttctgcacatatgaaatgacttatttctttctagatacaaatcttatataaaatttcatgcaataatagtttcatccattgtgaattatataaatttgaaaaaaagtgttgcaaagataaaaaaaaaaaaagttatatttttagtatcccaaacaaccactgaagtttatccagaccgttaatgaaacccatttttctttgcaacatcacctttgtccagaatgaattacttggctcctagaacttaagattcaaaaagcaaaaccaaaaatcccagatcttttaatgcatccttccagtctcaagcagtatgtgggtctcattggcttttttgacttttctttcacaggtctgggatactgctttagttttctcccaactgtaaccatcctatcacaatattttggcaaaagacgttccatagtcactgcagttgcttccacaggagaatgtttcgctgtgtttgctttcgcaccaggtaggtggactacaacagcctaagtatgaatgtggatgagagacgtcactcaggtattcttgctacgctaacttttgccaacagtatggatgactttcagtgtatgtgtaatgagacgttatttacgtctcttctccagctcatttttaggatctgtcctccctaacccccactttaggtattcagaccaccttaataataggtttcaattcctaactgggcacatatgcagtggtagggctttcttgacacatgcattccagaataatctagtaatttgcaattattcacctgttatgtcctctcgtttttcaaaagacctacattcaatgtggatttagattatgctaataaacacagcattcttatctgtgtgtagatcatctcaaaacaaaatctgtaactgagcacggtggcttacacctgtaatcccagcactttgggaggctgaggtgggcggatcacctgaggtcaggtgatcgagaccagcctggccaacatggcaaaaacctgtctctacttaaaacacacaaaaaaaggccaggtgcagtggctcatgcctgtaatcccagtactttgagaggccgaggcaggcagatcaggaggtcaggagatcgagaccatcctggccaacacagtgaaaccctgtctctactaaaaatacaaaaattggctggtcgtggtggcgcacgcctatagtcccagctactcaggaggctgaggcaggagaatcgcttgaacccgggaggtggaggttgcggtgagctgagatcaggccactgcactccagcctggtgacagagtgagactctgtctcaaaaagtaaataaataaagattgagtacattcatactgctgagtataataaatttccacagaacttataacaaaatctggatccatatttcttcttgatggcttctcctgggtcttgagtccattattgaccttatattatttcttcttcactcctgcctattcaagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccatttttgaaagagaaaagttttatttggttatgcatttatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtaatttaaatacacaaaatacaaacacttgtctactttcccttgtgaattgtgctagcttcctgttcaagccataaaaaaaacttactgccgttttatatttccattgaattttagagctgccagggattagagattacctgagccagccctcttgatttaaatatgaggaaactgaaggccaaagaattgaagctaaaggtcagatggtaaattagtggtcgattcaggactggaagctgtgtctgtagtccagattgaccctggccttttttttttttttttgagatggagtctcgctctatcacccaggctggagtgcagtggcgcagtctcagctcactgcaacctccacctcccagattcaagtgattctcctgcctcagcctcctgagtagctgggactacaggcacccaccaccacgcctggctaatttttgtatttttagtagagatggggtttcaccatgttggccaggatggtctcaatctcttgacctcgtgatccgcctgccttggcctcccaaagtactaggattacaggtgtgagccaccgcacccgccaacccaggctttttctgtcaccttgccttctctcatgctaggcaagaactcatggatttatcaccttcagagcccacctgacttttggaatgatagaactaatggacttctgtaagtcatcttcctttcttaggaaaggtatttgggaatggatagcagcactctgtaaatacctaactgatttgtacagaatatttccttgtaggagggacataggtatgtttcatatcttagatcccaaatgggtctttaaagtgtttgtgattagaaatcgtaccccctgtcaaaagatacctaaaacgggccgggcgcagtggctcatgcctctaatcccaacactttgggaggatgaggcgggcggatcatttgaggtcaggagttccagaccagcctggccaacatggcaaaaccccatctctactaaaaatacaaaagtagatgggcatggtggcagacacctctaatcccagctattcgggaggctgaggcaggagaatcgcttgaacctgggaggcagaggttgcagtgacctgagattgcaccatcgcactccacctggggcaacaagaataaaactctgtctaaaaaaaaaaaaaaaaaaaaaaaaaacctaaagtgaactcaagtgaaaataatacagttccttcctaccgaagaatattaccttttcaaagaagtatgcatcgaaatgtcccaggttttaggtcctctgctaggacaggcttagcccaagaagaacaagtatattgggtgtttgtctctttctcctctccagtctagtaaagatttctgcccttaacacccatttttctttagaaacacaaaagaaaacaaggaaggcagtgaaactgagaggcttctgaatgggatggtcgcctgggtgaggggcttatgtctaggaaggatgctgttaacggacgccatgctctcttccaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttccttttttttggagtcacactacatgtacagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagagaccgattctcttctaagattttttattgactctcacagcattcagtgtttgaggcaattaaagttataaaaactcaccaaagattcactccaaataaataattttttaacgtttatcttctgcaaaaccttttaactctactagagacacataaagtttcccaagaagtttctactgaactttttatttacttatatttattattattattttttgagatggagtttcgctcttgttgcccaggctggagtgcaatggcacaatctcagctcactgcaacctccgcctcccaggttcaagtgattctcctgtctcaccctcccatgtagctaggattacaggtgcccgccaccatgcctggctaattttgtgtatttttactagagattgggtttcaccatgttggcc

SEQ ID NO: 12409 - DNA, 16572 bp, Human
agccggcttaggtgctgctttaaaactcctaggcctggagggaagcagtggggtgctgggcttggcaggaagagggggtttcatatttctggtagatgtccgagtttccccagagcttcccaggacctggggtgaaagggagggaggctgtgggaacagcagctccgggatgcgtgggcttcactgaggtggaggctgctccctcgcagtgcctgctgcagcctagagcccccaggcggtgaggtctgagggggttggggggccagggcgcaggaggcaggataggagggggttgaaaaaggggtccaaacttggtgaggggaccttgggactttggaggcctggttatggcagcttctgtgatgaggggagtggcctgggtggtgttgaactaagataggactggctgcaccttgctaagccaaagatgtgagggtgtgtgtgtgtgtgtgtgtgtgtgtgtgtgtgtgcacgcatgcgcagatgtgcatgtctgcactgtgtgtgtccgtatgtctgtgtagcatgtgtgactctgggcatgtatgcatgtgtgtacatatgcgtgtgtctctctgtgtttgtgtgtaactgtgtgtgtgtctgctagtgtgtcttgtgtacctgcttgtatgcctctgtgtgtgagttcgtatgtttgcattgtgtgtgacggtacatatctctgtgtttgtgtgagtgtctacgcatctgtgtagtatgtgtctgtcagtgtctcttcgtgtctctggacttttttgagtgtctaagtgtgtgtctttttttttttttttgagacagagtcttgctatgtcactaggctggagtgcagtggcacgatctcagctcactgcaacctccgcctcctgggttcaagcgattctcctgcctcagcctcccgagtagctgggatttttgtatgtttagtagagacggggtttcaccacgttggccaggatggtctcgatcttctgacctcatgatctgcctgcctcggcctcccaaagtgctgggattacaggcttgagccatcgtgcccggccaagtgtgtgtctttatatgagtttgtgtgcccgtgtggtctttgtgtgggtcagtggatctctgtgtgtgtgactatccaagtgtgtgtctctgtgtgtgtgcgtgtgtctgtatgtttctgtgcttgtctgtgtgagtgtgcgctgtgactgtgtttgtgtgtgactgggtatgtgtctgtgtctgtgtgccactgcgtgtgtgtgtgtgtgtgtgtgtgtgtgtgtgtttattattcagtgtgattgcggaacttgagtcttggccttgagctctgtttgaaaggagtgttgcagggtaactgcaaaggggccgatgggaaaggcctgggggtgtgggggtggatgaggcccatgctttctccaaagctgctggttgggtgcttgttaaactcctttgtgtatgctctgtggctgctcctagcaccagcctgctcactcaggccttcacaacagcaccaatagtaactttgctgcttctgaggcattgcgaaagtctgtgtttgtatgcaggaaccctgggcaggagggtgtatccttgggtgcatttggggggcgttgggactacactgaccccagaggtctgctgcattctacaagtagtgactgagtgggctaggaggtccccctgttgacttctaagtgatgtaacaattagagacaattgtaccccattgcctggtgccacctgccctgccccgtcctgtccctcctatccctcctgtccctcctgtccttcctgccacctcctgccaggctggctctgggaagtgggtgaaaggagatgccaaggccaacacgtgggcctctggccacctcccaggggtggtgcccctctgtgacacctggtacttgggtatgaggaagggatggcttagctgcccagagaaggtggcaggtgggccaggagagacggacagcctgctgaccaccaggctccattctgtcccctccccaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaactgcaatgggagttccaggccagcaacagcgagacctcttggttcccctccatcctcacggctgtgctccacatggcaggtgagcggcctagggaggggccgatgagaaagtcctaggggttgcggggaagccacaacctccctggccttctgattccctctctctgaggccacaggctttgcctcctgggtgaattcctaaggtttcaccagatttcaccaggggcccctggctggaatccagctggactgggctggagccggggagagagtggggaggtgcctgggttgcaaagccaggcggagccttgcgtcctttctgtgggatccattccgacacaggcgtaggtgtgctggggcgctcagtgccaggctgggaagagcgctggggccagcccaccaagactctcctgctttccagctggctggtctctctgaacctcggttgcttcctctgcaatctgagggtgatgcccggcatcctgcccagctcccacatggaatagcagggaagaccactgtcttccctggaggtgctgggagctgggaaatgtatgcggctgtgaattattaatattttggagaccctcactagggcagggagtggcttcaggataggaaaggggacgcaaggaagacaccaggaatggccgggcgcgatggctcacgcctgtaatcccagcactttgggaggccgaggcggtcagatcacctgaggtcgggagtttgagaccagcctgaccaacatggagaaaccctgtctctactgaaaatacaaaattagctgggcgtggtggcgggtgcctgtaatcccagctactcaggaggctgaggcaggagaatctcttcaacccaggaggcagaggttgcggtgagctgagatggtgccattgcactccagcctgggcaacaagagtgaaactgtctcaaaaaaaaaaaaaaagacaccaggaacaagagggggacaaggcaggagccccagctctcccgggactccctgcagagaggaggttgctaagtgggggtgagggaggaaggcagcccctgtctgccccttctcctggctctgtcaccataggcctcagaggcccatgttcctggctggcttttccaggagtgtgactgcctcaccctgaccccagcgttgggagcagggcagagggagggttctctgcagtcgccgtggacacagggacctgccctcagctcctgggagctctccagggagactgcagagaccccggcctcggaggggcccggtggacagcagcccgagctgatggcccacaggcctctgcaggcatgtgtctgctggccgcagctgcccatctccccggctacctcctggctactccctccacttgccaccagcagcctgcctattattccaggtcctgccctcaaactgggagggaggtgaggctcggagaaagcgccaccctcctgggtgagctctgaatctgccacatggcctctggcctgcagggttggggcagggagtgggaatcccagagggctgcttctcacacaggcagagcagggttcctgggccaggggctaggaaccgggcacccggcggggaacctactccccagctgacttgcggctcaccacccccagcaggcatctcagcatctccatcagcatgagattcctggctggccatctctctcatgtacacatacacgtgtatgagcccgtgctcattcagagtactgtagacattttattttatgtttatttatttatttgcttatttttgagacagagtctcactctgtcacctgggctggagtgcagtggcatgatcacagcctattgcagccttaacctctcaagctcaagcgatcctgccacctcagcctcccgagtagctgggaccacaggtgtgcaccaccacacccagctaattttttttttttttagatggagtctcgctctgttgcccaggctggagtgcagtggtgcaatctcagctcgctgtaacctccgcctcccaggttcaagcgattctcctgcctcagcctcctgagtagctgggactacaggtgcgcaccaccatgcctggctaattttttgtatttttagtagagacggggtttcaccgtgttagccaggatggtctcgatctcctgacctcatgatctgctggccttggcctcccaaagtgctgggattacaggtgtgagccaccacgcccagaccatacccagctaatttttttactttttgtagagacggggtctcactatgttgctcaggctggtctcaaactcctgggctcaagtgatctacctgcctgggcctctcaaaatgctgggattacagacatgagccacggcacttgaccacagtattgtagaaatttttaaacacgatgaatcatggatactttcactgatcctttcaagtgcccctgcccctacctacgccttttagaggtaaggaaagcaagcaggcacagaacacaagacctgcccaaggctgaagagtgagttcacggcagaggaaacaccctgtgtcccgcccggccacaccaccctcagctatgcagctctggcctgcagcccagtccccacccccacccctgtgactaagggctttccccaatgtcaacttccctaagtcaggccagagtctctggcgtgaggaagctctgtgggtcagtcctctccagagccacctccccctctacaggggcagagacgccgggccaccagcctctgcttgattatgtctgcgacgggctgctcacttagtctgtcactttcttttttcttttttttttttttcggagatggagcctccctctctcacccaggctggagtgtagtggcacagtctcggctcactgcaacctccacctcccgggttcaagcgattctcctgcctcagcctccctagtagctgggaattacaggcatgcgccaccacacccggctaatttttgtatttttagtagagatggggttttaccatgttagccaggctggtctcgaactcctgacttcaggcgatccacctgcctcggcctcccaaagtgctgggattacaggcgtgagccaccacgcatggccactccatcacttttttttttttttttttttttttgagatgtagtttcactctgtcgcccaggatggagcgcatcgggttctgcctcccaggttcaagcgattctcctgcctcagcctcccaagtagctgggattacaggcacgcaccaccatgcctggctaatttttgtatttttagtagagatggggtttcaccatgttggtcaggctggtctcgaactcctgaccttaagtgatccacccacctcggcctcccaaagtactgggattacaggcgtgagccaccacacccagcctactctgtcacttttatactcacactggctcacaccacacatcccccctccaccgcagacacacacaagcatctcatgcgcacacacttccctgtccctttagttgcactctcggagagtaagttagagaagctccacatgtgcttgggtgaatggggcccctgtgaggtgccaaggagcagtctgcagctcttttctatttttttggggtgtggattggtgagaaagcagctgggagccaggcaaggaacaggcccccctccacattgagccaaacctctaggtgcagactttggtggtgctggaggtggtgtgggaggggagaacctaccctgcctgattgtctgcagaggccagtgcaaggaggcgcagaggggcccagggttcccctcagctgtagggctgggaaggtggtgggagggtgggagggatctagccagtcttcctgaggatgttgggtgtggggatggggcaggtaaaacaggatctgaaggtgcacactgtaatctagatgtcctggaacactgccccgactcctcccaccaacagacccccagcgaagtgggggaggtaaactcatgaaccaatcctgtttcacccggatagaatgagcagcctcaggtctgtgtagttcagggtcttgctccacctttcagggaatcctcatcagggtcaaacatcgcccattctgaatccttactttgtaggggaaaaaattgaggcacggagagggatcaggctttgctcaggccacatggccagtccatggcaggtgggtatcagaatccaggcctgctcgtgcccttgaaaccacctggctagttccagctggaactgccctctccagccactctcctctcccgccacctcctcattcagctgctacctgctggctgtcttctcccacagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggtgactatcacttcatctccagaatttataggcacctgctagaaagtgccaggcacaagtggacagggcaggcaggcctcttaatcttctggaactgctggctgggtgcggtggctcacacctgttatcctagcactttgggaggctgaggcgggcagatcacctgaggtcaggggttcgagactagcccggccaacatggtgaaaccctgtctatactaaaaaaaatacaaaaattagccaggcttggtggcgggcccctgtagtcccagctactcgaggctgaggcaggagaatcgcccgggaagtggaggttgcagtgagccaagatcgcaccactgtactccagcctgggcaacagagcaagaccccatctcaaaaacacaaaaaacaaagtgctgggattacaggtgtgagcccatcatgcccagccctttcacggcattttgttttaaggggactggaggaacagactatacccagaagtggttatgaggtcaagacaggctttttttgtttgtttgtttgtttgtttttaatgggagaaataacgaaggagaaggatctaggaaagaagaaaaaaaggatgatgcaggagagaggggacttgctagaggggtgcctctgagtggagaggatgcagggcagaagggagggacagccactgggggaatgggcaagccattgtcactggctagcaggcatgtgggcagctgagcataaggatggggaggaggtgttggggggcacagaggaagacaccggtagtcacctagcagggcaggcaaggcatgattgagggagctgtagtggcgtcacaggcagcctgagggcccgcctgaggccacggtcacacatgattgagaactttttctccagcatgctcaggtgtgcaggtgcagacactgagtgggtggggagcggggaaggcccctctggagaggtggcgtctgaactgagaggagagtggaaagtctggaggaagcagattccaagaaggaacagcagctacaaataacccgaggtaggggcagcttcatgtccagaggcagagaaagaagttcctgtgtcttgatcctaatgagtgacagggagcagcctgagatggcatctgagaggcgggctggagccggaccacagagagccttccagggcattgtggagactgtggattttttgtcaagtgtgatgggaagtctttggaaggtgttaagccaagagagacttaatccaatttggggtttgtttgtttttgagacagagtctcactctgttgcccaggctggagtgcagtggcacaatctcagctcactgcaacctccacaacctcagctcactgcaacctccacttcccgggttcaagtgattctcctgactcagcctcctaggtagctattacagactacaggcgcctgccactaagcctggctaatttttttgtatttttagtagagatggggtttcaccatgttggtctcgaactcctgacctcaagtgatccgccaaccttggcctcccaaagtgctgggattacaggcgtgagccaccgcgcccggcccaatttgggtttttaaaagataactctcgtgctacacctaggggaacagggatgccctggcagccttgggagggcagatctggggtggggtgcctacagggaggtggcgaggccagctgattccatggtcagtccccagggacttggagctgggtatggactagaaccagaggagggcaggtgtgtgaaatgaccactgaccccacccctgggtgcaggtggaaggccccagtgcgcctccaggctggtttcccctcttgccccgcaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccggtgaggagctgggagggagggcagccagatagtgtggtaaaaggggaacagtttagacagatctgggcccagtccagcatctccagaggttgtgctacagctggtttccaacctggcactcagagtatgaacagttaaaaacatgggtttggccgggcgcggtggctcatgcctgtaatcccagcactttgggaggccggggcgggcagatcatgaggtcaggagatcgagaccatcctggccaacatggtgaaaccccgtctctactaaaaatacaaaaaaattagttgggcgttgtgatgggcgcctgtagtcccagctactcgggaagctgaggcaggagaatggcatgaacacaggaggcagagcttgcagtgagctgagattgcgccactgcactccaggctgggcaacaaagcaagactccgcctcaaaaagaaaaaaaaaaaagcatgggtttgtgaccaggtgcggtggctcacgcctgtaatcccagcactttgggaggctgaggcgggtggatcacgaggtcaggagatcgagaccaacatggctaacgtggtgaaaccccatctctactaaaaatacaaaaaaattagctgggtgtggtggcgggcacctgtaaatcccagctactcgggaggctgacaccagagaatcgtttgaacccaggaggcagaggttgcagtgagctgagatcacgccactgcactccagcctgggtgacagagtgagactccatctgaaaaaaaaaaaaaaaaaaaaaaagcatgggtttgtgtaccaaacctcagtcctccatcatcctccctgtacctcctttttcctttttgttgagacaaggtcttgctctgtcactcaggctggagtgcagtggtgcaatcacagctcactgcagcctcaacctgccagactcaagtgatcttcccacctcagccccccaagtagctgggactgcaggcacatgccaccacacccagctaatttttatattttttatagaaatggggtttcaccatgttgctcaggctgctctcaaacccctaggctcaagtgatctgcctccctcagcctcccaaagtgctgggattacaggtgtgagccattgcgcctggccacttcctttttcctatcagtaaagtggggataaatagaatctacctccaaggaaagagcttaggagagagtctggtgtgcagtcagcatcctgcagagtttcctgtaatgatcatcccagttctcctgcttcctgcctgtgggacccaggcaagtctttttccctttttgagccacagtgccatctgcaaaatgcggacgagagcacctgccctaatcatttattcacctctgccagcctctgggtgtgcatggggatcaaaaggtctccattcccagcctgaccaacatggtgaaaccccatctctactaaaaatacaaaaaattagccgggtgtggtggtgtgcgtctataatcccagttacttgggaggctgaggcaggagaattgcttaaacccaggaggtggaggttacagtgaaccaagatcacaccactgcactccagcctgggcgacagagtgaaactccaactcgaaaaaaaataaaaggtccccatcccctgggggattaccttctagggcaggagtcaggagtgaaaacaaagagacacatcagcaaccatcctggtgatttatgatgcgagggaaaccaaatagggaagtagaggtgcacgtgagaggcagctgaagagtgtgagattctgagcaaatgagggcaggtttgtaaagccctcggtaccggggagcagtcagacaacacaaggcggcggttattagagtagatccgggaggttgagttcagcccaatggggactccgtccaagtgtggcgttggaaggcccagtttccaagggaattcttttttctttttttttttttgaggcagagtctcgctctgtcatccaggctggagtgcaatggtgtgatctcagctcactacaacctctgcctcccaggttcaagcaattttcctgcctcctcttccctagtagctgggattacaggcacgcgccacacgcccggctaatttttttttttgagacagagtctcgctctattgccaggctggagtgcagtggcgtgatctcagctcactgcaacctctgcctcctgggttcaagcaatcctcctgcctcagcctccagagtagctgggactacaggtgcgtgccaccacactcggctaatttttgtatttttagtagagatggggtttcactgtattggccaggctgttctcgaactcctgacctcgtgatctgccggcctcggcctcccagagtgctgggattacaggtgtgagccaccgctccctgccttagtttttgtatttttagtggagacagggtttcaccatgttggccaggctggtctcgaactcctgacctcgtgatccacctgcctcagcctcctaaagtgctgggattacaggcgtgagccactgtgcccatccaagggaattcttttttttttttttttaatggagtctcactctgttgcccagactggagtgcagtggtacgatcttggttcactgcaacctctgccatccaggttcaagtgattctcctacctcagcctctcaagtagctgggattacaggcacctgcccccacacctgtctaatttttgtagttttggtaggaacagggtttcaccatcttggccaggctggtcttgaactcctgaccttgtgatctacccacctcagcctcccaaagtgctgggattacaggcgtgagccaccgtgtcaggccccaagggaattctttaagcaaacaagtggggagagctcttcagaaggaggcataggtgagacctggagggtgggtgagcaaatatcccagactccactagttccctaccaccacatgcccttaagttctcttgcagcctgaggactcttcctgcccaggccagaggaggttgtgtttcttcccctcctttcattcttcaagtatctgttgagtgtctactgggtgtcagccacaattcctagtacagcagagacaaaaataaaatacctgctgtcagggaacacacagctgagttggggggaggcctggtagcactggcctaacttgatctctgttccccagggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtatgtaaccagcgtctaagacccagggttcatctgtgtgaccagtgtctgagtcctgggatcactgagtgaacactgtctcagcccagcccaggagggggacctctagctccttcaccaggggcttgggtgaagagtagcccaggaagcccgggctgtccaggctctgcaagctgggactctgccaggagctgggactttggaggctggcctctgaagatgccctgagaaactctttttttttttttttttttttgaggcggagtttcacttttgttgcccaggctggagtgcagtggcaccatctcggctcactgcaacctctgcctcccaagttcaagggattctcctgcctctgccccccaagttcaagcgattctcctgcctctgccccccaagtagctgagattacaggcatgcgccaccactcccggctaattttgtcttttagtagagatggggtttctctatgttggtcaggctggtctccaacttccgacctcaggtgatctgcccacctcagcctcccaaagtgctgggattacaggcgtgagccaccgtgcccagccagaggaacccttttctaacaactagcggaatccaggagcaggccctccggacttttttccttgggtaccagggtactcggggcccaggaacctgggtctgagccctgctcaggtttgtcccagccggctcagcgcagctggctgtgtgttgctgctcctacagctcaatgcactggaccttctcgtccagcctggatgcctctatcatttctctttgtctttctctggcctccataccgttctgaagagctcaccttcctctaggttcctcctgccctgctcttcccaagtgacccagccctcacctgtagggcagccaaggctggtggtgcagctgcccccagtgaaggtcattgggcctcgcactgggcagtgcagaggtccaggctgaggagttgagtggcgcgcccatcctggcgcctgtgcagagaacgggaggggggcccctggcttggatcctagaatcggtgaagtctgagggcccccctgcagtctcagcaggacctgctctatcaaggggcttcctccttcctttccccaccctgtctccttggcggggaggattagtgccaggtgggggaagccagacatttgactgacgggagaggaaggcttgccaggcagcccgaagactgttgtgaaaatggggctgcttttgcaagggaagctcttttactccccattcctgtcctccagaggccccccttttccctgccgtgttattggtgtcaaccctggggtaagtggctggctggactcacccctgctccccgtacacctgtgcctgtgactggcggtccaagctccccacacacacatcttgctggtgcctttccctgaagtcaccacccaggggctggctgtcatcagcccattcttgtcccagcagggtaccgagggaatgataaaacagaatgtgtttgaattacacacaaaaatgttccctgcagcaggtcataaactctgtgaactaatgaagctgacaaacagagctggagtacgtttcccctcacccttcctttcctcctagctcagcaaggggtgctcaggttcaggatgttgtttgttgattcaggctcaaccaggctccgcaagaaaaccttatcaggagattttattttcatgaacaggtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaattttaaaaaagaaaacgtaggaggttcgtttggatgagctagtctcttccggttgaaaagtctgactcggtgagcatcctgacgactccatttccttctggctccccacccagtcttacacttggctgccatcaataccacatgctctgaagggagagtgcttgcatgtactttgccaaatcctgtctgctccatctcagttgaatggaaaaggagggaggtggggctggtagataggtgcttttggtgctagtatccaccaggttttgtgtgcatcccgtaatgagcccacttcctgaaaacatttaaagaaaaaagatatcagctggagatggcagtgcgcacatgtaatcccagctactcgggaggttgaggtgggaggatcactcaaacctgggagtttgaggccagcctgggcaacacagcaagaccctgtcttttttaaaaaaaaaaaaaaaaaaaaaggctgggtgtggtggctcacgcctgtaatcccagcactttgagaggccaagatgggtgggtcactagaggtcaggagttcaagaccagcctggccaacatggcaaaaccccagctctactaaaaatacaaaaattagccaggcgtggtagcagtcgcctgtaatcccagctacttgggaggctgaggcaggaaatttgcttgaactggagaggaagaggttgtggtgagctgggatcacgccactgcactacagcctgggtgatggaatgagactcgtctcaaaaaacaaacaaacaaaaaaaacactttgggaggtcagagcaggaggatcgcttgagaccaggacttcaagaccagcctgggcaacatagagaccctgtctctacagaaaaattaaggaaagggaaaaaaaaaaagccaagtgtggtggatcatgcctgtaatcccaacactttggaaggccaagatgggagaatcacttgagaggccaccctgggccacataaggagacctccatctctacaaaaaatttaaaacttagctggacatggtggcacaggcctgtagtccaagccactcaggaggcagaggtgggaggatcccttgagccaagaagctcaaggttgcagtaagctgtgatcacaccactgcactccagcctgggtgacagagaccttgtccccccttcccaaaaaaaaaaaaggtatcaatgaatgttctgcataggaaactttcatctcacctgctcctaggcaagaatagcaatcatctctgggcagaattccttcaataaatatttactgagtatctactgtgtgccagagactgggcagaggtaagacctaccaagggctgagaattccaccccaaggagggcccctccctgaggccttaagaagggagaagactggctgggtgcggtggctcatgcctgtaatcccagcactttgggaggctgagacaggtggatcacgaggtcaagatatcgagaccatcctggccaacaaggtgaaaccccatctctgctaaaaatacaaaaattaggccgggcgcagtggctcacgcctgtaatcccagcactttgggaggccaaggcgggtggatcacgaggtcaggagatcgagaccatcctggctaacacggtgaaacctcgtctctattaaaaatacaaacattagccgggcgtcgtggcgggtgcctgtagtcccagctattcaggaggctgaggcaggagaatggcgtgaacctgggaggcggagcttccagtgagctgagatcgcaccactgcactccaacccgggtgacagagcgagacactgtctcagaaaaaaaatacaaaaattagctgggtgcagtggtgcgtgcctgtaatcccagctactcgggaggctgaggcaggagaatcacttgaatctgaggcggaggttgtagtgagccgagatcgcaccactgtactccagcctggcgacagagcgagactccatctcaaaaagaaaaaaagggagaagaccaatgagggaagatggggtggcccatctgattcagc

SEQ ID NO: 12410 - DNA, 39498 bp, Human
ggatggtctcaatctcctgacctcatgatctgcccgtctcggcctcccaaagtgctgggattataggcgtgagccaccgcggatgctgggcatctttttatgtgctgagttgccgtgtgtatatcttctttggtgaggtgtataactattcaaatcttttgcccattttttaaaaagtgggtcctcttattattattgagttcgaacgttctttatttgggatgcaagttctttagatctatgctttgcaaatattttctcccagactatcgtttgtcttttcatacattcttttaacaatgtcttttaaagaacagaagttcttaattttgataaagtccagtttatcaattgtttcttttatgaatcatgttcttcatgattttttttttttttttttttttttgagacggagtctcgctctgttgccaggctggagtgctgtggcgcgatctcggctcactgcaacctccacctcctgggttcaagtgattctcctgcctcagcctcccaagtagctgggactacaggagctcgccaccacgcccggctaatttttgtatttttagtagagaccgggttcaccatgttggccaggatggtctcaatcacttgaccttgtgatccatccaccttggcctcccaaggtgctgggattacaggcgtgaaccactgcgcccggccttctcttgtgctttcttctaaaagttttatatagtcatagtagacaccttataagtgtgctggattaaatgtgaaaatgtatgtaaagcccttagcacaaggcctggtagagactaaacaatcagctgagcctaagatggacattgactatgtaatttttataaggagcaccctcaggcccagcacacatttcctccacacagatgttgtgtcctgtcatcacagaatggcaggataccagagaagcaaaagcctccacccatatcctcatccaacctgctcctggaaccagtgaaggtgactgcagacatagagaggccatagagctacagggcagcaggagagccagccctggaaggtggcccttcccctgcagggagcactcctccatctagcctccgtttccatgaaacctggaggtctagcccaagctgtgatggggtgatggggactaggctctgtttactgagcacctactgtatgctaggcccttgggtaaggcattgaataagttagacaacacctgggcctcgggagctcacagactagcagcagaagaggccatgaacaaatgattgcgtaattaattgctagattcaggaaaggggcaacgttctggggtaggaggggatggggaagaggaagtctcagccgccgcctctgtgccaggcccctccaggctgggggtgggagggtgcgcgggcacagggacacacatgacgtcatcgtaagaggcaggggaagggtggtcctgggaggtgggggctgctctggagggctgtaagagagggtcattcactcgtggttcattcattcgagaaatattcatgcggcgcctactgcgtaccaagcaccctctaagaaggacgaacacagctcctgccctctcattatatttggggccgacaaagtggcaggaaacagccaaacaaatcaagcgtgaagatggtttcagcagagccgacggctcagaggggctgcgaccggggcaggggaccggggatgcggggcagggacacggcccacacttgctgtgcacgcaccgccctcccccaaacactttgcaaagaggtcaccgcactggctgcgagcgcgccctgagccccgggccgcagcacgcgcgcccccgcgcccgaggtcgcgcgctgcccagccccccgcccgcgccccgcgagctgcgcccgccgcgcacgacgccccctcgcgggagccctgggccgccggccgcgcgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttgggtaaggacggactggccgacggctctgccaggccggggtggtgggggtgtgagcaaaggcggcgcgcccggaccgaccccgaccccgaccccaacgggcccccggcggcggcgcggcggcgggcgaggagctgtcctgcctgcggggcccgctgccgccgctcctccttcccgggcccggggcgggcgggatccctggtgctcgcgggagacgccgctccggctcccggagccctggtttcctggggcccccggttcgtgcgccccccttcccgccccgattgctgtgacctccaggccgcggctatgccgcgaaaggctcggattgtgcgcggccgccagggcggactggggaccgtggggacggagccagggtttaaggtggccttttttggggggtggatcagggcgtggaccatctcggtggggtgcatgccgcgcctgcgatggacgttggaggaggagagggccgggaaccgggttcgtattgcctagcccggcccgtgtggagcgatgagtcgggaactgagtacctctcttccacccgggaactgcctctccttctctgcgtgaccttgggctgggagccacccaggaaatgttctcgagaaatgaggacttcaattccgaggtggggagtgtcatctcctctctcatgcctcagtttcccaatttatagacaaggtgggcggagccttcttgaggcccccttgggctctgacatttcatgaaccggtaacacccctcccactcagcatgcacctggatgcccaaggcgggtgtctgggagaaaggtctgctcccacagtgaagaggccagggtggcctccagcctagctggggggcagggtcctcagtgcagagggctgagtgggctcttgttcagacgggtggtcagggagaggatgggtcagagacagtgagcacagagggaggggttcaggtgccttgagtggcacctcatggaaagaagccctgctggggtctggagagggggtttctggggctccctgggtttggctggctgtatcccagaaactcccactcgaggttctggcctctgcaggcctggggcccgttccttgtgggcttagactaggaatgggctagactgtcagggaccccaggggctaccccaaggccagctgtgacctcagggtgcccaagcttcctcctttccttggttttcagggtctggttggtaggatggcttgggtatgtatccctggtctgcgaaggatgaccccatttaaagccttttcttctcaaatgccgtcagatgggagctgtttgagggcaggaaagcccagttcctttaacccttgtgtcggtgcctgcacagagccgggcaccccagcacatctgtgtttgtggctctgaattcatttatctgtgccagtctcctgctccccagatgccccaacagacccttgccaaaggtgggagccctggggggcacctgccggatcaggcgggtgggctgcgttcactgctttagtctgcccacccctgggcctctggcctggaagggcgaagccactggctttgtgagggggcttgtctgcttgggtcatttctgcctctgatgccttcatttagcaaagctttattgaatctgctgggccccaagggaaggcagcgtgactcagaagcagcccttgttctcgggaagccacagtcccactggggagtgagccaggtgcccccaggcagaggccgcaagagccaggagaggggtctccctgctgtggaatcaaatttcatggtgaaggtgatgtcagattgggcctggtgggatgagggtttatacatatgcacatccaggggagaggacgtggaaagcaggaggaaggatcagcccctctgagcacccatggggtgcaagaccacacacagctacctagctggttccccaacactagaggaagctgcggctcagcgagcgaggccaagtgcctggcccaaagtcactaagcatgtaagtggcagacgagcatttgagcctaggtcttcctgtctccaaagagtagttctccccctggggcagggaagaatccagaatcctggaatgtcaggattggaaaggacacaaaggtcacctggaccaaccaatgctcaaacgaccccacagcctcccagtcctgctcacacacgtggatacaaggcgctcactacctttgtcgaaccaagaggtgtctgatacaggctgattgacacctttaaaagtagctttttttcctgatcagagtaatacctgccaattattggaaagtataaaaatcacatgtgatggttgcacggtaggaatgtacttaacaccactgaaatggtgaagatggtaaattgtatgttacgtgtgttttaccacaacagaaaaagtttggtggggggtggtaatcatgtgataccaccacttagggagggctgcagtgaatagggtgctgtctccttctggtcttttcgaaactgtgtggcgtgctgagccatttaaacacatcaggagctgcgggggatgcagctggcgcctgctcttggccctcacaccacagggcagagcaagtgaagctgagctccaggaccagggtgacccgtttatcctggtgtgctggaacttcctgcctttagcattctgagaggcccttagtccagacaaacagggacaatttgtcaccctgtccaggactcctggacaacccagacccctaccacagccctggaggggccctaacagcatgtgcacatgaacctgtgattgttttttttctttttttgagatggagtcttgctctgttgcccaggctggagtacaatggtgccatctcggctcattgcaacctccgcctcccaggttcaagcaactctactgcctcggcctcccaagtagctgggactacaggcacacaccaccacgcccagctaatttttgtatttttagtagagatggggtttcaccatgttagccaggctggtctcgaactcctgacctcaggtgatccacctgccttggcctcccaacgtgctgggattacaggcgtgagccaccgcacccggcctggacctgggatttttgtaaaatttgtaaaagaaagatttttttttctgttgcttttccaaaagagggcccccaaatcatgtaagcttcagggcctcaccaacctggacccaccctggaacccaagccctctgagcccctgggtcagcctgcacagaagcagggcctccaagacctggcttgtctcttttttatttttttagagacaggatcttgctgtgttgcccaggctggtctcagactcctggactcaagtgatcctcccacctcagccttgtgagcagctgggacgatgaggcgaggcgtgggccactgcatccggcatggcttgtctcttgactaaggctttctcacctcttggtgtcatcgccccagtggcagatcagctgccactcctggcacccccaggccacagctgtgaccttcagtaagtgtcccctccccaccctctgtgcctcagtcttcccacccgaactgggctgggctgggtcagaagtgcctgatctgttgcgcggtgactgccgcctgtcagtgactcatttctttgttctaaagccagatgggaaaaaaaggagttacagcaagaagctaaactgatttaatagaaaggaccaccttttatttggagtttatattcttttttgcagggggctaagatggactatagggaatgaatatcagtgctggcagatgagttttttgtttgtttgttttttgtttttgagatggagtctcgctctgtctccaggctagagtgcagtggcgcgatcttggctcactgcaacctctgcctcctggtttcaagtgattctcctgcctcagcctcccaaatagctgggattacaggcacccaccaccatgcccagctactttttaaatttttagtagagacggggtttcaccatcttggccaggctggtctcaaactcctgacctagtgatccacccgcctcagcctcccaaagtgctgggattacaggtgtgagccaccgtgcccagtcaatgtttctttaattctctactttgacaaaatgaaaatgataaaatgtttgaaatgttgccattttcagggttcattttttaagggctttggccataataccacatggttctgtaagtggggtgggtatcttccccccgttttacaaatgacagaattaaggctcagcctggagaagtgacttgtgctagctcaaggcctgggcttgtcagagacttggtttgaacccggactgctgggctccacattctgtgtactccctgtgggttctctgcctggatatccatggcaccaaggggtggcctgaggggggcagcttcatacccctggttttattcaccccctccactccaccccccatcatcccaagtgaacactgaataaaaaagctgaacttggccaggtgaggtggctcacgcctataatcccagcactttgggaggccaaggcgggtggatcacttgaggtcaggagttcgagaccatcctggccaacatggtgaaaccccatctctactaaaatacaaaaattagctgagcgtggtggcggtcgcctgttatcccagctactcaggaggctgaggcaggagaatcgcttgaacccgggaggcggaggttgcagttagctgagatcacaccactgcactccagcctgggcaacaaaagcaaaactctgtctcaaataaaaaaaaaaaaaaaagctgaacgttttttgtaaacacagcagtttcaagataagaccccttgcctcccccaaccaacttgccatgtgccagccatggggccacaggaaaattctgggaccagcggttgttggggaagagggtccagggtagagacagaacctctggccagttctgatgttcatttgttcattccacaagtcccctgctcagtgccagctgagtgctcagtgccaccccaaggcactctcgctccaataacgagaacaggattgagtgggaagcactgtcccagaggctcgggtcactacaagaaggaattcccaaggggtggcccaggagaggcttggatgacagactcacaagctggacttcctctgagggcagtgggaagctggagagagggtcaagggtatttcggaagctcctgtggaagcttggtttggagagggctctgtggctggaaatgcgtggtcacgtccagcctgtcctctcccagtaccgggcacagccctgtcacctagacaggaaggtgggcccacggccctcgtttggcatttattgctgaccaccctggagtctttctcacctcttcacctcctgtggccggccgctccgccgcttcttctctctcaggtctaggacagggtcagctgcaaggagaccgctgggaggtgatagatttctgctgtgttttgggcacttcctcatgtccagggacagcccaggggcggcctcaagagcctgagaaagcctagggcatcaggagcagggccatcagagcgggaccttggaaaacccctacctctttcagccttggttgcctcatctgtaacatgggattggagggcctgggtttggggaggcctcgagagtttataaaaatgcaaattttggccaggtgtggaggctcatgcctgtaagcccaacactttgggaggcagaggcaggtggatcacctgaggtcaggagttcgagaccagcctggccaacatagcgaaaccctatctctactaaaattacaaaaaattagccaggcgtggtggcacgcgtctgtagtcccagctacttgggaggctgaggcatgagtatcgcttaagcccgagaggtggaggttgcagtgagccgagattgcgccatcgcactccagcctgggctaaaagagtgaaactccatttcaaaaaaagaaaagaaaaagaaagaaaggaaaagaaaatgcaagttatttttgtttgtttgtttttgagacagggtctcgctctgtcacccaagttggaatgcagtggcacgatctcagctcactgcagcctccaccttccaaattcaagcgattctcctgcctcagactcctgagtagatgtccgccaccacacccggctaatttttatatttttagtagagacagggtttcatcatgttggccaggctggtctcaaactcctgacctcaagtgatccgcctgccccggcctcccaaagtgctgggattacaggtgtgagccatcttgcctggcctgaatgcaagtttaaaaggcctgccgtaagtctgctgtggtgcgttttgttatcccctccttagatgaaaagctgaggcccagagaggttaactggagtcactgggatcggaacccatggcccctgctccagggagtccccagccatgtggggagtcccacatgagcagcgtgtgcaaagctgttgggcgggcctgagccccagggagaaaaaacagaggctgggagaggaagggaagagaggaggagaagccaggaggaggagggagggaggaagggagaggcagatggcagggctgttggagggagccacacttggcacccagaccggaagaaccagctgtcaggtgggaggggaggcagggtaggcgcagaggagtgccttggcctggagacctgaggctgcgttctgcaccctctctgccagtgattggctgtgtgactggagcaagaggcccatgctctcctggccttggtttccccatctatcaaatgggaaaaggatagttggattgctctggtggatcccgacctttccacccttgaagaaccccactcttgctcctagtggactccaggttgggaactttggattggtcagtctttaaagaagtgatgttggggccaggcgcgatggctcacacttgtaatcccagcactttgggaggccaaggtggttgactcacttgaggtcaggagtttgagaccagcctgaccaacatggtgaaaccctgcctttactaaaaatacacaaattagccgggtgtggtggtgcctaggattatgcttgtaatcccagctactccagaggctgaggcacgagaatcgcctgaacccaggaggcggaggttgcagtgagccaagatcccaccactgcattccagccaggcaacagagcaagactctgtttcaaaaaaaaaaaaagtgatgtttggagccatcccctcatgctttgtaggagcctgcagcagagggggcactgggccccaggtctatgcatgggagtgagaggtgacagcatgctgtcctcacagccctcacttgctctcggctcctcctctgcctgggctcctactttggcggcatttgaggagcccttcagcccaccactgcactgtgggagcccctttctgggctggccaaggctagagcccactccctcagcttgcagggaggtgtggagggagaggcgcgagcgggaaccggggctgcgtgcggcgcttgcgggccagctggagttccgggtgggcgtgggcttggcgggccccgccctcggagcagccggccagccctgctggcccctgggcaatgagggacttagcgcccgggccagcggctgcggagggtgtactgggtccctcagcagtgcaagcccaccggcgctgcgctcgatttctcactgagccttagctgccttccctcggggcagggctcgggacctgcagcccgccatgcctaagcctcccacccactccatgggctcctgtgcggcccgagcctccccgatgagcaccaccccctgctccacggcgcctagtcccatcgaccacccaagggctgaggagtgcgagcgcacggcgcgggagtggcaggcagctccacctgcagccccggtgcgggatccactaggtgaagccagctgggctcctgagtctggtggggacgtggagagtctttatgtctagctcagggattgtaaatacaccaatcagcaccctgtgtttagctcaaggtttgtgagtgcaccaatcgacactctgtatctagctgctctggtggggccttggagaacctgtgtgtccaaactctgtatctaactaatctgatggggacgtggagaacctttgtatctagctcagggattgtaaacgcaccaatcagcgccctgtcaaaacaggccactcggctctaccaatcagcaggatgtgggtggggccagataagagaataaaagcaggctgcccgagcttgcattggcaacctgctcagttccaaagctttgttcgtctgctcgttgcgataaattttgctactgctcactctttgggtccacactacttttatgagctgtaacactcaccgcgaaggtctgcagcttcattcctgaagccagcgagaccacgagcccaccgggaggaacgaacaactccagacgcgcggcattaagagctgtaacactcaccgcgaaggtctgtagcttcactcctgagccagcaagaccacgaacccaccagaaggatgaaactccggacacatccgaacatcagaaggaacgaactccagacgcaccaccttaagagctgtaacactcaccgagagggtccgcggcttcattcttgaagtcagtgagaccaagaacccaccaattccggacacaagagcagagcagacggcatcagctggagcctggaagggcagtcatgccctgtgtttctgggacaaacgtcccttcacagatagagttttgctcatctccccgctgctggtggagcaggggccaggtgaaggggacctggagagaggggcggctgcgtagctgggacagccccaagctgtcaaacccaagctgcaatcatgcaggagctttaacaagttggggctcctccagtacctcacagtgcagggggcaagagtccctgagccttcagcccctcccagaatgtccctgacaccttttgtaaattgcactgtaacctggcctgccccagaccttgcttcctgcagcctgttcagtgggggctgctttatccctcagaccctccctctgctgggtgtagaggtcgacagggtccttctggttcctgaggccacttacaggacattgtcccccagctttgaatctcacaccagcactgggtcgcccactccccttcatgatgagccagctcgaggccactttgcccgttcttcaaagatgcccccccaggccgggcacggtggctcacgcctgtaatcctagcattttgggaggccaaggcaggcggatcacaaggtcaggagatcaagaccatcctggctgagacagtgaaaccccgtctctactaaaaaaaaaaaaaatacaaaaaaattagccgggtgtggtggcgggggcctgtagtcccagctacccgggaggctgaggcaggagaatggcgtgaacctgggaggcggagcttgcagtaagccaagatcgcgccaccgcactccagcctgggcaacaaagtgagactctgtctcaaaaaaaaaaaaaaaaaaaaaagatgcccaccctagcttggtgtcagccctctccagcactgctcctgctccagtcctggtcattggagtgtctatttctgtgaccctttccacacctggcctcctcttcccgcatggtcttgtccgccagcctcagccaactgtcaccagctggaccctagctaggcctggccctgccttcccagtagcctctcgcactccctgatcctccatccaggcgtctcctccaaccctcctacctttccatctccctctccctcccctgatcctagatccttgggcctggggcccctgaaccactgatcttcccctgtgcactggccctcaccaccccttggtccctcctgtctccctccgcacctcccagtggccacgtgttgcagctccagcccttctgcgcatcacactcgcctggcacagctctggttaaattccgtcctaggcatcttcacacctgcccccctcatcctagactatctcccctgttctggtggcccaggccagcctggctgcagcctcgtgagcctgttcctctcacctactcaaggacacacgtccatcagttctctctccctctctctcctccaccctcagtttcgccctctctgctcttggctcttctgcgtcagcttgcaaatgtgcgtgattccccatctcaggaagacactccctcatccatttctctggtccttcagaagagttgtcaccgtctccagggtttcttctgcggtctcccacacgcactccccacgggctctctcgcccctcctcgccatcttctcaggctcattcctgaccttcacattgccaatctcatggccaactgtcattgatggatctctcagcagcgtctggcagccgtgaggggtttatgcatcctcccttgaatccaaacggctgcagaatgtggacgccctcaccccgctcgccgcagaatgtggacaccctcaccccgctcgtcctctctttaatatacatgctgagcacgggccggatgaggtgcctggtctgtagggagggctgacagtctagtggagggaaatgtggtggaaaccagttaaaatatggaggtgagcacagacccctagagagggacaggcaggtgacaccagcgttgagtcagcgttgagagggcaggagccagccaggcagagaagggggaaggaggaacagcgagggcaaatgctgaaacgcctggcagagcagagacgaggctgtcgcccctgctggggtgtacgcttggagggcgagaactgcatctgtcatagccccaggactagattgcttccaggcatctccttagggccccaactatggatggacgtggcgggaactgcactgatcggtcgtccttctagccacggttcttcaggtgtcccatctggcctttagggccctgctcaaatatcacctccctgtgaagccttcctggattctcccaagcttgcgctcccctccctgcttcccttgggctctgtggggatgactgacagagttctcaaaacagggagctttccccttctgtgcctttcttctctagaaggtgaggcagggcctgggaccagattatttccctgatgacctggaatttgcacagcaggagagaaaccaaacaacctcaggcatgcagggactggcagggcgggggcaggcactggggtgaggaaaagcagacagaactggatggttaaccctgccctttttttttttttttttttttgagacaaagtcttactctgtcacctaggttggagtacagtagcacgatcccaactcactgcaacctccacaatcggggtcaaccgattctcctgcctcagcctcccaagtagctgagattacaggcatccaccaccatgcctggctaattttttttgtatttttagtagagatgggtctcaccatgttggccaggctggtctcaaactcctgacctcaagtcatccacccgcctctgcctcccaaagtgccgggattacagccatgagccatcacgcccggccaatcctgcccttcttatcaactgagagacctcacagaacctcagtggccgcatctataaaatgggtacaacagcgcctaccccaggagtctcggggcatgtaaatgaggtctagccctgaagggctctgcagtgtttggttggcatttacacccctttccaggtggtgatgttgctcccctctcccacctcttccctgcctctgaaagggcagaggtgataagacctggggtaaagaaggccctgggggggtacaggattatggggatggtggtccagatacttctgccactgagagtaaggccctgggccagtcaagtgagccctctctgggtctttgtttcctcctttctctcctttttttttttttgtagagacgaggcctcactatgttccccaggctggtctcaaactcctgggttcaagtgatcctcctgcctcggcctcctacatagctgggattacacccatgagccaccgtgcccggccaatttccccctttttcttgaggctccaaggcccccttgaggttactcagccagaggagaggaagatggggcattctggaaagagggaggggcctgcagatcacccaggcccagcctcagcaccttggggaggcaggggtctgctcgcccaggccctgcccagcggagtccactccacccccaccaccgagcactcggggcgacagcttgcggagattacgcctaatccccagtgggtcacttccaaggctgcacaacccggtgtgaggcggggtgggggaggggcctggagcctcacctgccccacccccaccttttccccagagtgagactcttcaggaagacaaggggctgcccgacacccatcatgtgtccatgcggcttcagccgttttcctcacttgaccctgggggaagacaaggccctgttcctgtgaaggggggcccttggcagcctgactcatttctcaaagtgtgaccgctcccttcttccctcagcctttccccaggaggcaggatggatgcctgcaccaggacaagggcaggaaggctgggttcagcttgtggggagagggctcggcagcccccttttcagggagtgagctccctgtgcacaggggtgtgcaagcggaggtgccagccaaggacgctcaggaggggatgattctcctttctaccccccgtgctgcctgggcctctctgactatcagacttgctgtctactcccctcgaagcctttcctgaccctctccctgggtctgggggagagacgtgcacccaacaactgaaccaacaaataggaaagaagttatattgtgatgttaccaagaaaattaattgaggcactggagaataccttagatctggagtctggtctggagggcttctctggggaggtgtcttttgtgttgagatgtgcgtgttgaggagccagctgaaggaagatctggagaaatacaggcatcccaggcagaggaaagagccgagtgtgaatgccctgaggcagggatgaactcaggagggcttgggaggagagtgttggggagcttcagaggaaggcaggagccctggcgtttggtgggggaaggtctttacctgggcagggggcggtgggtgagcatcaatccaagagtctagacctggggggtgacatgacctgacttgggtttaaggggattgtctggctgctatgaggggacagagtgtgggggtgcaagtggacatatgggctgctgtcattgcctggagaggggtgacagtggcctgccccagggtggagggacttgacagttttgggaggaggttgaagcagctggcccgaatgtcagactggttggaggggtcgagtatgaacccaggactggggcccagcagctggtgctggggaggctgagagagatcactggggaggctgagagagcctggggcactggaggaaggactcatggcccaagcagggggacctcagggccattctagggtgatggactttatcttcagccagcggagggattgttgaggtttggagtgggtgatatccccctggctgctgcctggggactgcctggaggaggctggagaggaggctgtggtggtgtcaggcacctggacatgggcaggggccagctgcctggctgcctgcaccgcagggcagggaccagggctcccccgagccacccagctcagggatgttcctgcgcagggcgaggtagacggttccatttggagctgggaggacagagtgccgtgggctccagatgtcatctctctgcagcttatctggggaaagccagcattgtctaaaaacgtttaaaacgaggcctctaggaggttcctggcagcgttacagtgatctcagccacccccatgctggctgggcacagctcgccctgagccttcgttagccgacgccctgcagtgggtcctaggcacaccctgggtggtctgtctgcagaggggagataccatctcccctcaagtaaagtgggcctgtgcccttttgcactgcgggacacggctcaggaccagcaggcatgcctccttggtctcatgttgaccttagagtttgggattctggaattcgatccttcatggataggcagctggacacagaggtcgtgggtgagctggaggagcaggcccggatgtgaggcaggttccccatctgctgtgggtcagcgagaggcagggcctctctgagccttagcctccctgactgtgaaatgctctaagtataagactgctttgtggggatgatttgcagatttttatggggattaaaatagatgatttaggtgccttcttccattggcaccagctcctgggaggctgtgggctggttcagggtctcagagtggggacagacttgtaaataggtcccagccaggagtgaccaaggctcagggtgggaaagagtgactgggaagtgggttgtccctgaaggtgtctgggagtcactatatcccagcagcgttcagagggcaaagaggagttcgctcccattgaagatgaagaaggtaggaaggcaggtgcagagttgtcagacagcctgaggacaccacccactctcagccctctgtggtggctgcatagggtggggagggggacagatgagatcagggtaggccacaaagggcttggtgcttctggggtctctgtttctatgtgtctctgaatccagtagccaaggatcctgaaatccaagattctgagattccttctgatttgtttttctgagtttgacatagatctccaccaagcgccatctggaatccgtttttaaaaaagactcgggattggattttaaagagggcggaaaaaaaccaaagaggcttggcaggtttaccttgatgcctttttttagcgtttgctttagctcgagggaagcttgttttccctctgcttgctggtgacctgggtcctcccttggccatcaccctccatcctcccctgtttctgggcctctggctctgcctctgaagacctgtctcccttccccacagcagatccgcttgttggatgaattttccccagtgtctcggctgctgtggccagtgtggaatttcattctggtttcatttccggttctccagtgtctccttgtggctgctctgtgtgccccttgctgtccctgcagatctggccttagcaagtgactcagggatgctgcctggcacagggcaccagctttggatccagagagactcaggttcaagcctcaactccactcctgcccagctgcgagacctgtgcaggtccctagaagcggctctgaaatgggaataagaatattgagctggtggagtgaagagcatacatttctgggcacacagcaggccctgggcaagtctctgctcctcctcccatgtactgtgagtggctgaggggcagaaacctgaggcttgtgtcgtgctttgggggagctcccactcagggtggggtacagctgctaaatggagaagttaaacccttgacacagagggcagctgacagccctgcagggggttcaggagactgtaagggactgcttctgtatcctcagtgatgttccttcccttccctgagcctcagtttccccacttgtggaccagcaggctgcaagggatgtggcatttgcaggcgacggctctgctccccattatcatcattgagcctaaaccccacgacttcctcccccatctgctctttttcttttttttttctttttcacacctggctaatttttgtatttttaatagagacaggatttcatcatgttggtcaggctggtctcaagcaatctgcccaccttagcctcccaaagtgttgggattacaggcgtgagccaccgcgctcagccccttctttttttttttttttttttttttttttgagacagggtctccctctgtcccccaggctggagtatagtggtgcaatcagagctcactgcaaccttcacctcctgggctcaagcaatcctctggcctcagcctctgcctggctaatttttgtatttttagtagagatggggtttcaccatgttgcctaggctggtctcaaacccctgggctcacccaggagtgatcactcaccctcaagtgatccacctacctcggcctcccaaagtgctgggatcacaggcgtgagccaccatccccagcttcttcactcttcctctcactccctacgtcggctgtgtctgcagattctggtggctctactttcaaaatatattcaggccgggcatagtggctcacgcttgtaatcccagcactttgggaggccaaggcgggcggattgcctgaggtcaggagttcgagaccaacctggccaacatggtgaaaccccatctctactaaaaatataaaacttagccaggtgcaggagcgcacggctataatcccagctactcaggaggctgaggcaggagaatcacttgaacccgggaggcggaagttgcagtgagctgagattgcgcccctgcactccagtccgggcaacagagcgagactccatctcaaaaatatatatatatattcagcacccaccacttctccccatctccactgcctgcaccagccccaggcctgtccctcacttgggtgctgtcgtagctcctgtctgggctgcttgcattcacctttgccaccacagtcttttctctccatagcagccggtctgattcttctcaaacctaagtcgcatcaagtcactcagctgctcttcagcctgcagtgtctcctgaactcaccctggccctcaaggccaacccatcttcctcgccagcctcgcctcttggtgtctccctcacttgctcggctcctatcgtgcgggcctccatgccgctcctgaacacacacagcttctttgcacccaaggccttggcacctgtggctgcttcttccctgggctcgggtccctcactgagtcagacttctgctcaaaggtcgctgcatcagaggcctccctgggcccccagtccgcctcctcttgccctgcttcgttcttcatgacacttgtctccctcggtaagaacaggaacctcatacatcctgttcccaactgtgtcctcagcctcttgcacagggctggtacatactaggtgctcaggaaatgttgagtgaacgaacggctgatgtcaagccccagaagaggcctcccaggccccagggcagggcaggcagctcactcactccactccagcaaacaaacagcaaagtaggttgtagctcagcctgtagcaggcggtagggacagtcagtcttccagggaggaaaacatggaaaggggcctggggcgtgcaaaggtggggaggcaggtggtagggggagtggaaggaggtgagaccccaggagcggtgggcggggccagcacatgaagggccttgaccccagccttagaagcttgggttgtagaccgcgcgaggtggctcacgcctgtaaccccagcactttgggaggccgaggcgggcaaatcacctgagatcaggagttcaagaccagcctggccaacatggcacaaccccgtctctgctaaaaatacaaaaattagctgggtttggtggcacacgcctgtaatcccagctacttgggaggctgaggcaggagaaaggcttgaacccaagaggcaaaggttgcagtgagccgaggtcacaccactgcactccagcctgggcaacagagcgagaccctgtctcaaaaaaaaaaaaaaaaaaaacaaagtccccaccacagcagctcaccaggccttgtcccgctgcatgtcccatgtacttagttcccgggtcactgctccagccatattccttcccacctcatcgtacaaaaccttttcctgccttcagcctttgcactttctgttcctgtgcctggaacatacttcccccagatctttgcaggcctggctcattcttgtctccaatcggaggccctgcttcagggcccttttccctggccatcactgctccctcctggcgtttgccagggaccgccattgcctttgtgatctgttccatgagtttagtggcagtctagccttctggggctccttactccaggccacgtgcccttccttgcatgcatgacctcactgattcctcacaatgcatccttggtttcggtgctattgttgcccccacttgacagatgcagaaactgaggctcaagaggttaagtcagtggccttaggtcaccccactggtccaagtggccacactgggattcagtgggcccaggtcatctgactcagtcttgctccccacacaatcggctcccacagcagggtctcttggactgaattaccgcctggtgcccctcccagcgcagtgccaggagctgagaaacttgtgacctgtgatgaatgcctgaccgaggcgggtgtctgctggggccatacggccccgcccagtccctccgaagctattctgttcttgctctgcaccctcttggggacacatcctctccagcactttcctcctggcttctctgaggactgcctgcctctgtctcccaagagagcccagtcttaatggttcctcctctgctgtccccagggcccaggcttctgcctgcctgtttcccctcccacctcctctctgtcttcagggagcctgatattgttctgtttttggaaggagatccacacttattttcagcgctggcagcagtggggtctcctccagcccccggaagcatgtgtctgttagtaagtgttcgagaggggccttcctggtgttattcctcttttctggggccttgagagaggaaatgaacgttatgcagcccctatggggcttccaaagctctgctctgggtacttgctctaattctcccatctgccccagaggggatgttaatttttacagaggaccaatctgaggctcggagaggttaagtcacttgcctgaggctacccagcataagcagcaggccttggatttgaattggcgggtctgtatgattcctcagtgtctgaagtctctttctgatcaggagccttttctgttctggtttggtggcatctggtgacatccaggactgggcctcaggttcccaacctgacagttttctggtaggagccttggacttgttgcagtacaccagtgcaaggggttgtgtgactagcagtccctggagttgtgcagtccacggcccaagcagctggccgtgtactgcacatctcccagtgttcagagtctgccttgcttgtcttggtttgtcagtagctcaggagcccctttgacaatggctctgtcctgacttcacaggcgctccccactgtgcctctgagcaccagacttgagactgaatcgagtcgcctgatccccagtcacactgaagctaccctcccggccttcctccctgctggtcctctgcctgatcccttgggtctctgggagtaaattccatcccttcttcagggcccacctccagaggctgagagtcagcttggccaggtggaaaagaacacaggtctgggaatcaggagacctgggttcaacttcagcctgtgctgctgacaacagtgccaccttctctttctgagccttagtttttctactctgccaattgggaacactacaaatagccctctccactctaggggtgatggtgaggctgcagagcctgtgggaggcagagctgtgggccccgatgccctcacgggtctgaagtctcatggtcatggggttttcccaaatcaggactggcaaatggtggctcacgggccaccactgcccacctctgtgcccatggctgaaccatgggctgaacacagcttcagaatcctttcttttttttactgtggccagattagcctaacataccattttaatgttgtataattcagtgtacatttttttcttttttataatttgtaatttatttattgtagagatggggttttgctgtgttgcccaggctggtctcaaactcccaggctcaagcaatcctcccacctcagtcccccaagtagctgggaccacaggtgcatgccaccatactcagctaatttttgttttgttttgttttgagacggatctctgtcgcccaggctggagtgcagtggcgaatctcggctcactgcaacctctacctcccaggttcaagcaattctcctgcctcagcctcctgagtagctgggaccacaggcacgtgccaccacgcccagctaattttctttatttttagtggagatggggtttcaccgtgttagccaggatggtctcaatctcctgacctcatgatccacccgcctcggcctcccaaagtactgggattacaggtgtgagccaccgcgcctggcctatacgcagctaattttggtattttttgtagagatgcggttttacaatgttgcccacgctggttgttcctttttatggctgaaaaattgtccaatttatgaatgtaccacactttgtgtccccattcatctgctgtgcacatttaggtcagaatcccccttaacacacaacatcctaacccagaggtctctaaccatttttttttttttttgagacaatgtcccgctctgtcggctggagtgcagtgacacaatctcagctcacggcaacctccacctcccaggttcaagccattctcctgtcacaggcttccgagtagctgggattacagttgtgtgccaccacgcccagctaattttttgtatttttagtatagagacagggtttcaccgtgttggccaggctagtctcgaactcctgacctcaagtgatctacccatcttggtctcccaaagtgctgggattacaggcatgaaccaccgcacctggccggtctctaaacttttaatcgtgctcctttcaggaaaaatgtttgcaccaatcctcccattcaatgtagatttattggtttcatatatgctactactgtactaatatatcctgtgcattataaaatccatgtaaactatagacatcttacagagataagataatattaagaatgcttctcatatttttcacatacctgtcctggaatcattacccatcctgggcatcacccaggaagaaaatatgctcaactcacattgaaattgtagtttctgaggccgggcgtggtggctgactcctataatcccagcactttgggaggccgaggtgggcagatcacctgaggtcgggagtttgagaccagcctgaccaacatggaggaaccccatctatactaaaaatacaaaattagccggatgtggtggcgcatgcctgtaatcccagctactcgggaggctgaggcaggagaatcgcttgaacccaggaggcagaggttgtggtggactgagattgcaccattgcactccagcctgggcaacaagagcgaaagtccatctcaaaaaaaaaaaaaaaagaaattatagtttctggccgggcatggtggctcacgcccgtaatcccagcactttgggaggcttggggctggtggatcactggaggttaggagtttgaaaccagcctgacaaacatgacgaaactccatctctactaaaaatacaaaaaattaaccaggtatcgtggcaaacgcctatagtcccggctactcaggaggctgaggctggtcttgaactcctggactcaagtgatcctcctttctcagcctcctaaagtgctgggattacacacgtgagacaccatgcccagccaaaaagcgtgaactttagagtcaggtaccctgggtttgaagccaggttctgtcactgaccagttgtgtgactttgggtgtgttaacaatagctgagccttaactgtcttatctgcaaaatgctgatggtgcaggatgtattggcaagctattgctgcacaacaaattgccctacaacataaggcttataacaagaaatatttgttatctgacagtttctgtgggtgaggaatctgctaagcttggtgccactgcctcagggtctctcacaaggctataatcacagcatcatgtagggctgtggtttcatctgaaggctcaactgagggtagatccattcttttttttttttttttttttttttgagacggagtctcactctgttgcctaagctggagtgcagtggggttgatcttggcacactgcaacctccacctcctgggttcaagcgattctcctgcttcagcctccaaagtagctgggaccacaggcacgtgccaccacacccagctaatgttttgtatttttagtagagacaggatttcaccatgttaaccaggatggtcttgatctcctgacctcgtgatttgctcacctcagcctcccaaagtgctgggattataggcatgagccaccatgcaccacgcccagctcttttttttttttttttttttttttttttttgagacggagtttctctctgtcacccaggctggaatgcaatagcacaatctcggctcactgcaacctccgcccaggcccagcaaacagttctcctgggctcaagcaattctcctgcctcagcctcccaagttgctggatgacaggcatgtgctaccacacctggctactttttgtatttttagtagagacagggtttctccatgttggctaggctggtcccgaactcctgacctcaggtgatccacccacctcggcctcccaaagtgctgggattacaggcgtgagccactgtgcctggcctgggtggatccattcttaagctcactgacatggtattggcaggattcaattacttgtgggtgttggactgaggggctcagttccctgtgggcagttggctaaagaccctcagttccttgccatgcagtctttccaaagggtagtccaaaacacaacagctttcatcagagcaaccagggagtgggggagaagaggacgagcaagatggaggcagaaatcctttgtcacttactcccagaagtgatatcccatcacttcttgccatatcctgtagtggggtcagtgagatagcatgtgtaatatacccttgggatcatgcagggtgccctgtatctggcaggattgtgtctattgttattttctatttaatacacacacacacacacacacacacacatagatagatttttttttttttgagagtgtcttgctctgttgcccaggctagagtgcagtggcttaatcttggctcactgcaacctccacctcccaggttcaagtgattctcctgcctcagcctcccgagtagctgggattacaggcatccgccaccatgcccagctaatttttgtattttagtaaagacggggtttcaccatgttggccaggctggtctcaaactcctgacctcgtgatccacccgcctctgcctcccaaagtgctgggattacaggcgtgagcgaccacgcctggcccgagagttttttgttttgctttgttttgtttttttgagacagagcctctctctgtcacccaggctggagtgcagtggcatgatcacggttcactacaacctccacctcctgggctcaagagatcctccccctcatcttccctggtacctgagactacaggcacgcaccaccatacctgggtaatttttttattttttagtaggggcggggttttgccatgttgcccaggctggtctccaactgctgagctcaagtgatcctcctaccttggcctcccaaagtgctgggattacaggcatgagccaccacccccagcccactgttattttttcattcatcactccatctacttgccaggcctgggtaggggcctgagaccccagaccagcccacagctctgcagagggaaggagaacacaagatggggcccggcacatgccagcatctggaggagtcagcctgggggtgggggctgggcaggtccacagcccaggagggcctgtggctccttgttctttgagagtcggtccagtcccaggatatcttggtgtcagggcccaggaagacctttaggacctggctgaggggtgttggaaggggccacatctatggtcagagagtcctcagtgcctgtggctgaggaaggaagtgattgacccccacctggtgctatgtgacccacataagttaccctccctctctggggatccccctctgaaatgcctgcttaacccgggtcttgtagctcacggagggccaggcagcaggcgagggtggcagcctccccgtcccctgggtggtgtgaggcaggggtctgcccaggtctaaggtgtggccccacccccgacagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcgggtgagccccacccagcaggtaccccctgcacagagtctacagagggctgtcccggccataggaggcggctgccacccttcttcccatgtttcagatgaggaaatgaggtgcaggcgggtgaagggatggactcagggtcacatggctggcagcaggaaggatgggaccaggacagggcctgggaccccaaaataacccatgctgcccacaggcaggggagcgtggatgggattctagttccttctagtctaagggacccatggatggcactgggcatgtgccagcccccatgggttggcccgtgtttcagtggcctcttctgtgccacctccctggggcagcctcatgaggactaagcaaggcggtgactgggtgcccagtgcacagcaggggccctggagcctcagcctccccacgcctcccagccagaccttggcaggaccagggcctggacctgtggagccaacctgacctgctgccctttgcccttcagaagcagcctttggcagaggcaccctgacctctgctccgtgacttccaggaatctgattggtggatgctctcagtcaggggtccgaacccgaggcttcagcctcgctgttctgaggcttgggtccccggactgggaccaacccctagttctaagcctggagctctcaggataagccaggctgaaggcaggtcatgaggtctagttttagaaggaactagaactaaatgaatggttctcaaacttccacagagcctcagggttccctggcagtgcctctgggaggtgggctgggccccaggtgggcaccccacctgcttggcagatgcacgccttgtcctgagcaggtctgggcttctctggggagaccttggcactcacaggagattgcgtggctatgaggctcccactgctgacgcccccaggctcggctctcagtgggcccctcgctaaacctggggctctgtggggtcgcagcacgttagaagtcgaagcccagacccacccagccaagctgccatccttgccccagcctcgtcctccttcccatacctcatttgtctggcagcctgagggttggggtcttcctgcctgcagagttgcaggcatcaggggtggaccgggggggcccacgtcagcggtgtggctggacatgggggtttggcagaggctgcagaaatgcggcctgagttgattaccttctttctctgtctctccctccatcctcccctctcactgcccgtggctctcctctgactggccctgaccctgccctgtctgtggcctcctcccccctgcatctggctggcttccctcttctcgcctgcatcttctcttggctcccctctctcttcccctaccccctttgcctgtccctttgggggtgggggagcatgggagatgcactcttgaatgtccctctgttcctcggcttccccattttctccccactcaccctctcccccatgtgtggcactgcctattctgcccggtcctgggaccccccagccttctgggctttcctctggttcgtgggattctgctacctggccaaccagtggcaggtctccaagcccaaggacaacccactgaacgaagggacggacgcagcccgggccgccatcgccttctcctttttctccatcttcacctgggtgagtacagccaccgcgcaccagcccacactcgtcccctttccccactgagcccctggatgggtggcctttcgctagcctgggacccgctctgcctctgggagcccacactaccctcgctccctcttctgcctgcctgtctgcggcgctcacagtggtgctgcctccctcagcaaggaggctacagccctcgggggtagcatggtcactggagatggcagaccctcactgtggtgcagagcagccttcctgggggtcacggaccaccccccccccaaaccactctgggtaaatggtgtttattatcccctttcacagatgagaaagcagaggcctagacaggaaggtgaggcttacagggtttgaggctgggaagcagccctgcctaggagtcaggagacctgcttccgatcggggctgcctctgattttcctagcctctgtcttcccatccataaaatgagagggtaggatctgggggacacaggtgtcgacatcagatgcacatgggccaggcagggcctgagagccgtgagcaggccgggtgacacatgcgtgcctatcctaagtcctaagagggtacctctgctcggctgccaagcaggaatagggacctagagaaggcagaagtctgaatttttacatgaaatctgatcttgatatgttggaagtttattcaggtttaaacaatatattgtgtgtgtcaaacaaagtatgtctctgggcccagcaggccctgggctggcagctcggctggcccctctttcccactggtctgggtcatgtctgtttcttctctcctaatcacccttctgcagagatctggggccacatcacctccatagccccatcccaagagccctccccataacccacagctgcctcccctctggaccggcgagcacttctgggcccagcctcctgcaaggagactcttgaggctacatacaggccgccagccgtccctgtttcccccatccttctggtttgccccgggttgacgtctttttctttttgagggcccctggatatccatttttgaggggtacacccatctccccaacaatattagaagatagcatttggagggggagacccgtggttcaggccctagtgggccagccttggctgctccacccctcagtgtcctcaagactgggtaggaagaaccaggtgaccccaggggatctcagtccagagaaggtgccccagaagtggggaccacccagcctacagggaggagtttaggggcggggctcacagaggagtagtggatgatttctagccatgggtctgaagtacctgaccaacaggtgcctgcccggccccctgaagccagcctccctcctggcacctctgcagctcttccccactggcctcacccctactctctcctggcagagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattcattcattcattcattcattcttctctccagagagtcaggggcacctccagaatctctactttaagagtaattctcatgtgatgaatccttgttcctccaaaggattttggtctctggttctacacaggtttcctgcttgaggcccccagctgcctgggcaggaactcacccattcctccactctctgctggagttgaggaggctggtggagcacagacagttcccccaaagcaatgcctcaaccctgcgagggcctgagcacatcgagagtgagcttcctggcactggaggcatcccagtgcagatgcagactgcctgctgcacgctggagatgctgcagagagagcacctacactgagaaagtggggccaggggaccaccaggtccctgggctctcagtagaactcccatcctccctctgcagcccaggccagcgggggcccaggcctctcctttgctcctgtcttgtggccccttaaactggttgcccaaatgaagctttgacttagtgagggcagagagctgaacacagagacagtatgagtgcctacagccagaggcatctccctagaaggatcagtaggggtcatctgctccagccctctgcctctgtacaggaaaccagcctggatagtagagccagggagctcggggagaaccgcgtctacagacattgctctcaaggttcattcagtcagttcctgtgggctggccagggctcaagtgtaccctcagggggctcttcacctcccctgcttcttcaggctccggcgtctgagcccccagcagccaggacctcatgctaacatagtgggaaaccccagagggctacaccttatcccttagcccaatttctttagacctagtctgcctttcccaaggtgctggcactttgctttaaatacccacctcccagaaagtgcttcccctcagaactttggtcaatgagtacaatcaaaaggtaatgccctagctgggcatggtggctcatgcctgtgatcccagcactttgggaggccaaggcaggcggatcacctgaggtcaggagtttgagaccagcctggccaacatggcaaaaccccgtctctactaaaaatacaaaaattagcttggtgtggtggcgggtacctgtaatcccagctacttgggaggctgaggcaggagaatcacttgaacccaggaggcagatgttgcagtgagccaaggttgtgtcattgcaccccatcctgggtgacagagcgagactctgtctcaaaaaaaaaaagaaaaaaaaaaaggaaatgcccagtcactgggtttctggaactttgtggaataaaacgctaggtatattcactctctacctcttcactaagtggctctttaggttgttggttgacttagtgcctcgtcaggggccagtgaaagggaaggaggtgagggcgccctgacctgggaaggggtaggaccccatgtttagggaagggttctagcagtaactctgccacgggcacttccttttctaggcctcaatcttcccagccctaaaacaggggtctggagagtatcagcacattcccatcacaggcagattccccgggccgggaaagtttctggagaaggcttttgcaataaacctctaagctgcttttctaatgacaagtttgatttacttaaactttgacttagctcagtgtggtcagtgtcattgtccttaataacaatgtaattgcttttattgaaaaataatttcctaaccatgcatgtgtgctgtagacaagtctttcccaatctgagatctgtgaaaaaaaaaaaaaaaacggggcggcttcaggctaggcgcggtcacattgaatagtcagggctctgccaagtcagatgatcctgaaacttgtttcactctatttaactcagtttctcacttagaattaggttcagcagcaggtgaccgaaatcccagataacagtgatttcaacaaagtccaaggctgtggaagtggtccagggctggcatactggctccagaggtcttcggtgacccaggcatctttccttttttttagagacagggtctcactctgttgcccaggctggatcatagctcactgcagcctcaaacccataggctcaggcaatcctcccacctcagcctcctgagtagctgggactacaggccagtaccactatgcccggctaatttggtttttgtggatttttttggtagagatggggtcttgctatgttgcccaagctggccttttttttttttttttttttttttgagacagtctcactttgttgcccaggctagagtgcagtggcgctgtctcagggtactgcaacctccgcctcctgggttcaagcgattctcctgcttgcacctcccgagtagctgggattacaggtgatgccaccatgcccagctaatttttttaattttcagtagagatggggtttcaccatgttggccaggctggtctcaaactcctgacctcaagtaatctgcccatcttggcctctcaaagtgctgggattgcaagcatgagttgtcgcgcctggcctctcctgctttcaagaagaagatcagattgttattgtgcctgctgtttttcaagtgcctttaactcaacatagtcaatatgccagaggtgcatattttagcccaggctggtcttgatctcctggcctcaagcaatccttccaccttggcctatcaaagttgtgggattacaggcatgagccgcggtgcatggcccccaggcatctttcattcctacagacttggctcatggtctttgtggtcccttttggcaattagagctccagccatcacatctgtgttccaggcatcaggtcagagggtgggacagagaacatgagggtaccccattggccaaaacgtagtcacatggccatgcctagctgcaagagagacaaaagaatgactcttaggagatgctaacagtcctttgtcccgctgagaagctttttttaagaaggctgttgtgagcctttgagccatcttaacactccataatggagatctagaacttttggtagcccagactgacctctgggattgggagacaggggcaggtgatttctggggtactttctggctggatgatatggttctgggcatttccgggggtggctgcgagaacagccttccttctccacagccaagcttggtctcatgtttggtgctttgaggatctttaaccctctcctgcctgtgtcctgtgaactaaccaccactaacccagtgctcttgtctgtctctcccctaaccaccccctcccgcctgtccttgtcctcgccggcctttgtccccaggcgggccaggctgtgctggccttccagcggtaccagattggcgccgactcggccctcttctcccaggactacatggaccccagccaggactccagcatgccttacgcgccctacgtggagcccactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcatacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacagccccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcccccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaacccaccagcgattgcaagtgtgtcaccgtgtttctttgttcttcattctgcgtttggcttggatgctccatcccgtttgtctccttagacaggccatgtcttacttggttattattgtttgttaatttttcattacacaatgaacctatgaatatattatctttttaaaaagtaaaattggccgactgcagtggctcatgcctgtaatcccaacactttgggaggccaaggtgggtggatcacctgaggttaggagttcgagaccagcctgaccgacacggtgaaaacctgtctctactaaaaatacaaaaaaaaaaaaaaattagccgggtgtggtggcagacgcctgtaatcccagctactcgggaggctgagacaggagaatcacttgaaccggggaggcagaggttgcagtgagccaagattgtgccattgcactccagccttggcatcaagagcaaaaatccatctaaaaaaaaaaaggaaaattattacagttgaagccagagtctcttagcttacatgtgcacatgtccacatacatgccccatcaccatttcctatcctggttccttccccaaccaccaggagtaaacaagattagatgcttggcctcattccttccagaccatttccatgcttttacatacacatgttttacaagacatggtttttaaattgactggccttcagctgggtgccatggctcatgcctgtaatcccagcactttgggaagtcaaggtggaaggattgcttgagcccaggagttcaagaccagcctggtcaacatagtgagaccccgtgtctaaacaaaacaaaacaaaaaacctgggcacagtggctcacacctataatcctagcactttgggcagcctaggcgggcggatcacgaggtcaagagactgagaccatcctggccaacatggtaaaactccgtctctactaaaaagacaaaattagctgggcgtggctgggcgtggtgactcacacctgtaatcccagcactttgggaggctgaggtgggcagatcacctgaggtcgggagtttgagaacagcctgaccaaaatggagaaacctcgtctctactaaaaatacaaaattagccaggcgtggtggcacgtgcctgtgatcccagctactcgggaggctgagccaggagaattgcttgaatccaggaggtggaggttatagtgagccaagatcatgccattgcactccaggcctgagcaacaagagcaaaactccatctaaaaaaaaaaaaaaaaaaaaaaattagctgggtgtggtggccagcacctctagtcccagctactctggaggctgaggcaggagaatcgcttgaactcgagaggcagaggttgcagtgagccaagatcacgccactgcactccagcctggcgacggagtgagactccgtctcaaaaaaaaaaaattaaatatagttgccccgagccggcaaaaaatttacccagagcctgtaaagtaccagaaacttgctaggcgctaggagttcaacaccaaaggaggtagacagtgccctcttggagatgatcacgcagtgggggaaatgctgttaactaaacatgcaagcaaaaatatcaactgtgctaagtgctggagtgggttggaaagaatatgcgatgcaatttagatcaccctgactaaatcaaccaccaccggtcgagcaggtgaccctcgactcaagcgctctccatgagcagggtttggacgtgagcgggtgggctggtgagttatccaagctggtgagttctgcagggaggacccaggactcaggggtccccggctgggaaagagcttggaagtggtggaaggcaggtgcagtggacgcacagaagggagagagaggagaatgaggaaggacaggccagaaggtgctcatggatcccacagtgtagggcctggaggcctctgtaaagccatgaagggtgggtgaccacaacagtgcatgctctcaaaagaccactctgctggttagatggta

SEQ ID NO: 12411 - DNA, 22339 bp, Human
  misc_feature (1)...(22339): n = A,T,C or G
ccccgcccccgctgtgctccctctcagctcagggacgcgtacattttattgaagagtatcagcaccgatgcttctgcaagttgttctgcagaaaggagacctaagagctgcacacaggatgcagagagctgggtggggtcagaggcgtccatcacaaactggggaaaaagaaaaagacagcagcaatgccccgctgccaaacttcctcccctgggcctcacagacctggcactgggagagcaaaactgcattttttaattaattaatttattttttgagacgaagtctcgctccgagtgcagtggcacgatctcggctcactgaaactccgcctccagggttcagggttcaagtgattctcctgcctcagcctcccaagtaactgggactacagacacccgccaccacgcctggctaattttttgtacttttagtagagacggggtttcaccatgttagtcaggatggtctccatctcctgacctcgtgattcgcccacctcagcttcccaaagtgctgggattacaggagtaagccactgcgcccggcccaaagtagctttaaacaaagctttgggaacaagcagaagcagagggaatcgagttttatgaagacgacctggtgtcactcgtctctgtcctcatgtggccatcagttctccatactggtatccgcggcacaggccttatcaagatgagaccaaccagaggtacgtataagtccaacataaacacagacgtaccggggagtgacacagagggccaagtctgttctctgcggagcagcagccctgccctcagcaagccctctgtgagctcctaccgggggcctgggagcgcaagcaccagaaaccagacagggtgcccagcaggaagcaacactagctaagacctatttccatgagtagtatagtcactaaataacccaaacccctttctacacacagcaaggttggggactggacgtcacagaaatgtagacacacttccctaaaggaagcccatataggattacaacccaccaggagagaacggcagtttccatagtaactggaccagatggggcccatgcaccccccaagctcccggatggtgatctttctctgtgccacgatgtcagtaagattggtgcccacctataggaaaaaccacgatgcaaaaagaacaatacaaccgctgtcccgttgtgaactcctgaagagcaccgtgcccacaccttacacggtggcctgaaccccgcagacccattctccctaacgcaggaacggcgagcagggaccgacgcccatcagtagctggactcgctgtgggggcgaccagccacaggaagccgttgcgaggggagaggaagtgcccgtggagggcggcaggccccctcatcccgcgccaattatcctcagctcgggccgtcccccgctcccgaaggctggccttaagtcacgacctgacccgctgcgcctcggcgtgcacttagaggagcccggagctcttcgccaagcgcagaactgaccccccgcaactccacccgcgggggcggacacctaccgtgggccgtgtcgggggcggctcccccaggtcgcctttcccatcccgggagctcacctgtgcgaagcggtcaaggacccgagcagctaaagggtgagtccccgccccactccgggtgccccccgcgccccggtcccgtccccgcgcggaaggatatcctgcagccgtttcaccagcagcgtcttcccgacgcccgtggcccccagcaggagacacattccgtgcttcgctccacccggcacccgtagctcggcgccgcggctcaaggcccgcccaccggccactctcattggatagttctcaccttcggacttctcattggttcttagggctcattgttccaagggcgcgtccaattagcgcgcagcgttagcgggagagcggaagaccccgcctcctcgcggctctagggccggcgcggtgacgtgcgcgtgcgcgcactggagggaaaaggcggaagcggaagtcggggggcgcgccagctcgtagcaggggagcgcccgcggcgtcgggtttgggctggaggtcgccatggggcgaggcagcggcaccttcgagcgtctcctaggtaacgcgtccccacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtggggtcggcgtccgtcgggcgttggcaaatggggctctgcgagggtccgcgcagggcgccaggggcgctcggcgacctcgctcctccgcgggcccgggcattcggccgatttcctcttgaccgacgagcacccggccgagtgggccacaaggcctgagtcatgaaagtgggtgactcagtcggatgttaggctcgcacttgggcttctgacccaaaacactgggcctcgaagggtggagccggcagtgttctctctgggaccttcgagctctcttgggggctgcgggtcccagacccaccttttgttcccacactggcttcgggaagtgcctaatggtttaggaaggcgttttctcacgtttttggaggtgaaagctgatcctatctgagcctcctggaattgacgcgttttgggagggaaacgaatgttgatgtgcacgtgcccagcagcacgtggaaaatgcgtctaatgtttgggggtaggagcttgggtggtcgaatgggctgcccaagcttgcctttttgtcaagtagggttttcaaggagacttcaagtgagacaccttccttgccaagggaaccagcaagcagactgagtatctcagccacacaggtagttcagtgcttcagggatgaatccagaggttaactactgaatcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaagcacttggcttggagcaaggggcctggagtctacactgcaggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatggcacttccctgcccatcagcacgctcaggaggattctgtcatgctttttcatttggtccaaatgtctaaaggggaaggagagagtcccccccagctgctgccaagctggggtgctgcacggggcgtccagcaggataacccctccctttcatggcattttctctctcagacaaggcgaccagccagctcctgttggagacagattgggagtccattttgcagatctgcgacctgatccgccaaggggacacacagtgagttagcggggcctgtgccctgatgcggaggagcagccgtgcactaagctgggctcgcttggtgcccgttgggtctccacgacgtagctgaccgtgttaggctcttatgtggagaactgcatgggctacatgctaggattttttgacatcttggaggattaaggggttttctctgtacagcttgcagatacctggttatgtttgtatttgcttcggggttctcaaagactaagatggcagacagacttttttttttaagacggggccttgctttgtcacccaggctgaagtgcagtggcgtgatctcagctcactgcagcccctgcctcccaagctcaaacgatcgtcccacctcaacctcctgagtagctgggactacaggcattcaccatcacgcccggctgattttttgtattttggtagagatgggtttttgccgtaatgcacaggctggtctcagactcctgggctcaagcaatcctcctgccttggcctcccaaagcactgggattacaggcgtgagccactgcacctggcagcagatgagcttttctcatcttagttgctgagactatttttttcccgtttttctctgcttttatcaatgtttccttttcagagcaaaatatgctgtgaattccatcaagaagaaagtcaacgacaagaacccacacgtcgccttgtatgccctggaggtaagcagacccccgtgcctcagtggcccccagggtccctaccccctactagtcacgacagcatgagaagagtttgtcctgtggccttgcccacctccctgggcatacatcaagcaggagagtttccactcagccttgagtgcctgtgtgaacagtgccacctaggagagggtcacgctgagggagagacaggagataggggagggagtgggcaccacttcttcagccggtcctgcgtgagtaaacaccagaaggcggatgtcattgctgtgcttggcagtgagacttggcgtcacggagcggtgctgtgcaggctgctgagtctcagatgtgggttccccactggcctgacgggcctgttgaagggctgctgtcccaccgggttccccaccggccactgacgggcctgtcgaagggctctgctgtcccaccgggttcccctccggccactgacgggcctgtcgaagggctctgctgtcccaccgggttccccaccggccactgacgggcctgtcgaagggctctgctgtcccacagggaggtgggtctgtccgggaggaggaggggccctgccctgaccactggcccaacccttcccttcctgggcatctgcaggtcatggaatctgtggtaaagaactgtggccagacagttcatgatgaggtggccaacaagcagaccatggaggagctgaaggacctgctgaaggtgggtgagacgggggcatgcgggtggccacccaggctggcacctttgcttctccgggtgtttactgggcactgatgacagaacagcaccaggtgtggcggaaaatgtgcaggtgcagatcggtggtccctgcactgcgcaagctcgcactcatgagtcggagagacagggccgtgagccccaatccagggaggtcagggtttagcaggagccggcctggggtgctgtgtctggaggaccaaggtgacagcgaccctggggcctgggggaagcttccgggaggcagggcttgggcacctgctgtcttagggaaggtgagtagatgccactgggtgggcagggcaggtggtggctatcgtgtgtgagagtggctgtggtccggagggcaggctggccacatcccacaggcaggggcctgggagggctctgagcgggggcttgtaagatcggatgtgtctggcggggataagagctgttttggagagcgagggcttcatgctttcctgggcagaggaggaaaagccctccagatccccaggagattgtgccggggacatctgcagggattgtgctggggacacctgcagggactgtgatgtggactgtgatgcagtggggatgctgttgcaggtgtcaaggagaaagagtgtcccatgtagtcaggctgctccccttctgtcccgacctgtgggccagacctgggtctcataggagactccctggactcacacagctgagaacctgcccggggatcccggtggacagccaggcctctcaaaggccctcactggccactttggctggcttcctgtcccgtcctgtcctggctgagaggcggaaggtgccggagtctggccctgcccgaccctggtgctcctgagctccttcagtcaggctgcagatcctgagccggttcgctcctctggggtgaggcagggctgtgaagggaaggcgccgctgaggatgcagaggggttctggaaaggagcttaggctgaggtgcaagtgccccggagcctgcttgcagcagcctctgatcgcacgccgtcctgcacgtcacaccgggacggcgtccccgagagggccgtagacgcgaggccaggctgcgctctaaccgggggagaggatggctgcagggggtctggagcccgctctgaatttggaggcatttctggagcggctgccccccgcgtctccccggctgtgactggaaggaggggcgtggccagagccccgcagtacccctgtgttctcagccccaacaccacgctgccaccgtcaggcctgccgggtcctgcctgttggaggctgacgggaaccggggatcctggggtgggcaggtcccgtggggaaagggagagacagatggtcaggggcacagagacgcggcgttgtttggctccagcaagtagaggcaggcgtgaggtttgaactcagggtctgggaacaggttggtgcatggcccccacgccccactcggggggccctccctggcctctgtgtcagccccatctgctcagaggctgaggtctgccagctgcttcctcacaccgaggcctctggcgcctggagtgtcctgcgaccctcacccccttctccctgcctgcagagacaagtggaggtaaacgtccgtaacaagatcctgtacctgatccaggcctgggcgcatgccttccggaacgagcccaagtacaaggtggtccaggacacctaccagatcatgaaggtggagggtgagtcaggactgaggttgggaccaggttgaggcttggaactgctgggcagtcaggctcaacgggcacagtggcgaggggcctgggaagatgggttgttccctgtgttgggagggaggagggcggtggcctggagccagggaagaccgtgcatgtgagggcgggttcagaccggctcctgcctttctggacccacggcccacgggcaggggcaggcagtgatggcagacaacacacaggtgaaaaggcagcagacagcctgtttcagaatggcaggactcctgggggccgggttgggctgtgcagtcagggaaggcctctgaaggagctgtcccaagtgtcgagactggaacagaagccagagccggcgtgagcaggcaggcagcacccgtgggcagacactcagggttgaggccccagggcagaaaggtggccagcgtgccagaggagagtgcagccgggcctgtgcgccgagggcctccaggctgttgggctggagttcagggttgctgtcagcgcagcaggaggcctctggtgggttttcgtctaggtcgtggctgccaaggtgtgtttcttaagggtccctctcggccattgtggccgtggagaactaggggattgtgtagagagaggtgggggcttcaggatgcatttgggagtcttggctggtgctcagggcccactcagtgagagagaggtgggcatggctgctcacatctgtgcgggttctctgtggccctgagtctgctgaagacgaggctgagagcgtggggaatggggcaggctccaggggtggtgcgtccccgctgcaggagttggacgcttgccctgtggctgcagggtgggcaggaccagtgtggagaacacgggaagaacgcagggggcgctgcacgagctgccttggaccctcaactttggggtggtggatgctggtggtctgtgctcctgtctccttcctggggtgggagctctcctggattttttctggggtcgtgtgtcaagaatagctcaaggtcttgtcctcaggatcagtgggagccctggccagagagcagagggtgagggagccactcagcaggcggggccacgcaggggcctcatgccctgatggagtgggagcagtgtctcaggaagagggcagcagggcctggctcttgtctcccgccacagtgaggacagaggccccatggggacacccaatcttgggggcaggaggctgtctcggtgcccccagacaccttcacttgggtgcacggtcactgctgcgttgcagctgccgagagtgaggaaggggctcccggaagtcttgcaggccaggtgggagcaggcagtgactatggcttcatctctccagggcacgtctttccagaattcaaagagagcgatgccatgtttgctgccgagagagtgagtgtgggcggccgccaggggttctggagtcgggctgctcaggaagcgtgaaggggagtgctgggagcccggcttgtttgagggttggtggctgagctctcgtctgtctgggacctgaggatgcctgtgtgtcctgggcggaggcgtagcagctgtctctgcagggcgaggtggagacgtggcttgagggcctttagagtggctagggggctcgggaaaggaaaacaagcacctttgatgaggaaggaagtcccttcctcaggcctcggcagcttcaccccaggccacgccgctgggaagggccgcccggggcattgctctcgctcgtgctggggtcctctctgggtccgttgccttctgtggggcaggggaggctctgtgcctctggggctggtggggcgggaagcgtgtggtcctgactgctgcccctcctcaggccccagactgggtggacgctgaggaatgccaccgctgcagggtgcagttcggggtgatgacccgtaaggtgagttcccacctggggggctctacagccccggccagacaccaggtcccctgccgtgcacaaggccaccgtccctgctgggcctttccttcctggtgggtggttcaggaggtgagtgcagctcgcagcgggtggcagtgtggcgtcaggagggggacagtgagggcccacgtaagggcctgatgccactgcctgggccgggcccagcctcactctggaattataatgttttaaacctagggctacaggccttgccacagtcactctgctgcttgccagggccgtggggcccccttctctttgtggcttagcccatctggattcttaccctcgaggcatcttcacatcaaaaccccctccaggctggcaaccggcagtgcttggggtttggggtgtcagcagcttccagcacccactgcactcacaaaagctcttgttttatcagcagaattgatgtgtattttttccttgcccttacttttaacttaccttattttccccaaaacggtggctggcgttgagactcccgggagcatgtccaggttccccggccttagggtcttcccaggcacttgttctgcttgtcccttgccttcccccacctgtgaggcccagcttcggcatcgtacggggtggttctgggccgggtggcgcatcagggtcccccagtgcctgtgaccaggcccgcccgccccatcttacagcaccactgccgggcgtgtgggcagatattctgtggaaagtgttcttccaagtactccaccatccccaagtttggcatcgagaaggaggtgcgcgtgtgtgagccctgctacgagcagctgaacaggtgagtccccgccccccatttgggctgcaggtggggcaggctctccaggctgggttttctgtccctcttggccatggtgcctgaggcctgcagaccccagaggaccctcacagcacagcagctggaaggtcaagggaaacccagggtggccgcatgccctcggaccctgccccacactagggcaggtgggtgtgagagacagggcgccgcggctccagggaccgaggctgccccgacaaacctgttgcttgggtttgggtttgggtttgtttgcatttcaactttcggaataaaacttacagaaaagttgcaagagtagcacagagaagctgcggggccgcggccagtgcctcagcggtgggaacctgcggggccgcggccggtgcctcggcggtcggtgttttgtcgcagagtttactctgcctcccctctcctgcgcgtgcgtgtgttcacacaggttttattttgaatttgcatgagtgcagatgtcatgccccttggcactcagatcttcgcctgtgatctctgagagggacagtgctctcatggccacagcagtcactcgggactgcgctgccacccagtgctggcttctgctctgtggtccacgttccatttctgccgtggtcccagcagcgtcgctgtgggtctggcctgggttgcgtgtgtttcgtatgtgggccgtgctccctgcttggttcccttttcctggaacgtgtcactgcctccctgtctcgctctgtggacatttctgggaggtcaggccgtggccacctggccccctgttcaggtctgaggctcccacctgcttaggttcgggaagctcaggagtgaggccatgccctcctcaggacatcccatccaagccagccatgtccggtgatgggccgctgcccggaaagttccttttccttcttgtaactgagaagaacttgccttgagccacgtcaagtcccgtccgtcgcagccactgcccacaagcgtgagtctgctgtgagccagcggctccatggcagggcatcccaacgccattcctgccttcacacacacttgctgccgtttccctgtgctgggggctgtgcaggtctgcctcggtgtggacttttctcttaggaaagagccccaggtcggccgagcacggtggctcatgcctgtaatcccagcactttgggaggctgaggcgggcagatcacgaggccaagagatcaagacaatcctggccaacatggtgaaatcccgtctctactttttaagtatcttatacttaaaatttttgtattttatacaaaaattagcgggcttggtggcagatgtctgtagtcccagctactcgggaggctgaggcaggaaaatcacttgaacctgagaggcggagattgcagtgagccaagatggcgccactgcattccagcctgggcgacagagcaagactctatctcaaataaaaaaaaaagaaaagagccccaggtcaaaggtcagcgtgcgtggttggaaattgcgaccatgctgtgagcctgcggcccttggactgcctggggcgccccggaagagcttactgggcatgacagtcactgacctgtttgccccttcttgggtggggcccgtcccacagtggcggtgctgtgtttggtttcccgagtgccgtaggaaggtcttcgcaggccgggctggtgtcctgaatgtccattttcaggagaggaactggggcttaccctgagggactcacccgagcccttgtggctggtgtgatgccctcgagtcctgccctgctctgctctggagtgtggccattcggacacctgtggctgtggaaccactgtcctcactctgtggggacacttagaggagcccgcagaggtgtggttgagagctttggcgggggcagggcggtgtcagcgcatggtgacctgcagcattccttgtgcccacaggaaagcggagggaaaggccacttccaccactgagctgccccccgagtacctgaccagccccctgtctcagcagtcccaggtactcagccccctccgtcccgtgggcacctcttccccggcgccccccctcaccctccccgcttgtcctcagctgccccccaagagggacgagacggccctgcaggaggaggaggagctgcagctggccctggcgctgtcacagtcagaggcggaggagaaggagaggctggtaagccgggtggggcggggcggcctcaggaggggcccagctcccctggatgtgctgcggtggggccggaggggcgtcacgtgcacccaagtgacgccccttctgattctgcctcagagacagaagtccacgtacacttcgtaccccaaggcggagcccatgccctcggcctcctcagcgccccccgccagcagcctgtactcttcacctgtggtgagcggcccttgggctggagctccctctcctggaaggcagtagggttgatgggggacgcgggtccctgagctgatttagtcaggttggtgggggatgcgggtccccgggcttcccagagaggacagccccagcacacgggcggacatcagggcagagccccacggctccaggcacccgttgctcctggtccctggttcggcccttgggactgaggacatgggacaggctgtgggggaggcgccttgctggtgagaccccgtctcttccacacccctcccgccccacaggaactgaaggacttgctttctggggcatccacgtcacctctccctggcctcagccccgctctcagtagagggtgaagaggcagcctgttttgcagggggttgggtcggggacagcaggttgagaaagtcattttgtaggttccgtggagtggccaggccgctgcaggcccaggggtgcagaacagccctgccccagtgagccaccccttcccttcttcccttccttccgggctgtcggctggggccccacacgctggaccgtgggggctgtccagtgtccaccttgaggccccagggctggcccagtgccaccctgttcctcccatagcaaggttaggagccttgtaggacggcagtgctgtcagcctctgtggagttctaagcatctggaagaggagaaaagatggctgctcagatgccaggaaccagaggagggcacggagggagggcccaggctgcggctctggtctccaggatctgtcgcactggggacatccctgtccctgccgaagcaactggctctgtcacctgtgagactcagatgcccttttctccccagaactcgtcggcgcctctggctgaggacatcgaccctgaggtaaggcccagcatggggtgcatcctctcacggtttctggccttgggagtgaccccctcattgcctgcagctcgcacggtatctcaaccggaactactgggagaagaagcaggaggaggctcgcaagagccccacgccatctgcgcccgtgcccctgacggagccggctgcacagcctggggaagggcacgcagcccccaccaacgtggtggaggtgagggggccactcccggcattcctagtggcagggtcccttggaaggggtggatgcgggacaggttggaggccccactcattctctctcttccagaaccccctcccggagacagactctcagcccattcctccctctggtggcccctttagtgaggtaagctgtggctccctccacgggccagggcaaaacatggcctcctggcccacagcgccaggcacatggcacaggtgcctgccctaaccagagggccgtgctagagcaagggtgtctgccccagcccagccctggcctgccctgccctgccctttgtggcctctcccaatggaaactctacaccaggctgtggtccagagctcgggccactctctgtggacctaacatggacctgaatattccagagcagcctagaaccatcagatgagtccttggcgttgcctggggcttgtgggctggttggctgtcagagcacaggtccctggagagggagctggcagtggggccctgagccagctccgtcctgaccagggcttgcagctggacaaggaccccgcctccagggcctcgccttcctcagctgtagaaggggctgcttgcataaggagcagatggactctgctccaggcttgagtatagctgggtgcctccatcccaggccccaccagggaggctggctggggcgtggccgcactcatccagaaccctgctctgcctgcagccacagttccacaatggcgagtctgaggagagccacgagcagttcctgaaggcgctgcagaacgccgtcaccaccttcgtgaaccgcatgaagagtaaccacatgcggggccgcagcatcaccaatgactcggccgtgctctcactcttccagtccatcaacggcatgcacccgcagctgctggagctgctcaaccagctggacgagcgcaggcgtaggtgcccgcgccacggggcctcggctcaggggcagccaggtgttgtgagcgccatcctgggccagggcctcccctgagggtgctgagctcttgtgagtccttcattggggccgtggcttcctccagagagtgtcaacaggaggtggtctcagtgatgaccatgccctgccctgccctgccctgccctgccctgccctgcccaggaccctctgcctgcctcccccagagcccagcaccttcagagccctctgcagaaggttgggcacagggcggcccatctgcgtgtccgttccacccaggagcttctcggcactgtgccggagtggtcagggttgctctgtcatctgcccacagtgtactatgaggggctgcaggacaagctggcacagatccgcgatgcccggggggcgctgagtgccctgcgcgaagagcaccgggagaagcttcgccgggcagccgaggaggcagagcgccagcgccagatccagctggcccagaagctggagataatgcggcagaagaagcaggtgcagtggctgcccagccacaggccggggccggctgggggacctcgcagcataaccagcatgtttttgccgcacaggagtacctggaggtgcagaggcagctggccatccagcgcctgcaggagcaggagaaggagcggcagatgcggctggagcagcagaagcagacggtccagatgcgcgcgcagatgcccgccttccccctgccctacgcccaggcatgtgccatcctcccgccacccagaggcttgtgggctgaggaccaactctcaccgctgtctcttttgtccccagctccaggccatgcccgcagccggaggcgtgctctaccagccctcgggaccagccagcttccccagcaccttcagccctgccggctcggtggagggctccccaatgcacggcgtgtacatgagccagccggcccctgccgctggcccctaccccagcatgcccagcactgcggctggtaaggacgggtcggggcagagaccatgccttttatccctcgtctttattttagccgaatttacagaaaagcagtaagaatggtgcgaagggttttcccagttgccccgatgtgaatgttgtccctgctttttcctgtttccatgcaaacgcactcacacaggctttcctgctggagccgtgtttcagtccgtgcgtggcaggtactgccctctcccctgaatgcgacagcgagcatttcctgaaaccagcaggtgctgggctgccgatcctcgtctgtagcaggctcagccctcatggactgtcccagtggtgtcctgtaaacagcacgccccctgctgcgtggcatttgcccccccccccccgcctttaatctagagtgttccccagtcagcttctgtgttttgtgacatctactgtcccaagagcactggcctgtcattcggcagaccgtcctcagctcaggtttgtctggtgtctccacgcggtgaccataaggctgtgcttttctcagagtggcagccgaggtgacgtgcatcccgtcagtcccattgctggccgttcggctgagacggggtctgccaggggttttcactgtgaagtgactgttttgccctttacagatgtctcttgggggaggccttccaaataccctgggactcctcaaggtctagcattttttgctaatgttgcctgtgtttattacggtgtttgccaaatagcgccttctaattctgctgttgtctttccactggcgggaggtactcttccccactctcctgcttatcgtcagtcacagcagcgtggagacgtgtttattttttctttcaaaggtgacactcctctgtcatcactctttatttttagagtctcgctgtcatccaggctggagtgcagtgccatgatcatggttcactgcagcctcgacctcctgggctcaagcaatcctcccatctcagcctcttgagtagctgggactacaggattgcaccaccatgcctggctaattaaaaaaaaaagggctgggtgcggtggctcacgcctgtagtcccagcacattgggaggctgaggcaggtgggtcatgaggtcaggagttcaagaccagcctgccaggatggtgagaccctgtctctactaaacatacaaacattaggtgggcgtggtggcacgtgcctgtaatcccagctattcgggaggcagaggcagagaatgaattgagcccgggaagtggaggttgcagtgagccgaggttgcaccaccacactctagcctgagcaacagagtgaaactccatctcaaaaaaaatgtagaaatgaggtctttctgtgttgcccaagctgacctcaaactcctgacctcgagtgatccgccctttctcggcctcccaaagtgctgggattacaggtgtgagccaccgtgcccagccccgttactttgatgctcaaagtttcccaggtgtggccatgggaggcgtcagtggcttctctgttgcgtagggccattggtttgggttgctcctgagtttctgttgctagatactctgtgctcgtcttgtatgttctcaaccctggaagcagccatttctccaaggagcccttgttccctttagtggagggtggtctggatcttggttagaagccaagatcaagattctgggtgtgctcacagctctaggttgttagcagacagagctggaaagtgtgtatgtgaatacaagtgcacagttgtgggtgcgtctgtgtatgtgcgaatacatgcgtctttgtatatgataaaaaccgtgagtgcagccaggtgcggtggctcatgcctgtaatcccaacactttgggaggccaaggcgcgtggctcacctgaggtcaggagttggagactggcctggccaacatggtgaaaccccgtctactaaaaatacaaaaattagccaggcgtgatggtgcacacctgtaatcccagctacttgggaggctgaggcaagagaatcactggaacctgggaggtggaacttgcagtgagccaagatcatgccattgccctccagcctgggtgacagagcgagactccgtctcaaaaaaaaaaaaaaaatccatgagttaattccagtacttgcaattttaatccaatagcacagttttcttttgcattgttttcaatatactcaattgctcagccctagaatacacaaaaagtagttttaagaatgctaacctggcccactgtggagacgatgcctcctaactggagtgtaacatttgtctgtagttcttgtcatttgtagcctgaggccgtggagtccagattttgggttcagaagttactggaattcactatcccatcccattggtcagaccatgtcactcatttcaaatacagtttggttcattttttctgatttcattccattctaggattctcctcccatccttgttggtttatcttcttttttgagacgaagtctcgctctgtcgcccaggctggagtgcagtggtgcgacgtcagctcacggcattctccgcctcccaggttcaagcaattctcctgcctcagcctcctgcgtagctgggattacaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccaaagtgctgggattacaagcatgagccaccacggccccgcctatgttccttttttttagaaacgtgaaacctgaacttggttccaaaagtcacaacaaaaaggaaaactcctggccgggcggtggctcacgcctataatcccagcacttcgggaggccgaggcgggtggatcacctgaggtcaggagtttgacaccagcctgaccaacatggtgaaacccgtctctcctaaaaatacaaaaacttagctgggtgtggtggtgcacgcctgtaatcccagctgctcgggaggctgaggcaggagaattgcttcaacccaggaagcagaggttgcagtgagctgagatcgcgccactgcactccagcctgcgtgacagactatctcaaaaaaaaagtaaaactcggccgggcgcggtggctcacgcctgtaatcccagcactttgggaggccgaggcgggcggatcacaaggtcaggagatcaagacaatcctggccaacatgatgaaaccccatctttattaaaagtacaaaaaaaaattagccgggcgtagtggcgtacgcccgtaatcccagctactcgggaggctgaggcaggagaatcgcttgaacccgggaggcagaggttgcagtgagccaggattgtgccactgcactccagcctggtgacagagcaggactccatctcaaaaaaaaaaaaaaaaaagtaaaactcaagagtagggtgtcccttcctctcctccctgttgccctggctgaaccatctcccctgtcttgtttgtcacagatcccagcatggtgagtgcctacatgtacccagcaggggccactggggcgcaggcggccccccaggcccaggccggacccaccgccagccccgcttactcatcctaccagcctactcccacagcgggctaccaggtacacaggaaggccgctcctctccttccagggccagccccagccccagccccagccccagccccttctcccatggcactcattccctccgcagaacgtggcctcccaggccccacagagcctcccggccatctctcagcctccgcagtccagcaccatgggctacatggggagccagtcagtctccatgggctaccagccttacaacatgcaggtacagtgacctccaggccctgctgggggccagggtgggggagcagttgatgatgctgagggtcctttggtgaggctggcaggcactgggtgggctccaccccttctgctcctccccctccactctctgggtgctccctgtggtcacctttggattgttgcaagccagaaacatccccgcctgcctggtcacagggctactctctcacatctgacgtcttctcacaacagaatctcatgaccaccctcccaagccaggatgcgtctctgccaccccagcagccctacatcgcggggcagcagcccatgtaccagcaggtgagccattcccggggcctcacagcggcacccgcagggcaccctcaggcttcacggtttagcaatgggacccctggccccagtggggattgtcccgtacgtctgctcacagggggagacgcatacccgaggccccttctcagcagacagaacgaggacacaagtctcagggcagatacgcgcatccgcaagtgtagacaggaaaaaccgtgaatttacttgaaaggcaaaggccgcatgagctggctgcatgagctgcagtccgtggacatggattacaagcacttgtgggtctgtggctctgctgggacaaaagccttcctccctgggctggggaagggaggaccagggccatgcctgctttcctcctgcacagatggcaccctctggcggtcccccccagcagcagccccccgtggcccagcaaccgcaggcacaggggccgccggcacagggcagcgaggcccagctcatttcattcgactgacccaggccatgctcacgtccggagtaacactacatacagttcacctgaaacgcctcgtctctaactgccgtcgtcctgcctccctgtcctctactgccggtagtgtcccttctctgcgagtgagggggggccttcaccccaagcccacctcccttgtcctcagcctactgcagtccctgagttagtctctgctttctttccccagggctgggccatggggagggaaggactttctcccaggggaagcccccagccctgtgggtcatggtctgtgagaggtggcaggaatggggaccctcaccccccaagcagcctgtgccctctggccgcactgtgagctggctgtggtgtctgggtgtggcctggggctccctctgcaggggcctctctcggcagccacagccaagggtggaggcttcaggtctccagcttctctgcttctcagctgccatctccagtgccccagaatggtacagcgataataaaatgtatttcagaaagcatcagcgttttttctttaattaatttttttgagatggagtctcactctgtcacccaggctggagtggtgatctccgctcactgcaagctccgcctcctgggttcaagcgattctcgggcctcagcctcccgagtagctggactacaggtgcaccccattaccatgcctggctagtttttgtatttttagtagcgacggtgtttcaccatgttggccaggctggtcgtgaacgcctaacctcaggtgatccacctgcctcgggctcctaaagtgctgggattacaggcatgagccaccgcgcccgacctgcatcaacgtttgctcagggggcaggtggtcaggctgatggcccagctgcaggcagggtcatttccagcctgcccctccctgaggctgcgtgccagggttcatgtgtgccctccgcggctctgcactgaccccgccggtagctggggaggagtttgggcttggcgcctccttcgtgtagtggctgaagcttcccgggtgctcctcattcctgggaagggagtcgggtgatgggaacggtgggagctcagcgctccgagtctgcggccgggggccagcggggctgaaacgcgcctcctgagtgttgaaagcggcaggcgccggcctttgcacccagaggccagggcgtctcactcaccttcacatccaggcctcttaggggagcgcggctttggcttttccaggaaggaatggactccaacggacagggaaagaagaagtgtggagagacgggcaggataagcaggcactgggcccaagccgcccttggaggctctgcctgttctgatctgaaggcggaggctcagccgtgctctcccaggaagccacctgggcgtttggggctttagctaggaaagaggatgtcgcctgcggctgcgaaggcgccaaagcccagacctcgcgcctccgcccgcgacggcggcactgggggcccggagcgggcgggagacgtggattactgcgggcttcggggccctagcctcgaccgcgacgttcgctcgcatcgcgtacggacagaaacccgtgagcgctgaagaaagaacacctgaatccggagccccagcccccgtcgctcgtttgcgcgaccccaaaacccggcgggacgagggtcgcccgatgtctagctgccgccacagacgacgcttttgcgtctgcgcagcgcgccgccttgtgggtaatctcagggtgagacgaggctagcgcgaggtacggctagagcgtcatttccggctcgaatgcccggcagccgtggcggctagagcgttcctccccagctcgaatgcccggcggccgaggcggctagagcgtcgcctcctcccggggaaccgcgtgtgaccttccagcccgcggaccgatgctgccggcggccgctcgccccctgtgggggccttgccttgggcttcgggccgctgcgttccgccttgccaggtacgcgggatcctggggcggtccgggccggcaggcgggttagggggcagccgggcactgaggggtcgatccgggcgaggagggcggcggggccggcctccctgcagcggccaggccgggcttgggggtcccatcgggggcgcggggaggaggcctcccggtgcgcacgccccttccctcctgggccgtggaaagcgccggggtcggccccagatgaccttggacgattccctgctcctcccttggcctcagccttttccgcagcaaaggcccatccgtgggtgcggcgttttgcggccaggggcccccatgttttgggaggctttgcgcaggaagatgcacctaagtaatagtttcgccaccgctgggttgatgtagttcattcaaaccagaaacttgaggtttgagtggtatggctgcaaataaacacgtggctttctaaggctctttgaagaatttaaagtaacttgcaaatcttatcaatacggaccccttgaggtctgagaaccctggactgggaccaaggagctaggtaatttc

SEQ ID NO: 12412 - DNA, 476044 bp, Human
agactacagttatccattagcttggatgaagcgatcatttggaagtagttcaatgttcagattggcaagcacactcgtgaatttactttctgtgatggaaaagcatcagaaggatccatatctattcctgagagcaagggaacacaatggtatctttaagaagtgctgctgttactccctgtgaaagtgctcctgataccattgcctttcttcctttttggtagtcacaacctggagagaaaagggaggaataagagaaggagggagaacatagagaaagagagagagacttttgtttgtttctcaggaggaaaaaatggagcaatttagtagtaagggcctctttcaggatgtttagggcaacaaaatacacgataaggtggagtcggcctcaagtctccagttcccacctcattcatatttattagattcttggagcaagaaggaatcttggagaacctctctttcaactttcattttatagataaaagaactaaacattagaaaagttagatgacctgcttgaagccacacaacttcttggtgataaagacagagcagccagggctccaaattctcatcagcatcctttccacgaccaagtccttctgagacaagttgttgactatggcatgtttggtttaggttttcctgtacttgctttgttttattttaatttttaaaatttaatttaatttaatttaatttaatttatttattttaagatggagtctcactctgtcacccaggctggagtgcaagggcgcaatctcagctcactgcaacctctgcctcccaggctcaagtgattctcatgcctcagcctccccagaagctgggattataggtgtgcaccaccacacctggccatctccattctctagctcagggctccagcaggaggtgtgagtgctcaggggttatgatctgaatgcaggtggcaggcaaatggagcactactgtggtaagccgacagaacctcccttcatgtctcaaaatggctcatatttggtctgaacccattttctgtaatctacaataataatgtcttctctaaaccagtgaactgactggtacagactctgaagtattaacactcaggaagccttaatcaatcattgaattcagcaacctctgaagcaagcaatcaattgattactcataatttactatcctgggcagagcattattggatactgtcggggaagcaatagaaccataaggcttcttgctctcaaggagctgacactctaactggcagagacaaatagaaaataatgaaatgctgtatttaagtattaaatagatagtaagggcagcatggtaatagagtagtgttcctcaaccaatcccaagaacctctgctatttctcttcaaaattaaaatttttgttttaatttatatggtcatttaaaaattaatacagtggagatgtattctgtatcacttagactcttctttcgataaaaattgctctctgatttcaggggccccatttgcgctgatcaccaaatagcactgttttgtgactgtgggctaatgagtaaaggataggaatggaattattatgtaaatgctgcctttgtgctaagagaggccaaatggcatcatgacaggctgtgtgagcagaggctccactgtaattgcagcatagaaatatgaccagacaactgagtgttctcacagcacctatctaaaaagaacctgctctggagcaaacaggtgaaggtggtgatacaattcaaggaaaaacaacactgtcatacaacattaatattaggattttgagtgtttgggttatatactcacattgtatttgaatattatttggttttcattattgtataattagtattgtgacttttaggcttatttttgtaaaacatacttaattaaaattatcattaaaagaatttaaatgggctgggggcggtggctcacgcctgtaatcccagcactttgggaggccgaggcgggtggatcatgaggtcagcagatcgagaccatcctggctaacacggtgaaaccccgtctctactaaaaatacaaaaaattagccgggcgtggtggtgggcgcctgtagtcccagctactcgggaggctgaggcaggagaatggcgtgaacccgagaggcggagcttgcagtgagccgagatcgcgcctctgcactccagcctgggtgatagagccagactccgtctcaaaaaaaaaaaaaataaataaataataataataaaataaaacaaaaaaagaatttaaatgaatctgtgagagtctgtaagaatttctttttccttttatagagttcgctacaggactgaagattgagaaccagaggtataaagtatgaatgaaataaaagttcaaataaatgtaacgagagcagcttttgaatccgttgggcagcaaaagcagtgttgtaacaggaaggttcaattaccacaatccagttaaagacctgacttgcttgaaacaaaatgggaaatgtaaatggtttcatgtgcggctccctaatggtgaattggcctggatgagtatcgctgattgcactgggctcaccagagccactgagaataataacaaaagcacacctctaagcattctgtttttgctacaagcaaactctggtgctaagagcgtgagcatttgtcctcagaaaacttttctcgctccaatcagcatcatctcagggacagaaaatggaaaactctttggcaagtaattccattctgtaattctgcattacctttgattaatgaagaggggagggcacgctccaacgaaaactggtgcagggattggcatcacagtgtagatgactccatcaagaaattatttctttccttgctttgcaaattgcttctacctgactcttagtcatttgggcctatcttcttaagagaatttattttccttgctcatggtctgagacttaaagtcagagatgaatttcaataatttgtggcctcagtgtaaatttattttcattgttgcccataacatagttttttacccttctttcagaggttttccaccactagtattcttttttcaaaaattcgattgtggttaagaatatatataaaatttaccattgtaacaatttctaattgtataattcaggagtattaagtatatgcacattgctgtacaaccaatctccagaactttttcatttgcaaaacagaaactctgtacccattaaataacaactgtttctttcaccttgccctggtgcctggcaatcaccattctactttccatttctaagaatctgacgactctagatatctcttattaagtggaatcatacagtatttgtctctttgtgactggcttatttcacttagcataatgttttcaaaattcatccaagttgttgactgtgtcagagttttcttccttttgaaggctaattaatattgcattgtatgaatagatctcattttgcttatctgttcatccattaatggacacttgcgttggttttacctcttggctattgtgaatagtgctgctatgaatatgagtatgtaactatctctttgaaatcttgccttcaattattttgcatatatatgtgcaacagtggaattgttggatcatatagaaactgctacactcttttccttgtgtctgcaccattttacattcccaatcgtgcactaaagttccaatttctccttatctttatcaactcttctttccctgtctttctttccttctttctttctttttttttcttccttccttccatcttttttttctttcttcttcattctaatgggtgtgagtgatatctcattgttggttttgatttgcatttccctaatgattaacaatgttgaatatcttttcatatgcttgttggccatttatatccgtttatatatcacttttgaaaaatgtctgttcagatttttttccatttttaaatcaggttatttttttgttgttgttcagttgtaggagttcttaatatattctggatattaattccttatcagatgtatttacaaatattctctttaattccatagtttgcctttttactctgttgcttgtgtcctctgatgcacagaagttttatattttgatatatttcaatttgtctacttttacttttcttgcctgtgtttttggtgtcatgtccaggaaatctttgccaaatttaatatcataaagcttttcctctatattttctggtaagcattttatagttttaggtcttcagtttagatctttgatccattttgacgtaatttttgtatatggtgtaagatagaggtccaaattcattcttttgcatatggatgtccaattttcccagcatcatttgttgaggagacactgtttccccattgaacagtcttgacactcttgccaaaaatcatttgaccctatgtatgagagctaatttctgagctctgttattctattccattggtctatatgcatgtctttatgccagtaccacatagttttgattaatatagcattttaataagttttgaaatcaggaaatgtaaaacctccatctttgttctttttttagaagattgttttggctatttggggtcccctgtgatttcatatgaatctgaaaatggatttttctatttctgcaaaaaatgctactggtattttgacaggaattgcataaatctatagattgctttgggtagtactgatatgttaacaatattaagtcttttaactaataaacaaaaatatatttccatttatttgtgtcttatttgcttaaacattgttttgtagttttcaatatacaattttttgaccaccttggttaagttactccgaagtattttattatttttggtgctactgtaaatggaattggctgctgcttcttatttttttggattgctcattgttagtgtatagaaacacacctgcttcttttgtgttgagtttgtatcctgcaactttgctgaatttgttagttctagtagtttaaaaaataataattggtgaaatctttaaagcattctacacttaagattatgtctgcagacggagataattttacctctttctttcagtgtgtagccttttactgatttttcttgcctaatagtgctggcttaagcttccaggactgtgttgaatagaaatggcaaaagtgggcataattgtcttgtttctgatattggagacagagctttcagtctttcaccattgaatatgacgtgagctgtgaatttttcatatatggcttttattatgttagggtagttaccctctatccttagtttattgagttattttattgtattattcaaggttgttgaattttgtcaggttcttttttatatcaattgagacgactgagttttttttacccttcgttttgtaaatgtgatatactacattgattgatttgttaatgtgatatattacattgattgattttcatctgttgaatcatcctcacattccagaaataaatctcacatagtcattgtgtagaatcttttaaatatgctgttgaattctgtttggtagcattttgttgaggattttgtgtcaatattcatcagggatattagtctatagttttcctgaagtgtttttgtctgggtttggtataagattaatgctggccttatagaatgagtttggaactctttaattttctggaagagtctgaggataattagtgttaattcttctttaaacgtttagcagaatccaccagtgacacccatttggtcctggactttcctttgtttgatagttgattaataattcaatctcattactagttatagatctgattcatatttctatgtcttcctgattcagtcttggtaagtgtgatatatattcttaattcaagatctcccttgcaaaacttgcatttgattaccaagagatttgatgtgctaattatggaagttttgagcatcactttgtgacgtacagataggagcaaattaaattcttttagggtttttgtgttatttaaatttgcctaaaatttctagagctacttattgattaaactacttcaggatggttggatttaactcttattccaccatttccctatttacaaccaatttgttaaaattttaaaaattatacctcagaaatatctttcaagtatttattccctttcctagcccactgtcacttcctcatatcaggtccttagtatatcttgcacagactacctcaatagcctcataacttgtcttcctgcttcttcctgtccagctttgtcctccacaccttgatacatttctgaaacttacattatatgattataccatttttcctgcctaggaataatccatgtattttatcttcctattccacaaatttcaaaatcctcagaatagaagaatctctccaagtgtctgtaacttgccccactctagcctcatctgcctccccttcttccttgccacctacccccattccaaatttgtgccatatcaatgtattctgcattctgtagaacacccaagtttttcatttttctgtgcttttgcaatgtgctgtttctgggtggtaaaatttcactcaaacctttagagataaggcaaaagtcatttctttcctgagacttctcagacaccaaatgttatgttatgtccttcaaggtcatgccccaaggcacatggaacttagtagaatgcaagtacttatatcaatatgtcttataattattaccctaatgttcaccccacaaaactctgatcctttaagggtaggatatgtccacaacttatctttgtgtagagtgtgaaacacagtgtcccgtatattcacagtgtccaaatacagctagcacagaatagctagctacttaatgaatgcttatttaatgcgtgtttattctgggggatgaataacattgaaaaagacctgaacttcattgctccttctccactgactacttatgtgaccttgggtgagtcatttatcttctcaaggtctgtttcttaatttgtgagtgaaagatgatgacagataatctccaacatcccttacagctctgacatcttattattgccattttcatttgtgcaaaagacaaccttaattattaaaataacttcattgtgcatgacactcaaggaaaacaaaaccataaccaaatttctttaccttatttgactttacatttcatgttcattcttgagtggaaccattctaatctttatgagcattcccaattttacctctatatactgaattaaaatgttttatgttgtttgtttaaatctatagctctgtttatatttttccagtgttctaaaccataggtttataatacctctgtccctggtagaggcacaagagaagatatattttaaaataatacagtatttaataaaataatatttatcatttaaaatgtcttacaagtgtaacactataaataatttaaaaattaagagttatctttaaagtcaactaatttcctgttttgtgttccttttctttgtttattcatattctatatagtttcaaggatggtatcacttaattttatatcctagtgttttcatttagcacatcatcagcaatttgtattatttctacttagacccacaactattattttggaggtctgcataaggttcctccactggacattgaaaaatttacttaattattttcctattgttgaccagctaagtcactttctttaatttaacattataaacaattctataacaaatatctttctttacttggaatcttcatttgggatttttttcttaagatgcatttctagaagtgagattatttgattaaagagtaatattgctaattttatagttaagtttggaaattatccataaaagtataattttagggacaagatagtccaaatatcttattttatatggattattatgaatatttcaatcaatatatcaagtatttttctgaatttatttgtgccatgttataagaatgcatttggctgcaagtaaagaaaaaaataaatccacttaacagtggcttatacagatcagagtttaatttccttacataataaaaagtctagcagtaggtggactgtagtcggctggcaactgctcaaagaagtcatcaaggactaaggcctattacattttctgactcttccatgcttagtgaatggttttcattttcatggttgcaagacggttattatacttgtgggcattgagctcctctctaagcatgaagaaggaaaagggcaaaggactgagagggcatattatctttctgtactaataaaacacatctccagaagaagctccatttgattattttggctttgatctccttgttcagaaccaggtcacatagtcacacttcacttaagggcagtggaaaagaaagcatttcatcttgtacatctctatattctaggaagatggagaaagggaatgtgaatggcttttaagttaaaaggtcaaggtgtttgccacttgactttcattactctacgtaaaaagaagtgaagacgaaaggaaatggttttcatttattacaattaaatggtagtctcttccagggaagttatctaattgtatccatctttgaatccttagcattagcagaatgttcatacacgaagaggctcaaaaagtctttgtaatatgctgaaacagtaaatatatgttccctgcaaatctaaatggattaattaaaaagtcatattagattagcatcattttccttgatagcatttcttgtttgataccttagggaaatgcaataaaaagaatattaggcatagtttaccaaccaaactttgcacacaaatacaggaatgcagattgaatgagagtccagctgaatgttttaatatggattttaataactatacacagaagttattaattagtggaacattggaatgtttagcaccaaaagagcagggtctttagtttttcctcactgaattactggtaccttgaacagtacattataattacaagtagacatttaccaactgcctgtaaaacaaatgactgtcagaatgaattaaggtttccaggagtgcattgcacattctgaggccaaccttatcctttttgggaggaaatttattggtgacttcattgagtttgctgcagatcaggcctgctcttgataagtaaccaagaaaaatagtgaatgcaatgaatgtcagactctggatcccaaagacttttgcctgagagagtgagagtcagaacacagcaagaggaaattgagtgggaatgcaagctaattcctcaatttgccccccgcaaactagctgctcaagtacagtcattgtaaattatacataggtttttttggtacaccagcagttcgaatgaggaataatgataaaaaaaaaaaatggaaagcactttatgacagagcctgttgaaaatgactaggttgtcttagaaagtagtgactcctctgtaacttcaattgtttaagtctaaaaaaaaaaatcacatgaagagatgctgtgggagcaccatgcatgagagggggctggactgggtaatctaaagacctcttccctccttgcaatataatagttctatttttagttaaatctagcttagacactgcctgttgaaatcaattcctatcaatagaacctaaaatatttttctccatactaattcagcaagctcccactgtagcttcatattttttatggccatgatataagtctgacaatcttcaactctaggttgaacacgggaacagtttaacacagacacagttctatgttagctaatggctgagaagggcagtttagggagcgagaggcttctctgatgagataacatgagaagtaagacctgaatgataagaagaattggagcacataagacacaatttatgtccccagaatggctggcttccatctattctctcacacctttgtgtctttgcttgctcagtggccagcccaagccaccattgccattgccagtgcctcatatcccaactgtgccagtgacctcagcctctcccagtgactggattccactgagattgcattagaaggagactcacaagtttggtgctcaggtgcaatcagtctgtatcctcagaggttcctccaatcactgggggatctgggttccctagcagttgccataaagagccagtaacagaacctggaggtgagggtgaattaattagttctctaagggacaaacttcaaccagtttcaacaggagacaagaagacattggcagagaatctccactctctcctgtggacagaatgtttctggatataatgatgtaggtcctgtctggaagaagtgctggtgaccaagaaagcaggtatgttgttttgtgatgctgtagtcattcataactcgccaccttgaatttactttcccctccttttcagccttgattctctttttccttcattcttgagtcctggaattacaacttcacataaagtcttggcttgtaagttttgcctcaggatctgttttctagaaaactcagacaaaaacaaacacaatacaaaaatatgaaccatagttcaggaattgtgctcaggttcatggaggtgctcaggtttctgccgtatattcacaggggcaccgcaggatatattaaaattttgaaagaaactcagagatacttgacatttgttagacaccatgcatactactgactcaatgtagttgatagtttcaacactagattacactacattctttcagtgacatcattatgtttgcaaagctgggttttggtggttgcaatttcatgtggtattaaggagcaataccacatgaaaattagtgtggaacaggaaatgaaggtggtggtgtctaatatgatcctaagatttgagaggttgtgtcatgcccattactatcccattggtaagtgattgtggctgcttacaaatgaagtacaaacattttttctttcaatttatgtttttttcaaatagctactaatgttgtcaagaagtaaatgtttattgaattgttagcatctgaatacttaataaacataagtgttaggttcatcttcataaatctcagcctagaagtgccaggaaaaataattactgagacattcagtaaagggtggtgtgaactgagaaagtctgggaacctctgaggtagagctttacgggcaggcaggaataagctcagcatgtgatgtggtttggctctgtgtccccacccaaatctcatctcgaactggaatccccatatgtcgagggagggacctggtgggaggtgattggatcatggaggtggttccccatgctgttttcaagatagtgagtgagttctcacgagatctgatggttttatgaggggctcttcccccttcactctctgctctgcctctcctacggccatgtgaagaaggtcttttctttcccttcatcttctgccatgattgtaaatttcctaagggttccccagccatgcagaactgtgagtcagttaagcctctttcctttgtaaattacccagtctcggggagttctttatagcagtgtgaaaatggactaatacagcatgtatgagaaatgggatgttaggagagctgagtcagaaggtgagggactgcagggatggaggaggcacaggagagaccaagtggggccttgtaggctttgacaagagagctcagttatcatttctgtacaacatgatacatcctggaaacttaatcctggaaacttctttttctttttttcctcagtgacaacattttcaaaagctctattatcttttcctggttttatacataactgaggtctccaatgtgtgcatatgcatgtttaaatgtgtcactttttaaaaaaacattctgtgttatttctggaaaattcctgaaattcctgaaaactacatacatttaaaaatgttaaatataatgttctcattattatctggtcttgcagtcttatctagacttaaattttttttcttctttctttcaaacttcacattgaagcccttttatcaagctcggcatttaggagactcaaggttggtatttaagactaggatgacacctgttttagattgaacagtaattaataatagaaaggtgagttaggaagctcaccaaatggggcatggctttgggcccagtcatggaaatattgtccatctgaggtctgagattatacttccaggtccagacactggatgtttcaatatacccagagatgctcattttcttggttatgtacttatgttactcaaaatcacatgcaatgcagtttcaaagcagaatgtcaatttatttttgtgattagaatgcttttgacccattttcaaggattccactttttagtgtcaaggaaactaagaagcaggatgaataattacaaggttacttggtgatcgttgaaaaatagaaaggaaaataaattgtctaagagaatgactaatattttaagtaacttctcaggagatcaccccacaacagaattcatttgtcttttgctggaattatttgtgcttcccaaatgtcgctctgtcttaagttagagttaatgttcaatgactgtttttttaaaaacccaatattcctctgattagcaacccattaatacactatttaaacatataaatacacacttgagaggtccagctggcttttctgataggctgggagacattctgttggcatgtacttattgaatcaggcaaaacctcaagactctagctagagccattcaactccgcttcactgtgaccattttcttatgtatccttccagaaatattatatctctatagatcttcttttctccataaatgatagcatactactaaatactctgagcattgtttttctttttttgttaacattatatatttgagattgttttatattaatgaatgttaacttgccttatgtatcttgacagttccagagaattccattgtttggatgaataacaatttaggttgttttcaatcttaaatccttgtgtatacctacaagtatatcagaggacgaatttttagaagtgaaattgcttagttaattaggtcatgcatttcaaacatggatagatattgtaaaatttaccatcagagagattttactagttaaagtatatcaaaaatttgaggaagcatttgttttcataccccctcatcaataccatctattatcaaactgtttgttctgaaaaatgacgtctttcattatgttcacaacgatgtatatttcttttctcagtcaataaacacttcatgatggtctatgatatacacacttatgcaattatgttacctgtttattattactgaagatatagtgataaacaacatatagcgtttatatacatgtgggataaatagacacatgacagttgcagtggtccaagtttagtacaatggtgcaatgggagctatgggaggtacgtccatcacagtctagaaagggatcatcaacggaggcttctagtggggagaaacatggggagagacatgtaaactaaaatccgatggaggtgtagagtagttggcttggcaaatcttaggaaaaggagaagcaaagaagaggagacagcagactcacacgtgcaaaaatgggaatggagagagcagagagcgtgtggggtttgcacaaagaacagttcagaacctcactgtcatgacagtatgaagggaaagcgggcagtactccaccacccaccaatgtagccctcaaaatcagctgagttgtttgaactttaccctaacggcaatatgacataatcaaaagatttttaagtggaggcgtgaaaaatcagaagtattttggggctcacacttgagattggattggggaagatacggctaaaagtaagtgggagtaatgagggggctgtcccagtaattgggttcagatgacatttgcttgattttagggatgtacgagatattcgtggatcttgtgttgaagcacctaatacacgatgtcccttctgaagacgggtgcattaaactggggtgaagcacaaaggccactgagcagcctggcttgactcctggctttgccagtttgcatttgcacgtgtccaagcccttgagaggtgctgtgaaaacatagaggtggatgagggaagtgcttatacagcacataccgtataaaaagagggcttcatacttgctagttgttttaatttttattattacttttcctcgctgcacatggaaatgtctttacctttgtcttattataaggtacatacgaggagagttacagaacatgggtgttagaagagatttgacatatctgttcattttcctaattttagtgatgagaaaataaagggaaagaaagcaatttagatttttgccagtattacaattctttgttcacgggcacaccacgccagcctgaaactgttcattggtctggttctcttaccacctcgtatatgtaggtttatagtttggttacgaacaccaccttgtcttaaccatagatagttcctgtgtttgccgacagcagcgatttcttgtgtggaaacccctaatttgggaaacaatctgttttaaacactttgtagcacatcactcaaaccgcacagttttcgataatcttagaaacaaaaactggggttgaggcggacagttaaattctgcagacaccacaagcttggattcgtttcagcagtcggtcctaagtggtttgaagccccttccgggatgcctcttcttatacgaacaacgcagcggcgccaggcgccagggtcctcacttctgcctcctggatttcctccgcctttctgcttcaccgagggccctgtgatccgattccatcgaattaaccgctgtttaccgagggtctgctgcgcctaaggaaggcaccgggcgacgagcaaggcggggacgcagtttggggacgcaggggtccgggccccagtccagagacaggaggtcggcgcttcgacttggcacccgccgacgaattcactccaaggttcccactggcggagctcctgctacctcccccctcccctaaatgcagctcccgctaccttcccgcgcccaggggctgctgcctgagcccagctctgctcactggagggcggcggtggagagggtgctggcccagcgtcggcagctgggctcaggaccaaggtgggcgcccgccggtcctggtccccccagcctcacggtgcaggacccagggcgcggccactcgagttccccggacgctctccttcctgatgctcgctgtccctgccctggcgtccccagcccggggtcgcagcctgtcctcctctctctccccctccgccgcagcccgtcgcctccgggcagagttcatgttcagcttgggctttcgctcgggatttaggaagaggccggcggggctggagggtgcgggccggcgcgggagggcgcgggaggcggggagcggcggcctctgattggccggggcgggggagtgagcggagtttcccacaatgccccggtgcggtgcagccgcggatggatgctgcgggaaggggctgccatttgctgcccctgccagcggcgcgcggacctgcccgcgctcctgcagccgccgccgccgccgccgccagcccgcccggcccctgcagcggcgccgcctgcgctccctccgcggccgccggagcgggcgccatgaaccccagctcctcggcgggagaggagaaaggggcgacgggcggcagcagcagcagcggaagcggcgccgggagctgctgcctgggcgccgagggcggcgcggacccgcggggcgcagggtcagccgcggcggcgggggccgctgccctggacgagcccgcggccgccggccagaaggagaaggacgaagcgctggaggagaagctgaggaacttaactttccggaagcaggtctcgtacaggtaggtgcggggagccggcagccgagacaggtgcgccgcggcgggagacccactcttctacccagcaaggggcgcttccgcggagttgggcacctctctgtttccacgcctctccttccccctttccccctctcctcccggggatgtctgtcttctccccatcctatcattccaggctggagggcagcaacgcctgctttcccctgtggcaggagagaagcactgggtccctaaggtcagagcaacagaaattttgtctgtgtgtgtgtgtgtgtgtgtgtgtgtgtgtgtgtgtgtgtgagagagagagagagagagagagagagaaagagagagagagaaagggttgcagactcagtgatgcttagttttcttaagagaagtcgtcaaagttgcccctaagcaggtgtcatcttcaaccacccttcccccaccttccagatttcgctggatgaacctttggcactaacttgacagctgagatcactccgacaggcagaaaagaatagcactacactgaagagaaatccttatggaagttggacctgcctcgaaatcccccatgaaggaagagtgggtttatgtctgtagatgcgccactggttatgggggctccatgcctgcgtgctccttgcctctctcctggctggaggagggtgtggggagcccgctggcaagctaggggtgaaggtgagagtggggaccatatttgcacctaaggatgagtgtatgtgtaagacaaggacagtgtgggatcaatggcctttaaattaggataaaagataaccccacattgtattagaatccaacaacgaggaattaggatttattaaggtctctctcacccctcccttccgcaggcaagaataaagacattgacaggtttggagagttgttgacactaaccctactgcttatcgatgttaaaggtcgaggtgatatgcaagcataggtttacaaagatgtacacttgctggagctcagagggtttctggaaaaggggtcagtgaaaacattcttgtaaccctactctttctgagttagtgttcccttcccaaaaaccatataaagtattaagcctgtcacaccatgtgctgttatgtaagcaaacgcagatgacagaggtgtgtgggtttgggagggtgtgttttatttatgggggcaggtgtgtgaataattgggatccccatagacatcgcctggcctggaggccacagtcactagggcatgtgctctgtgtctaagtgttgacttctgatgactcctaaaacgccttcctggtgaggttgttgcttctgcgttcctcccatgcattttgttcgctgtgcgctgagggagttccccacctgagttgttctcttagttactcacacagatcaggtccaaatggatctttctttttatactttggtttctaaaaatagacagatggtggggagggggtagctctagggaggtatgctaggacactggcagttctacttcctagttatgatggcccgtctggcccctgggggaacagggactacattcagcctaatttaggagctgtgagttggaagggggtggtgattacatgaagcacagtgtaggctgctcctggcttattggtattcatcagagtcctcactgggtaggaagacaaagccagagtttgcaagggaaatcatttcagcttgcctcttgtcaggggtcattctctgagcctccttttttaaaatgtatgttgtgtggggttttggctttctgagttgcatgctcacacatgcacgtgtaagtgtgtacacacacaagcatagacatggacacagacgcagcatgtttctatagaagaataataacattgcgtctgctttacaatccttacatagaggtggattctacttcgtgaacatcatttccttttaaataaagctttacagtctccaattcctgcatcagtgtcacctcaggtgtctggttaaaagtgctcaccaccctagacttgcagaatcaaactgtctgtgggtgagaatttttaacacgctcctcaggcgatgtttatgcagactaatatatggggattgccaccctattttgcccccaagactaaacaattgatctttgaactcataaaccctccccatccaaaccaggccagtcagtctcaaagtcagaggaaagatggtgaaaaggaggtgcttccatctggagcatgtttgtgcctgggtaacaggaaattgtctccattttgatcactgttacttatttgttttggagtaatggtgaatggcctgcccactcgtcatggcggccattggtgctggactcctgcagcagggctggctgttttactgtgggatggatgaagggtgtgtaaaaaaagagcaggtttgtcaggagctgagggtcggctccttggtggggaccacaccacctcccttctgggggcacctgaggacagtgtctggtgggagcttatggagaggaggcaggaagacctcacagaatggagtctgagtgaaaggactgagttagggtatggagcatggctgcttgcgtgagggggatcatttgaggtggaggagtggagatttgcaggtaggcaaaaaatatcttttgaagaacatgtgtatttttggaatgaaacttgacaggcaaaaagaagggggctttgggagagagggtgtgtgtgtgtgtgtgtgtgtgtgtgtgtgtgtgtgtaggggggtctcatctgctccttctgttgctaaggaacatataagctagggtttaaaaataaatgaggagtgggtgggcatatgcagtgactcctgtctttttaggaaccagagccctttacaaaaagcctttaaataaccatttctggaggcagattattcattttgcttgacttttactttgttaagtaaaataaactgctttctgtactcctagatttcccctcattatctattctgtgttggctttttttgagaaccatttttcccatgagaattttttcctttatttcagaatctgcacccctagagcaaatagtctctgtcgactgtaaagctgaaggtttgaaaaggcagtgcgagtgagctggtacttttcttttaaaattactacttcgtttttctttgcaaattatggtgctgcaacagatacatatgtgtaaatgactatatactgtgtaggaactgtttttttttttaaactgctgtaagaattcccatataagtcagtacaataaaaaaaaaaagacttcagaaacacataagggaggggaaggagaaggtagctgatgtttattgtcttctatgcaacaggcactgggctaagccttattgtatattctgtcttaattaatctttgtgacagtcctgtgatgtgactatgactatttccattttattgaaaatgaacttgaggcatagagcttgggcaggaggcagaatttaaaacacagatgactccaaaggactgtctctttagaccgcatcacgctgcttccctaaacatttattttaggcttgagctctctgtccatgtgtgcatatgtgtatgcatgcgtgtgtgcagtgtgagttatcttccccctcatctgtaatacacggcaggtcattacatattattattattatatattattgcatacctttttttggcttgtggccctttgtctatataattttagggaactcttctactatctcagaaatataaatgaatataaattcatgattgcaaatatatcagttttgcttctgagaacaaaaccacctacatgcacctgctatgaagatatcctcgttagaggtttatatgccttaaaaaaaaatttacacagggttgtgtaggcgaacctaggtccaatgaagagctggcccatcggtacctctttgggcagcacagaatgagtgatgaagtacaattttgcttgtcagtatgtctgggcagaccattacttatgagatgttgatgcctatgatttagtttctctgctcataaaccatgctggtaatactaaacctttcttaaaggaagtttttggtatgagatagaaataggagcaaggagtattaaacgctttagtttgggcaaccatgtaaaaaatgatctgttattctttataggttgatgattagaatgtagtttttttgcgtgtgttttgtcccacaaagtaaggttgtgttattacaagaaagatatttgaggagttcgaagccacgtaggataaaatggatattggtcttccttgcattgtaatcaatagtgtatgggggaacttttctcctgaatatcagtatgtatcctcttttgtaaatccattttattttgtttttatccgtgttttgcacatctgttagatttttaaagactgtaggatcagattaagatcttggttctaatttaattcctttctcagtaatgacttacatactgactgttacttcctcagttaggatacacactgggcaagatttcaattcaaccactgtccggagtacttattctgctctaagtgatcttttagaggcttgatttttacctgggagattgacactattgggtcctgtggaatctggggatagggaagttgaagagaggtctttgctggtgttcaattctgctgtggcaacaaacaacagcattgcctcatggggccaaattcaattagactagagctagctctttccaacaccgcactttctagtctgaggaaatgagggttcctagtgagagcccaggctgtctacaccctgtatgttcgtctggcctgggatctgagaacatgttccctacacaaccccaaggtatccttgaagttgagtacactgtgagaccagaagcatctggaagaactattgcctacacgttgggctgtgacatttgctttcttccatgggtatgtgttggtaacactgatcctgtggagactaattatttttcctgaggtcctgtaactagttttgggacagtagttactgcaaataaatgatggcatgtgagcttttcttacagtggataactttgaaagaaaggtcagaagtaaaatgaaatctaagccataaaactttttttcattaaaatttaatttgctcaaaatgcctataaaaatgggctgatttctaattgttggaactgattgaaacctatttcaaggcacaaaaacaatgcagataattggagaaataaaaataccaagctaagtctgtttgcccataatgcttccacaactcattgctggcttgttcaccaggaaaactcctcgattggtatgagctcaaaagcgtccacttggggtgatgggtggctggtgctcccctgttctttcaaatagctttgttgagacaagtgtcattttctggtctgggacttagactagggtttgaacttggcatctttctgctaatctcagacaagctatgtaactccttggaggcccagccaatgtgtttctaaaatgagataatagtaatacaggtttgttaggaagattaaatgagttactttatttaaaggacatggcatagtgccctacatagagttaacttgtgtacttattaccattccccaaactaagttgttagctcctttgaagacagaacttgcacctgatcatttgaatcgatgactctgattcttcttgcttggtaggtgttggataagtatttattgaataaatacatttcattggcattttaaaataaattactactgttattcattcttggttcatctcaattgtgagtttcttttctactaaagaaacctctgcctttttcttatttacactttgtccagcagcccaggactgcgttactgtttacagcttcctgtttgcgtacctgcatcagccatttaggcagctgtgaggctggagaggggtggcagaaactcttacttaaccagctatttgcagcttgtcaaagaaaaggccttaatttgccttctgagtagcactaattagctctccggttctctttctgtctgtctcatccctttccaaggggcagcattgattttctcctcagggaaatttctgttgacttttccttcagtgattaaaatgtaaaaatgcagaaaaagggctacccagcattcctggagtcctgaccattgtccagccagccggaggtcactccagccacctctgttctatattacttcactccctctttccttccagctcatctgattgactttggtgaaaaagttattttaggaagaatgcattagtccgcttagtgactctaagcttttgctttgtttttaacccacttaataaaatcttcagaaaagcaccagctactttttattcatgtaccatacagagcacttgaagaatggctcacgagtgtcctgacacccatagtgtttagggagaggagggatgagcactgcttgggttactttagagaaaattaaatcatcttgtgtgtgcatattagctgaaggagggggctgtgattgggtagaggtgggaagaaagatctttgcatatgaatgttaatgttctttccttccagccctgagttttgtgagcctttgaaataaagcaaacagcattttcttttaagggcaacagctttctaacaggggcttctgtcattcttgcatccaacctagttttgctgaaatggaaatttgcctttagatttccagactcataaataatgttctgataaaagaaccaattctggtttaagctgtaatatttatagcctggcttttgttagatgttgggaacaacattcgaaacagtaatatttaaaccacaattaaatttcatttttcttaactttcaattacttgagaggtagaggagagtactggtgaagagccctgctacctgggtccaaagcgccacctctgcctgctgtgtgcctgcaaaagttacttaacctctctgtgtcttaatttccctatctgcaaaatggtagtgatagtagtactcatcctgtagaattatttgacatttaaatgagtcacaaagtacatgctatatgtgtgtttgttaaagtggtattatctatactcaagtccagttaaggaacagatttgtctattattcttcaaaatacagaacatcatcaaatgtcagcagctggtgataaaattattcaggtaatatgaaaatgagatagacatagacttgagaaatttaactgacaggttttggcattctttaaggtatagaatatgtactttttctttcataacttattaaaacacaattcattgttactaggggatgtgaaggggagaaagctgcttcttagtgctttggaaattggagcagacagaaggcagaggtcggaggagagaggcacagtcagtgtgcggaggaatcaggtagcagcaatccaaactcccagctggtcatctgagagcaggaagccagccgtggaggggtgggtgagaggggtctcagagcttcacagtgtcaggaatggataagctgataaagaccgaggtactagaaatagaattgtcccctgtgattccaggacagaggttatttctcttctggcctgtcttgatgatgcctgctttgtacatacagacaatggccggctggcatgccctggcaatcacagaaagaagcttcgcagatgctacctgccctggattatttcagaaatggaaggtgcagccttctgggatgttccatcagttatttgaaccaggccaaacagcagaatatattttaaaagatgtagatggttattaaatatttgttggacaaataaaacggctcaggactgtgaaataaattttgaggaggtgaattcattttttttcccctaaaaaaggcaaagataagacagttggactgcttttgtgtatcatgtagtctttcaggaaatagccagaaaatagattccttgaaaggaccaaagtacattttaaaaatgtgtcattcctttgtacatgagaaagatgtcaggcttgtaaggaaaaatacatttttgcttttttaaaaaaaaaacttgaaagcaatttgttgaaagataaaaagagctttacataagcttatgtggaagcggtcggaaagggttccgtgtatcatttagagacaaacttctggaacattcctcaggctgaaaggcctcagatctcatcattgtccttatggatgtgtcagagtttgagacaatctctttcagactgaaagcattctctttaagagttttgaaggaagagcctgtaatcccagcactttgggaggctgaggcaggcagatcacaaggtcaggagatcaagaccatcctggccaacatggtaaaaccccgtctttactaaaatacaagaaaaattacctgggtgtggtggtgcacacttgtagtcccagctacttgggaggctgaggcaggggaattgcttgaacccgggaggcggaggttgcagtgagctgagatcaagccactgcactccagcctggtgacagagtgagactctgtctaaaaaaaaaaaaaaaaaaaaaaaaagtttctcccttttaaattggccccctctcaatgcaaagactaaggtgtggcatgtttcttttcctatgcaattgaagcaccgtcctcagtgtctgaagttacacaggaagctgccaagcatgggcttccctgacagcgcacaacctcggggctgcttggttttcatggctgtcttcattagcttgggctgctgtaacaaagtcccatagactgggcggcttctaaacaacagacatttctttctcatcattctggaggttggaagtctgagatcagggcaccaacatggtcaggttctggggaggaccctctttggggctgcagacagctctcttctcatggtgtcctcacagggtggaggtagtgaggctcctgggggtctctttctagaggggcactcatcccattcattagcgccccacccttgtgactgaatcacccccagtggccccaccttctagaaccatcacattgggggtgataatttcaacatgtgacttttgggaggacataaacaccagcctaccctgctttttctcacaatattccaggaagccacagacatcactcctcttgtccttcccagtggcctctgaaggccattcccagaggcagcaaaggcaatccatgcacttccaagctttttgtaagtgcagctcagagaaggaaaaagcttttcttggttcaaatactgaccgcaacgattaacttacctccctacctgtgaatattaatcattataagttactgattttgccaaatgcttacactgtgtcaagagctgctaaatattttacatttgggatttcactggaccgtcaattaagtagggactattattatttccattttacagagaaggacattgaggcttagagtttaagcagcttgcctgcaagtcacatagctgagtggcagagttaagatctgtgcccatatttgcatattgcttattacttccctattgcagcttttcttgtcctcttttcaccctttcccattaccctctctgtgtgcaaatagccatattttcacaatctagtggtttattagaccaaactctcttgaggagagagacccatgtgtttcatcttcatgggcccagccagacctcacacaagacatagagagaggccttgacaaaggttgattggctgagtggatgaacattctttttatgtctaagcataaaacttagctctgtgaataatcatgtgctactgtcagttgtagggaggccaagattgagctttccatggtgtttttttgtaaaaactatatgaattttccattgcacaagacgggggaataaatccagtttcctggggccaagaaatgattgcagggattatagactggtactgctccttttaaattctacagtacaagaccttgtgatttgttgtaatcacagtggaacttgaagggaggtgatggtaccatggattggggtccagtgaagaagctagggttaacttatgtgcactttacatgtctgaaatggcatagtcagccccatttgatttttacaaaagatattcttagaagagtctggtcttttacctttagctcgaggacctgtttgagctgcaagtctttgcaatatgagtttttccataacaacatccttcagaattcgtcagtatgttcatgagtgcagttagagacacctagaaagttccaaaggaacattttgaaaacctgagtcattctttctcatttgaagaaaactttcagaatttcttaggaaaataaacctctacttcaaaaataaatgcccaagctatttaaagattaaaacagaagctttctatgagccagcgtggaattacttataacaaagtctaagggattttttttaaagacaaatttctggagatttcttaaactgttatactgactaaatttaggtacttaataataataaaaatgtgtgtggtgctttcacagcttaccatttataaactcctttcacataattaatctaactactcacaaaacaatcttaggcaaccccgtattgttttcatagccattgtacatttaaggaaacagtcacagtagctaagcgactttcccaaggccatgtgccataagggacattgccaggttcaggctggttttcggatctgaagtctcatactcttttcactgcaggatgctgtttcaacacatgaatctatggaaaaatagcaccatttccctctcattaattttacttacttgaattaatctcactggtttatcacaatggacaaagttggaatcactagctggtattctaaatccatattgcattgacaatgaggatgacctcattgccattgtcattgcccttcctgtacacatgaaaacatgaaactacaagtgtgatggtatatgtttaacactcctcttactggggaaaaagaaaaaaaaacaggtagagatagagtcaggctctttctttgcattagttgctaagcagcagccatttcattgtaaaggagacccagttcaagtaatggcataggtattccaagaatagtatttcatttttatagcaattgcatttcaggtctccagaaagcatatgcttctgtagctcagtgatttttaggggaagaaatagccacctcaacatatttgttgaacatatggagaaaattcagtatagctgattacctaataaccagacttccgtgagccgcacacggttcacaggggcagcaggttcaggctacccacagtttgaaggatttggaagtctccagaaaatactgctaacaaacaggtacgttttgaggctgtatttgacattcaccgataccatctcaatgaaatactctgggtaatttagaatgctaagggtattgaaatgacatggtatagaacaaaattttgttgttgcagccaaggggttggatggtgccaagatttcattgtattgagctttcgctggcagctgaaagctcttcaaaatgaagatagaaaatacggtacaagacaagcataattcatggagctcagtttatcagaaggatctgagtgcagaggaggacgtatacttaatgtcccaatgggtatgtgtgtgaaggggcgatgtcaatatacaaagctgtcaggtgctatattttttgattgcactatcactattaattttgaagatggattgatctgtgtgtggaagccttgaagcccttggccctgccttttaaggcataaaaggcatttctgccatctctgttgtaatttgccaaactattgtgaaacttatgtgtatctatacaaatgtattttcttcagagaattgcttcatggagttgttaagggagcaaactttgttgttttctaagagtgtgctgcataatactgctcctcaccattcccctcctcaagatatttgagagaaaatgcccctttccaggagcagctgggatgctgggaagcttgtctttaatttccagtaagttgcccttccatttaaggcaaaatacctcttccaggaactaaaagtcagactcagaagaagtaatacatggatgaattcacaaatggtgaatggttattcccattgtggtgctgggttcattagtatggttggttttagcatctctcgaacaattaatgcctctcatatatgtttcatcatgcacttttacaatgactcaaaacagctttagcaaaagcacttgtgttatacgaacccaatatatagatggtgaaatcaagacaagaaaggctggggaggagagatctaaaacattgacttcccggcctggcataaaacccatagaaatgcaagatcctaagtgtctctcagaaaaagcatatctgggaggtgctcaatgatataccttcaacattaatatgaggtcctacttgccaagaactgtgaagtgctttacatatgtggtttcagttaattcttatcacaactttataaggtagatgcttttactatccatagctttacagaaaaggaaactgaggcacaggataatgaagtaatatgtcagggtgtcaccaccagccaacggtggagccagggtttgaattccagaaccccctgtctagtgcacttaagcattattctgtgctatattcctatatgcatccaaaaccctgtttttccttttaggaatgacctctgtcctcttgtgtgtagccttgaggggctgtacatcaaggtgcctggctctccaccatggtaaccaatgaggcctttggaagctgttgtagggggcttcctctcaccaccctgatagcatcttggggcaagtgtatgacttgagcttggacgaccagactctcttggacttggactcaaaggattgtcaaagggattgccaatttgttcatatccactggcagtgccctggtaggacaattcctgctgctctggttcctgtctttattcaaagcataggttgtgatatggtttggctttgtgtccccacccaaatctcatcttgaattgtactctcataattcccatgtgttgtgggagggacccagtgggaggtaattgaagtatgaggatgcgtctttcccttgatgatctcatgatagtgaataagtctcatgagatctgatggttttatcagggtgagtttccctgcacaagctgtctctttgcctgctgccattcatgtaagacatgatttgttcctccttgactttgccatgattgtgaggtctccccagccatggggaactgtaagtctaataaacctcttctgtaaattgcccagtctcgggtatgtctttaccagcagcatgaaaacaggctaatacagtaaattggtaccaggagtagggtgctgctgaaaagatacctgaaaatgtggaagcgactttggaactgggtaacaggcagaggttgaaacagtttggagggctcagagaagacaggaaaatgtgggaaagtttggaacttcctagagacttgttgaatggctttgacaaaaatgctcatagtggcatgaacaataagatccaggctgaggtggagacaaggaacttgttggaaactggagcaaaggtgactcttgctatgttttagcaaagactggtggcattttgcccctgccctagagatttgtggaacttagaacttgagagagatgatttgtggtatctcataaaagaaatttgtaagcagcaaagcaatcaagaagtaacttggatgctgttaaaggcattcagttttataagggaagctgagcataaaagttcagaaaatttgcagcctgacgatgcaatggaaaagaaaatcccattattcaagctggctgcagaaatttgcataagtaatgaacagctgaatgttaatcaccaagacaatggggaaaatgtctccagggcatgtcagaggtctttatggctgtccctcctatcacaggcccagcggcctaggaggaaaaaatggtttcatgggctgagcccagggacctcttgctctgtgcagactatggacttggtgtcttgtgccccagccactccagccagagctaaaaggggccaaggtatagcttgagctattgcttcagagggttcaagccttaatccttggaaacttccacatggtgttgagcctgcaggtacatggaagtcaagcatcaaagtttgggaacctccaccttgatttcagaggatgtatgggaaatgcctggatgcccaggcagaagttcactacaggggcagggccctcatggagaacctctgctagggcagtgcagaagggaaatgtgaggttagagcccccactcagagtccctcctggggcaccacctattgaagctgtgagaagagggccactgtccttcagaccccagaatggtagttccaccgacagcttgcactgtgcacctggaaaatccacagacactcaatgccagcctgtggaagcagccaggagaggggctataccctgcgaagccacaagggtggagctgcccaagaccatgggaacccatctcttgtatcagcacgacctgaatttgagacatggagtcaaagttgatcattttaagctttaagatttgactgcccggttgaatttcagacttgcatggggcctgttgcccctctgttttggccagtctctcccatttggaatggctgtatttacccaatgtttgtatccccattgtacctaggaagtaactagcttactttggattttacaggctcataggcagaagggacttgctttgtctcaggtgagactttggactgtggacttttgagttaatgctgaaatgagttcagactttggagggactcttgggaaggcacagttggttttgaaatgtgaggacatgagatttggcaggggccagtggtggaatgatatggtttggctctgtgtccccacccaggtctcatcttgaattgtactcccataactcccacatgttgtggaatgagcccgatgggaggtaattgaattatgggatgggtctttcttatgctgttctcataatagtaaataagtctcatgagatatgatggttttataagggggagttttccacacaagctctctctttgcgtgctaccatccatgtaagttgtgactagttcctccttgccgtctgccacgattgtgaggcctccccaaccacgtggaactgtaagtccagtaaacctgtttttcttcccagtcctgggtatgttttatcagcagcatgaaaacggactaatacagatcatcagtctttctattcattgtgaactatccaacatcttcccgataaaattcctttttgtttaagttaactaggtggtttaaaaaaagtctaactgataaaatatcattggcgaatggcccagcagcctctgcttgtgaatgtcctcagtgccagagagctcttggatacattaggggcatagttacgccgttggtcaattctaattgttagagagtttttgttataggaaaaatgaatatattatcatttagtgaatacttaatatgtgttaggaactttcttgcctcctttttgtgattttcttgtttaattctcacaacaactctgagtagttatcactattgtacagatgagaaaactgtctcacacaggggaaataatttaagtcaaagggctataattgatggagtcaattaattggattcagactcagttttaagtcacccaaagcccctatcttttcccattacattctgctgtcttcatgttgagtctgaaactgactccttaatttttttacgtacttaatattacactgtagttctggaggacattcaggataataccctttccttttctgtataacaggtcttcgaatatttgaagtcaaatatcacatgcctcttcagctcttgtttctttagactgcaccatctccactttcattctatcccttatccaaaagtggttttcaatcaacttcacttttctggctctttctaatttgacagcatactgggttatccatggctttcttcataaaaatgcagcactaaactaaaaatgtggtccaaccaaggtcaccattagcacatatggtgcctttgttcaaattagaaacaggtttcaagtctgggatgcatgaatttacaaaaattctcttgcactccagagcacagtcagctccagctaggacctctcctgtggtggggggcactgaggctgggtttctgtccccatctgctcctcctttggattctctggtgcaggatacacctacataccataggcatagctttggggacttcattagcttgctgtggctgttggttgtggatagggattagtatgggtgtggaccaattgctgtgaaactcattccaaaagttgaatatccagactgccagtttaacaaattgctgataatatttccaaagttttgcttaggttgcagccatttcacttaagactggccattttagcttggctaaatgtttacttggcttgtttcctacttatttcagatgccatgcccttttagaatgttccacatccatcccttcctctgtccatccatctgtccctccttccctctctctctcatttttcctagataagaaggggcaagctctctcttaagttctatttactattatctctatttttcagacttatgcctgcatcgtcctccttttgaccctgctgctagtggagaaatgcctgtgaccaactcttccaaaaactggcttaagctatttgagaggttttggcgaactttctttcagtgagttgacacagagccaatgaagaaatccatgtggactttggctaaaactatatttggtggccaagaaaattacttatcttatccagaggacagcattttcctattttaagtacaaaggctatgccgttcaatacagtgggcactaatcctgtggacctaccaaaactaattaagtaaactaaatttgaaatccggttccttctttacactaatcacacattgagtaaataagggccttatgtagctagtagctgtcctgctggacagcacagttacagaacgttttcatcattgtggaaagttctattaaacagcacagcgttgtgggattagggtcaagatactaatttatcaaaattacagaagcctctagatagccatccttgaatgataaccttgaatgatgaagttcttgaattacgaagtctagtttcccaagttaagaagttgtactttcagggtgtaactaggaaggagagagaactgtagacaggaaatgtggggagagtcctctttggtgttccgcatcatccttactgtcctatgttcctctcctcaccacagtggtgactgaggataaggttaaagacagagagtttgtcttctctttcctttgcaaactgcatcttcctctgctttgccagacatattgagcattagatgtaagagaatgtgttctatagcttttgggtggcctagctgttttgccatctaaaatagttcagcttgtggtggctgcacttggaggtagaataaaggttatgggaagagcattattgcttctccagcaattaattcctaaaatttgggtaagaggatcattcaagatgaaggatatgaacttagaatgtggatgtgtagcttcaggttatgtctgtgtcacagaaattgtttcttatgctcttattcttatattattcttaacatcagttcccatcatgttaaataaatatttattgtaaattcacttgggaggcatagaagtaaatgcatggacttatacttttactgtggctcccctgattcctaggggagagaccttaggaagctgtgaaaagagcttcaaggacagagcaaaagccccaggaggatctgtgtgtgtttgtgtggattctatctggtgctttgaagtgccaatattgcacacaagggtgttctaaaaataactcaagtaatgtgcattctctgctgaagggagtgagataattcatgaggatgatgagaaatgaaaaaggaaaaggagagaagctttagaagatgagaaatgaaatacatgcatctcaatggtctctgaggctcttccacgcactgagtgctttctttcaagtcttggtattgaaagctgggaaaaagtacttaaaaaaaagcatcactgggagaacattggggttttctcacctgttttatagcatgaggaatcctctcgataaaaacttacctaagttgtaagaatagatatggaatactaatttgttatatgtgcaaaacactatttcaagcacttggtgaagaatccaaaattgaataataaatgatttttaccttaaagttgtttcaagttgcttataacttattggagaaagaaataaaaaaaatagccactatgtgccaaatactatgtgaagtgctagaaataaaagagaaataagagtctctgttatcaagaatttatggcttggtgatagagagaagcaagacattgacctgtctacaggctgataaatacaaagagagcgggcggtcagcgggcaggataggggagccctgagagagggcacttatgtctgagtggagagtggaggatctgcagcaagtgatggttaaatgtgccttgaaggaggaagagaagataaccaggtggagagaggaattaaaggacttgttcatgtcattgattgaatggagaaaacatactcagggttctaaatggcaaactagaaacagaattttagaacacagtccatttgcttctaatctctcctgaaaagctctcaaagtagatcatttgaatatttgaaggaatgaaaggctttaacaggttccactaacctagaattccacacataagtgagctttactagaagttgtatctattccgtgcttcttagacatcagcagcttgaacaaaggtaaagcagcgggcatagcatgatgcacatgattgtatctggatctgggtgataggaacacaaaagtgggagaggttagttctgtttgggagaagttttcttggagcactgactttaaagagttggtaggatttcaataggaggagatggggacacaaggagggagagtatggaaagcgttccaggcagcaggaattgcatgagaaaggatacagtggtagaaatgtatgacgtatttgtgcagcagtgtgaatggtgatgaagtagtttgggttgagcataaggatagagtggaagataaggcagggaaggttagttaaatgctcattatggaggactttgaatgccatcagaagaatttggattttatagttaatagggagccattggaggtttttgagcctataagtgatgctccatactcagctgtggggaggtccttgttctctctgaagccattgctggttaccctgcatccagagtcactgttatagctgcaagtcattcctgtgcaagtgacacctccaccctgccatgcctccagacactccagtatggacaataacttttctttctcctctagcacatgaagaaggaagggggacccctgttctgtctgcaggggccatggtggctgagaaccaggcttttctcatgccttaggaataataggaagtagggtgagtttctagtctcaagctttgggaaagattgagtaaggagaatttgagatgtccacagagtttgaacgtgaaactcatttttacataaaggaatataacggatggtgtttagatttgatgccattcattattactttagcaaaataacattgtcctaagttctatacaggtaaatacacagaaaattctggaacgtggcttgcctctgagctaggcactttccctctaaactgtttggataaactcgcctgcccccgccgcccccttccccctgccagatcacatcactggactttaaaaaacaaaaatgaagtggatagattttttcccccagattccaatacctagaaatcattgaacaaattaataggagaaatgtgtgttctgaatttattagaaaacagtagtcaagcagcttaaacattgttcactgtcagagggctgtgttactgtctaacactgttacatgaatagagattggctggaccagttaatagaaatacagataattttgcagctaagaaagatttgcctttagctgcaaaccacacactcttttcagacataatcttcagtaaatggagtgcaacattgtggaggaaagtcagtgtgaccaattctgactgctggctttcaggcctgttccagaaggattaggacgatggccggcttattctctgcattatgtacatgcattgcaatgcctgagagctggctcacgctctgcattttggagaaatcacctttcttctcatataatggaaaatagagaaacatagaaaagagagcaactttgagatcaaagtattattaacaggcaggaaaaaatagagtcttggtttaaggccacccagagtgatgaacagtcttggacccacaggcccacatgacctgcctgacttggagatgcaacctacaaactgatttcatgattaagaagttaaaaacttgatttttcaactaaatccaattgttaataatgtggagactactaagcaagttcataattctagtcaacaatactaaattcaaagatgtaaaacttcatatttttttcttgttacttaatagaggcagttttattttaaatgaaaaaaagtgtgtcccacaattttctttcttgatagccttcattcaaaaaggtttacttttcactgccctagattgacaaagacataaacaaattcagaaaacaagtctgttactgtgtcaccgtccatccatgttagaaaatactactgcctaccactgagtgtgtgtgtgtgtatgtgtgtgagtgtatgtgtatgtgtgtgtgtatgtgtgtgtgtgagtgtgtgtatgtgtgtgagtgcgtgtgaatgtgtgtgtgtgagagtgtgtgtgtgtctgtgtgttggggggtgcatgcctgtgtaaatgggcgtttttcatgtcacttgctaatcctcagataggtctcattctctgagccccaatgtcctcatctgaaaaatgaggctaatgatacctatttcccatcatggctgttggtgctgaatggaataatgtgtgcacattgtaaattttatagccctacagccatgcaagatattgctgtcaccaccaccatgcttcatcacatgtatgccgtctgccatgggataacgtgaagacattacaaacttcttagggtaatgaaatttcttaacaccagctctggagcctaggtttataaatggtacagattgttttggagacgtgcaaatgcagttatgtgagggttggccagcttttgggtttcgttgttaaatataatatttatttaaccaaagtaatatataagcaagacttaaggcatagctcatagttagaactacagagctttattgtggaagacagtgtggcaattcctcaaagaaataccatgcaatccagcaatcccattactgggcatatactcagagaaatataaatcattctattatgaagacacatgcatacatatgttcactgaagcactgttcacaatagcaaagacatggaatcaacctaaatccccataaatgatagactggataaagaacatgtggtgcatatacaccatggagtactatgcagccataaaaagggatgagatcgtgttctttgcaggcatatggatgaagctggaggccattatccttagcaaactaacacaggaacagaaaaccaaatactgcatgctctcacttataactgggagctaaatgatgaaaacacatggacatacagagggaagtaacacacactggggccttttggagggtggaggcggggaggagggagaggatcaggaaaaatagtgggcactaggcttaatacctgggtgagaaaataatctgtacaaccaaccgcttgtgtaacaaacctgcacatgcacccctgaacttaaaagtgaaaaagaatgacagggctttaaataaaacccaataattccattttcttttctttttcttttttttttttttgagatggagtctcactctgtcccccaggctggagtgcagtggcacaatcttggctcactgcaatctctatttccaaggttcaagtgattctcctgcctcagcctcccgagtagttgggattacagacatgtgccaccatgcccagctaattttgtatttttagtagagacagggtttctccatgttgctcaggctggtctcgaactcctgacctcaggttatccacccgcctcggcttcccaaagtgctgggattataggcgtgagccgctgcacctggccaatagttccattttcaaagtctctcccatactttcatttcttcagcgttgttatgatatattaactgttttttctgattctgcatttgtatttatacatcacatgctactaaccactaagtgctgtttggtaattttttttaactgtcccttctgaggtgaggatttagtagttctctttttatcccacccttatgtgtttcttcttccatccttccaatacatattacaattttatttaaatcattaataaatgcttatattatcatgactttgtaaatcttatccatagccgagtcacccagtgtgctatgaaaaccttttctttcttgtattattggtcttattttaaaacttattctcatatggacttactcatgattcttccacaaagttcttaacaagacaataaatgttttattgcatttaattgtatcaaataatgagtcagtttcatggtttttcttgtagacagcccttctggttccttccatcatcttgccctgtctgaactggtttttacatagcttccgttcttctccaatactttgacatccttctgccattttcctcaggcggatcctctgacttccagatttcctaagcgtcacacctccttttctgacttatgccttgtctgatggaacaaacaattttaagaaggagaagaacaacaccagcctcctcaatgaggttttttccccaggaactctcttcctatttttagatgaccaagttgaaaaagtttttcaggatgtgaaacatccgcaggagcttctttgcagagggtacatgggagtcagatatttagagtccttttatgtctgagaatatatatacattttaccttcacacttgactgagagcttttcaggttatggagttctagatgggaaataattttacctcagaaatgtgaaggcatatctctgttgctgctgtgcttacagagtcacagctgagaaaaattccattctaattctcaataactttacatctttttctttctttctggtttatttttaacatttttccctttatatacattgtttaggaatttcaaaactggtgtactttgtataggtacatatattcatgggttttgggacctttttagatctcttcgctctaaaaacttttaatgccaagaaattgtctggtattttttttttttgggttgggggagaatattttcctcctccccaatttaccagttgcttttttcctggaatttatattaaatagccaatgtatctactgaactattcctctgattttttttttctattaaagttctcctttaccttttattcttctttctgggagatttcctcatttgtttgccatcctttcactggatttttaaattttttgtgatcatactttttatttctatgagctctttcttgttttctgaggttcctttttgttttattttatttttgttacatagctttaatatcttcttttattcattgagggtattaataataatttttggatgttgtattcaccctacattaattctgttttcttcaaaaattttcttctcttcatgctgatagcttctctttacattggaggctgttcaaatgtctgatgatccagtaatatttaagagagaggccccaaaaggctgaatggaagctcggtgtgcatgtctgtgacttatgcttcaccgtggggtcctggtttgttttattgaaaaaaccctaaactttagcattttctgtttagttttctcagagaagaatcctccactttccttaagagttctacatctatcttttttctgaggctgaataataataataattattattattttggagacagagtcttgctctgtcccccaggctggagtgcaggggagtgatctcggctcactgcaaccttcacctcctgggttcaagtgattctcctgcctcagcctcctgagtagctgggattacaggcatgtgccaccacgcctgactaatttttgtatttttagtagagacagggtttcgccatgttggccaggctggtctcgaactcctgacctcaggtgatccaaccgcctcagcctcccaaagtgctgggattacaggtgtcagccaccgctctgtgccctgaggctgaattattattattcagtggataggctttcatttgctctctctgcttttagtagagggtctcacactcaaacccagctgcggttgtattttctagttctctctggtgtagcttttttagaaactaaatctccagtctcatagctgtgtgtggcacatgggagtagtcagaggtcctcagaatgggggtctaattactctctagaaaggattcttcctgtttttggctcctcctcacaccctcaccttcagcactacctgatgcctctagtttctgagcttttctggaactctgtggggtgaccccacctctttttgtttgctgcttccttcttaacacatttaatttctggatttgtctactctgcctgcattcagctcacttcgcagcttccaaaaaggttgtcatctgtctcttttattgtcatctcctgttttctttcttttctttctttcttttttttttttctgatgtatgtcttttatttccttgactttcatcttactgggagtttctggagagagctgggctaaaagtatgtgtccagctcaccatagtgacctggaagttgcttattctgttttgctttacaacaatagaaaagttaacatattcgtgtatttcttcagaatttttaaacaatgttgttcttagttcctcttacttctaaaggacttttaagagtttttttaggtatttcatctttcccaattctctgtctgtgaccaggggtgaattggtaattttacatctttttttcaagcattccaagtagaggaggcaccccctgtgacttccagtggcattctgcagcaattaagttgcattcattcagctcatcatttaccttgcagccatcaactcctttcaaaatatccctttgattgtcagtaactacggacgtgaagctgtgggtttcttccaggaacaatgctcttctctgtagcctgtgttctcccagttttctgggaagccctgagacttgtcattctcctagcagctcagatgtcattctcctcaaacacccagatttcatttagcaccaacgaggtgctcagtctgggatttctgagggactgtcactggggagaggctgttgctaatgaggtgcaaattggcagcagctggggaggagctgctctctccctctagggctgggccccaggggaggaggggagggttgctctgacattttcagaggaggttggtgaggggccgaaactagagactcctcaccctttagcaaggcctgatgccggctgggggaggcccttgcgtcttgctgagaggctggtctggtctcacacagccccacctccagagttgctgccagctggctaatttcttggctgccttttctggctggctttacttgcaagcaggagaggccatgatcagacacggggttttcccagacattggagagacagctaagaagacccacagcccccagagacactgtccttgggattggtgttctagaaggttatgaggttggggtttggtggtggaagaggggttactgtagcaactgttgaaacaagagagcccatccatctccccccagcatttgcccgcctgttttacatggaagagcctcttatgcattaaactgttcacctgagtgctcccaccagctgcgcttctctgcttctgcaaggtgcagggctctcacagccattttcatctgcaagggtctctgccagagctgtggcagagttttctgtgggatgaatcagaaactatgttctgatgaagagaaaatggagggcagtgggtggatgtggaatgtcagtaggtagttaagtggctttttgtctcctggtctgtctgacaaagtgtgctgattggggcctcctgctgtgagattcatttgggtgatcttgagcaaatctcttaatttctctgactttagcatccttcatcttttttctctgtatctcattttttctaactttttaaggagcacactgagtgctagcctagatgcaaggatgagtgaaatgaataaaatgcagtccctgtcctcacagaactcaccttctggtggaagaaggtggacatatgaataacatagacttacacatgatgagaaatgcactatgtcgaaggcatgcaagaagtgtcatgggatgatgaaggaaggggcaacgatgctctctgagagggtcagagaatgccctacagcggtagtgacatttgaactagttgttgaagactgattctgtagggggacaaggaatagtaatggaggtttgaaaaaacatggtgtattctagaaaagacaagttgtttgttgacactagcatgcatgtgcaggatgaactggcaggctgtggggctggcagtggactaggtcagatgatgtagagtgcttgccatacaatgagtttggatctcaccttcttggggatggggagttgtgctgggctgtgcagagaaccatgatcaaatatttgctaaatgagtaggctgggccatatgatcatttaagatcccttgtagtctggctgggcgcggtggctcacgcctgtaatcccagcactttgggaggctgagacgggcagatcacaaggtcaggagatcaagaccatcctggctaacacggtgaaaccccgtctctactaaaaatacaaaaaattagctgggcgtggtggcgggcgcctgtattcccagctactcaggaggatgaggcaggaaatggcatgaacctgggaggtggagcttgcggtgagccgagatggcgccactgcactccagcctgggcgacagagcgagactctgtctcaaaaaaaaaaaaaaaattcccttgtagtctgaagttcttggattttctgtgtgggtacaaagctgtgggtctgggaacacagcttcgttgaggagtgttatctggtgtaacgtctgtgagtaggtgtttaaatgtgggctgtactcaatagctatattaagaggtagcatcaagcagggagtggagcaccaggttcccagttaagctggagtttaaatatgcaagtcttgtttcagcctttgatcgtgcttttgaccatggctaaagcacttaatctgtcgaagagccttaggatcatcacctgtaaaatggaaatttccacttctgtgcagttgggagggctttttgtagaagctttatttgacaatgatttttctgttgcttaggtcatttgaggggaaaaacattattttaaagtttaacgttatttctaattgtcttaggaactatcaacatacatggaaatagaaattatctgtgtattgatttgtgtgtaatacacttatgctgagtttttcctgagtttttgatccatagatagataggaatctggtgggagttggaaatatgggcaaaaaatggtgggagggccaggcgcggtggctcacgcctgtaatcccagcactttgggaggctgaggcaggtggatcacctgaggtctggagttcaagaccagctgaccaacatggtgaaaccccgtcactaccaaaaatacaaaaaattagccgggcatggtggcgcatgcctataatcccagctacttgggaggctgaggtaggagaatcccagctacttgggaggcttgaacctgggagtcggaggttgcagtgagctgagattgcgccatgcactccagcctgggcaaaaatagcaaaactccgtctcaagaaacaaacaaaaaaattgtgggagatgggaatatgtgccaaaatggtgtgacaggagctcagttcatgaatgtacagatacacaaagcttaatggtccacttgagccatctgaggagtgcacttgtgtggttgatgacacatttctggactcctaaatattagtttatgcttattgaacttttgacctagaggattattatggaatggaatcacatgatgagcagtttggaccaacttcagagcaattctaaatctctgagttgcttgtttgctttcgggttgggtgtatttccttcaattttgtcttagaaggtttttagcttggtagcctgccatcttctcaaaatattcccagttagctcatctttgtaaccaaatggaataaacggtttctatatgattctcatgctgtaagacaatgtcattgatagtgtgtagccaagtaatggtgaagccaataagaatattcaaaatatggagcaactggtactggttgtggatgactgataagttcgtactagtacatagtgtctgatgttagcccctgctgtggctaagaaggcctgggacacatatgcataggaataaaacagatgtggcatattaaagactgggtaagaacgggtaagaaaggcatgggaaggtaccttttagcattggcctcactcagatacagtttgcattctctacattcataggactcttatcattgaaataatccactggtatctgcagattgattttccagtaggagtgatggtcagtgtgacctaccaaatatcctcacatctggtctgcaagggctttattaatcactagtgaaattatgaccatggtctgtgactataggactgtattgggggaaggtgagtcacaattcgacagcaacagtctttacttgttctatacacataagaaaagtactcattgaagagtatgttttcctcattctgaactcaaataaacactttgttattattgaatgtacgtcacttatcacctttagtattatttgagagttataggtatatatatcttgtggcctctaaataattgtaaaatcctgagggcaaagtagttaattcattcaataaatatttattaagcaccgagtatgtgtcaagcacctactgtgtgttatagacactgaatacaaatgaattagacaatgagacactttgaactgatgacactttgaatcgaattgatgaaaggatgatggggaattgttcagctgaagaggggtgggaagggtcttctacaaaggtcaagaggtcagcataagcacaggtatggccatgggaaatgacttggctgattaggaaataaaaagcaagttggtaaccgagaaatataacatgatcagttgggtcaagaagtgagacgagaatgataacagtgtttatcacttaaattgtcattttagtgttgctattcagtgagggagattttgtcataactcctgggatgctactggcatctagtggttagaggtcaggctgctgataaacatcctgcaatgcacaggatggcccctcacaacaaagaactctctggtccaaagtgtcattagtgccaaggtcgagactcccttcttcggatctttttacatttggattgcatcattcaggtcttaactcaaaagttccttctttagcagcttccttactcaccccctattgtcatataaaaatttgcctctccttctctgtcactctctattacaaaacaatgttttttgtctttataccttttgataccatctaatgttatattatgcatttgtttatttttattatctgtctctcctcttttaaaatataagcaccacaaggtctttgattggttcactgctgtatctctagagcttagaatagtgtgaggcacattggaaaatgcatggaaaagttcaatatatgggtgttctgagtggaagaatgtggtaagttggacatagactctgagttcctggaataatcacagtagttaacattcatttttaccattgatactaggccctgttccaagcattttgcatgtattaactcaatccccaaaacaacctcagggggtaggtatctgattatttccattctacatatgaaccaactgagaaagagagttattttcccaagatgtacatctagcaaggggcagtgttcaagaggtaaattgcccaaggtgatcttgtgtgtttattcacacatgctttttgtggctattagtctgagaatgctatggggagttgggggttaagtgacttgggaattggatttgaggggtttcaaacaatgcatccaaaacatagatggacgggaaatataatgaactaaatgttggtcatatcgcactcaagggacctgtgagccatcaaggtgaaggctaacatgaaaaggattctctcattcaagagaatggtttcagatgaagtgtggaatttgtaatgggaactgaaatcaggagagcagacttgattatttagggacaggttgatgatgggaacagacccagggaacaccctgacatcacaaatatataagggcctataatataatataaaagggtacccataatgaaaatagaaagagcagtagagtcacatttcaagttctgctttgggcacaagcttctatctaaagtctcttttctcccttgtagaactaatcttttctctctctgttctacctacagtattttatattttcaatgtattaagtgacataagagaggtgttagataatagctagtactacgagtgtcacctaagcccgtaaacttccacaggcctacatcttcatctttgttcatatccatgtccctagcgtgaacatccatagctgacatctagtagtctttcaatattaataaatagatgatgttgaatatgtgaattagaaaatgtttattgggagaataaatgtatcatttcattagaaaatttgtttgtaacccacatcaaaagaagaagaagaaatgtgtagatcagtgaacttttctgttgttttttctatttcaaaatacactcaacccccgacttcttaggcaagccatttagctaatttctgaaagggagcagctaatccagcaccaaagcctgtgcagaagctgggccagcaactcaaataagatgattttctgagaatgaccagccatgttggcttcacatatggaagacgagtttctgaattctccctcctctcgggtggcacatggtgtcttctctttctagctgctccaggacgaaggaggggggatgaatttttaaaagattcaggggaaggaattcaggttctagaaatatccaagaaaagtaataataaaaccagtaattctacttttatgagccaaaggtcaatattatttagtttttttttttattttttcctgggaagaaaaaagagagctgatcttttgggtaattattgatatttccatgttttcagcaggattcaagttagccaaggagaagcataatctttcattatccaaactggagatgtcttgagtaatccagtggcaggaattgctgctgaaggagtgtattttcttttagttcatctgcctttttgacctaaaaccagcgtaccatttttttgttttaaaatatacgtgatatacatacatggtttgtctacctctggaatatttataggctcatattcctttctatacttgttctctagcgggggtgcttataacatttaataatacttacagagtctgtttcttagtctcatttcaaacctcaatgtttgtgccaggttgtttggagcagctcaagtctctgaggttattttcccaagatgtatatctagcaaggggcagtgttcaagaggtataatacccaaggtgatcttgtgtatttattcacacatgccctttgtggctactagtctgagaatgctatggggagtgggggattaggggccttgggaattggatttgaggggtttcaaacaatgcaccccaaaacatagatgggtgggaaaaataatgaactaaatgttggtcatttagtccattattagcctcagagaagctagaagctcttaaaatattcaagagtatgagagattcaacccttcgaagagaagaggagttgatgatggaatttgaatcgttttttggcatttctttactttataagaacacatgacggtgttccattccagtgcagaggagctgttcttaactcttaaatggagagccctgctgttagagaaaaggcttcgtgaaggctcctgtgtgtggggtcatcctactctccgggtggcttcctcctcccattcctcaccttcatccatcactgtacttgcacatccatcctttcattctgctctggagatcctttggaaagggagaatagaaaggacaaaccattgatcgatagaggcagtaaagctgtcctttggggtttcacaatatgtcctgtactatttttgtgtttagcaaaaatccattttgcctcattatgagcctgttttcccttgggctttcacttctgagattatttcaagggaaattatgtctatatattagtctcatttgcccacatctcactcaataactattagcgttattagatatcctgaaccaggaagctgcattttgccagcactaaatgcagcttgaaattcaaagattcaatttggagaaaaatcactacatttgagtgggttaaaatcttgccaaaaatgcatttttccatctgtctcatggcaaaagctcttttaagatttgaaatttatagctaaggacttccagtcatctttgcaaagtggtctggaactagagaatatgataagactggaggtacttgggagcattcctctgaggtggaggaaggagttgacatcagtttctttctgttttaagtttattgaatggtggacatcctcagtatcaaatgctgtgaagtcagcaccagcacactcaacacccaagggggtggttcacaaagtgcatccatagccctgccacgcccagtgtgacatgactgaaagtgatgatcatggtcactttcattctttcttcctgacctgaatctgcctgggaatatgaacattgggttcatccttactgacctactctaatacatacaaagaaggctgtcagcttgccaaacccaaacaagaaatcagaggccaagtcaggagttggttttcagcctcttcactgatgtgacccaggagaagtgatgctcccgagagtgactgtctgcactttgtcttagcagtgctgatgagaccagtgagcactagcaccatcaccagtgagaactgtacctggtccccctaagtctgttcctgtgtgggtggaccctgcctcttagggttgttcctggtctatttactttctttaaacagaggaactcccttccttctggttgcatatcaacttgtgtctctggcatactttctcagggtcattgtttggggctctgctctgttgacttcttgaccatttctgctgttctcgcaactgatgctttctgtacttcggtgcattgtgcagcaatgatttgagaggttcagtcttctctcttacacatataagacatcctgtattgttattgcctcaaatatgactatatacctaattagtatcacacaaaggcgcaacatagcttagtgagtagaacacaggctttaaaagtcaaccttcttgggactaaatatttaccactttccaggtctgtggagtcaggcaagtgatttaaaatctcttggcctcaatatccttctttgtaaaatagagatattagtatagtctgtcacatagggttattgtgagtgatgattaaatgaattaatatatggaaagggcttggaatactgccatttatgcattaagatatcaaattttagttacagtgatgatgctaggggctcagcataaggacctcaaaattgcgcctgaaagggcagggtttctttatcagtcatcctgccttggcaccttactgtcctctaagactctagggaaatataaaacaaaactaattaagaggttgagtgtaagctttgctacagttaaatgcctcccgtctttataggatatagaacctagatgatgatgatgatgatagtcaacatttattgagcaattaccatgtaccaggcctgtcctaagccaaatatgtaatcatatttattcctcataaaaaccatatgatgagaagcttatctctgttttttagttgaggaaactgcaactcaaagacttggagctagatttacacccaggtctaactatgaataatcattatgaactttctcctttacactagactggttctcctcaaaacaggaagcctgagggaatggaaagtgaagggcatctccctgggatctagtcctttgagatgttggactttgagcaagctacgcaacttccccaaagttcagaattttaatctgtaaactaagataacagctatttcacaggttgttgtgagggagacaaaacaagctaaaatatataacaaagcaggcaaagatgtatacttcaagagtcactacctacctaggctggggcaattagaaattctaaatatatgtacataagtatttagcaaagttatatacttcaagagtcactacctacctaggctggggcaattagaaattctaaatatatgtacataagtatttagcacagatgataaaggatgggcaattcattctgagattaggctgtagttcttcttcagtatggaatcagagctcaattatctttaaccattgtgatttggggaatagttttggtcctaattgggtgtacatgatgcctttgtcttcagaagtctgatcaatcaggggatgctgcaccacaacccttatactacgttttagtgtttctcaatgtcaagagacttctgtaacagatttcagttctttctgatggctttgaaaaatgctagtaattctctgtctttctaatggagtattttgtgtttgttgtctcctgaggtcagaaaattactttggggaagttgacttttgtgagctgtgagtatggtgtgtgtgtgtgtgtgtgtgtgtgtgtgtgtgagagagagagagagagagagggagagagagagagagagaaagagagacagacagagagaattaaatctgtattgttagttcttggttagaatagagcttaatggatcttcccatttgtgaaaaccccataactcttcctgtgtaatatcattaaagagcctcctgacagcagtaggtaaggagtagctctggggtgttactttttaatcactttaagcccattttcgtgtgttattacagaaccatccctcttctttatcactgcatcttccaatagcacaccattgctccaggaccagaattcagcaacaattttagtttttctgttgacaataaatatgttagcctgactgatcaaggctgatgcatgagcttgatctttgggattatttccattctacatctgagtacatacgtagaatgtactacgtaagatagagccagttctgccaactgtctgtggttgtcataggtatgcttcatcaaatattctggcgcatggtaggtgtacttcctggctttgtatatttgagtggggccacctaaccagttctggacaatatgttgtgattggaagtgatgtgtatcacttgtgggatggaatgtttatttgccacaaataaataactaaaaaaaaaacttctccagggatctcttttccttctgccacagttacatcttcttaattgtcagcctgggtccagaaagccccagccaattctttatagacaggcagtgctagatagacataaactgctgttattttaacaagtgggatatgtcttatgttcctacagtataacctacttcatctcgactaacacaatgatccatagtcagggacatgtgctttttggtgagcagtcaaggtgtggccttgatgtcccttgttttctctgctttgcctttactgtgaagtctgtctagcagtctgagaaaatttaagaccctaataatagatgtcttggggcaatgaaacttagtacctttcatagtttcgttttcttttccttaatttttttttctgtatttccttgtaccagccattaatgttttgcctgtcacatagcagccactcaataagtgagtgatgaatgaatttgtacagaaatccattgattggtagggaacaattagcattagcattatagaagtgttttgattctccctgaacttattgttgtcaattactcttttactcaattcaaccctaagtcatactgttttctatttccagggctgccctgatgagaggtagctttggcctatcaataggtgcattggcctctctgagacagcagcacaggggacctcagccttctactgcctacactcagcaaacagaaatatatgaggctcttggctgtgaaagcagaagaacctcttactcctgcaccattttatggccaaggccgtagcaaactgctgactccagagaattttttcacctttttttttaacttatgtggatttttttttttccaactgggttttgcgctgttgctcaggctagagtgcagtggtgcgatcatggctcactgcagcctcgacctcctcagctcaagttatcctctcacctcagcctcttgagtagctggaaccacaggcacacatcctcatgcctggctaatttttgtattttttatagagacagggttttgccatgttgcccaggctggtcttgaactgagcttaagcaatctgccttccttggcgtccaagaatgctgggattacaggcatgagccacagcacctggcttgtagttttaactaaactaaaacttctctggccctggagaatttccctttctctaaacttacgcatatcaggacatgcctaaagtgtctattttatgataaagtgatgagaaggaaagagacaagggttaggacagcccgagactgcaggctgatacctggtggcaaaatactagtctcttaaacactaggcacatatcctgcccaattagagatctccctggaatcaattccttctctccattcctcctgtcattgcttcagatcaggctttcaaatctgttgattacactattaaattagaactgtgcccgagacatcaatgagtatgagctattattatctttattattgctattctgtagcctcctgttcccgtctccagtttttcttcatttcaatccatactgtgtatcttttaaaaatagatcagattctgtcatttccctgtttataaagctctcttgcctccactgcctagaggataaagccctaaagtctgagctcattgtacctcttcagccatgttctcactcatgttagctgtatctgaatcatcaaggaagcttgtcaaactctctgtgccccaattcttttctccaagagattctgggaagcttttgggtgatagggaagggagatatgacacattcctgggggggtgtggagtttgagaaagctcccccagtgattctgaggccacttcttccttacttagccatccccacgtccacagctagaacctctaatgttgccatgtgtaatgttggttccagccacgccaggcttctggagttccttagtctcaccatgatctttgacatcctcatggtttgcaggtgtattctcatcactctttatgttcttcttcctttttctgctcgggtctctcccatggttttttaatatttcatttaaatgttagttcttaggcctttcctgatattcccagatgactgtctgtctcctctcatggcatgttgcattgacctacattattatccttgttatattgcagcctcattatttgtgcctgctactgcctggacagtgggggctaggggaggcaggtgcctggttctgtaatcttctgccagatttgaaccgagtttggtgcatagcaggcacttaatgagaagcacactttatgaggcagcactgtgtgatggttgagtctgggctttggagtcttccctcttggggaccttgtgacaagtaaatgaaatactgtaaacaaggcacttagcctagtgtctggctcttaataaatgcacaataaatggcacctaccatttttttgaaataaatattttatgattaagtctgtatttataagattaataagtctctcatttatatactaatttccaggatgcatagatttttcatccagatagtttatataccagcaaaatgggaaataacaacacctgacttttttactggaaaaatattggttgctgtggagattatctactacgttgtccttactctcaaagagattacagttaaaacacaccaatatcaacatgaacaactaggaaatagcaatgagccaatcacagcagagatcttaattggcttcataacaaagtgtggtctgtaagccaatgggaatgaaaggagaatcaataaatcccaagagacgagagttgcctttttgggggacacagtcatacacacacctatattcgctctggaggaaaaatggtggcaagagggtgtatgacttgatgagtgggggagacatggtcaaggggacaggcaggcaggtgagagtctgggctgactctgggttggtcctagtgttagggccatgccactcaaagtgtgtttatggacagtagcagcagcagcggcacctgggagcctgctggaaatgcagactctcaggctggccccattattttttccagtttctagtttcagggcttgcctgatgggagacagccttggcctatcaatagctgcagtggcttctctgaaagagcagcacagagaacacggatggactataatctgcattttaacagggtccccagatgatttgtgagcacgtgaaagtttgagaagtgctggcccagggatgtgcagtgacttggatgggccctatttagcgctctcctgtgagctgctggaacaaaatagagggtacttaaaagcatatgcacttccactgtaggcttaaaactgcagaaacgaggtagctcgtgcataaatgtaataattctttgttccaaatgtacctagatgtcattatgacaaaacataaaatccatttggaactgttactgattcctagcagctttttgccattagacattttccaggcatccaaacctaaaataacatggatcttgggtgaaggtttttgaaatgccttatattaaaaagtccttgtatttgaaaaccagtaaagaagtatttgggaaccattatgcgttctttcagtactgcatatgcagaatattttgggtcttcacagatagacttgtgacgcaaaaataaaataaactatctcgtaatcacacagaacagatcactgacatatatggcaagctgttgcagtgacccaggattaaaagtttagcatagttcttaaatgtgtgcctcatactgcatcagctccttatttcgagggctcatagtggatgaagcaattacctggatggccctgtttcttgccctttccctggtcttctgccacgtaggttggtggtgatggttgggaaatgggggtggcaaaagtgtcctttatggattttatacagttcttattccactttttggtgggtcactggcctggttgctgtcatgcatggtggggaggtgggcagatgagaagcccagctctattgccaatcttagtcctgagcatagatgcagaggttcaggccgggtgcggtggctcatgcctgtaatcccagcactttgggaggccgaggcgggcagatcacgaagtcaggagatcgagaccatcctggctaacacggtgaaaccccatctctattaaaaatacaaaaaattagccgggcgtgttggcaggtgcctgtactcccaggtactcaggaggatgaggcaggagaatggcgtgaacccaggaggcggagcttgcagtgagccaagatcgcaccactgcacttcagcctgggtgacagagcaagactctgtctcagaaaaaaaaaagaagcaaaggttcagtttctgatattttgtttccaatcatgtggcattgacactggaatcagctagacctgcattcaaatcctgactccatcacttaagctgttgtgtaactttgggctggttacctcactaacctctctcagacctctctcagtttcttcatttgcaaagtggggaataacaacacctgatttagatgcaacgcaagttgcaagtcattcagcatttactcatgatcagtgagagtcactgatatctccgtttttctcgtttcccctgccttctaaagccatcaggtggggaccttcatctaccaaacagacgctaaagaaggatgggcacggtgagtggaaaaaggaggttgaagagttgtttttgctcccaagtgtttcataatgaatgaggttaagaagagaaaataaaataccctgtccccttgctcttatctggctcaaatacagcctgtattatttagcgtcaaagaaattatcttctcatgctttgttcagaccactccaactcatggccacagttctgacactggcttagccttggctgacctgtatgaagtcaaataagttccttcacctttcttaacctcagtttctttatcttgaaaatgagagcatgaacctttgtgatctctaaggtatttccaattattcagttctaagagattatgcccatctgagaacaagtggaattaatgttatgaagggtgccttcaaaggagaaatgcttgagatgggagcaagaatagatgcaaatcatgcctgtttttgagctcgggaaagctttcatatggcagggttttatattcatctgcctggttgcatgcttatgcactgcccttgtttggccttgaagaacatggttttttccattgtttctggtggagataatcacaatgactatgtcacgtctgcttgggaaaccaaccacggctgctgatctttggatccttgtctgggaagctctcaagccagtagtagtttgcctcaaccattcaggggtagctcctctctggccaggaccttgttatgccttccctgcagacagcgtaagggatggtaggcattctttctccattcgctccctcgccagaatcagcactggtgattgtcaggcaggtaaggagaacactgtcatgctcaatggagatgtcagactaatgtgagtcagctctagcttccctcaagcacagctggaagacaaagaaacagatttactggagatgtgcacaaactagtgcctattatgttaaaaaacataaataaaacgagggagaaggcatacagagagaaattatcttttaaaaacatcttggcaaaatagcactcaatacacatcagtacaatagtggagtcatccatgtgtgtcaacctgtagttcttaatgacagggatgtataaacaagtaggtaataagcagcccagctgcttctggggtttctcttaacttactttctttgaaaatgagttggtggaaatacagctgaaaacacagactcagaaaatgaatgagtcatttgagttgaacataaaaaaggagacctggatgaggatttagagagaagatccattcaactccgtaagcctacaaagtaagattagactaaatagatagaaattttattctactcccaaaggataaacatcattttccatttctttttgtagacaggcaaagctctgccgtgaatcatggttttaatgcagacttctttacagaaaaagaaatatatccatttcctttcctttcctgtgcccatccaagcttgttatcgagaggagtgcctctgtaccctctgtcagctagaatcaatgttaaacactgagcacacaaacaccaaaaacgtttacatctttttatttttcttcaaagacttcaaaactgccttgcctttgttcttacagataatttttaatagctggtctagttgtatttatgttaaatgggggcacaggggtcaaagagacttattaaaaggacggaatgagtgaaggacttctcttctgacgaatgaacagggcatcgagccaataattaaatcttattgaagcagagaaaactagcctatatttatatgcctagaatgttctgagtgctttcttgtaggatctcttttcaataattgtaaagtggtaattttcttcattttcctgaagagaaaactgatgctcagagaggctaaataactgcacaagctcacatatccagtagagagggggaagagatggaagtccaaagtcaatgccacactgcttcctatttaacaatatcaaactcaggcatcaagctcctgctctatgccaggcatttgctgggtactggagatgtgaagagagaatggtctaagcgcttactgttgagtgcttcccaaagcatgtgctcagtgtttgctggttgtcacttactctcacaaaggagctccctcagtctagcctcagagaagataattgtgcaaagtgggcatgcttgttagcttatattttcagaaaatgaaaaacgcatgcccggactatttacctcacgaatctaagatgatatagtgagcgggtgttagggatgggacctgggccaaatccaaataggttatgcatttagccttcaaatccttgctgtgttccaatgtccgtttaaagcttgttaaattctccaggatatttgatacacacttacttaatatgtttcatttgcagaaatggttgtattttaattgaagctcctggaagtgaaactgcgcttttgtaagaaattcttaagtaagtggaggaaaacattgtgctcaggaaaagttttccagagacttcaaaatgacatgaaatgttaaggccgtgtccagtcaagatgcctgtatataaatgtgaaaggtgcattgtcttagtagacatcataaagaaaaatagcatcaaaaagaaagaaaatatcatacagctaaacaggtgatctaaataatatacataacttagaaaatgtgaaatcagtggataggattcatatgaggatctttttaacatgtttcctatatcagaatcaaaaatacagttccagtcacattactttcttgtttgaaaacattttttggctctttgttactgacctgtaatttgtctaaactgtatactggaatgtaaggcctctgaagagtgatcacagccccctttttcaaacttacctccatcttctctacaacccagcaaaactggtctcctcactgtgtcctgaatttccttgttttgtctcacctgcgttttctctcagcttgcacccctccatcccttctctccaaatgtagaaacctttaatcgctcacttgcttctccaggatgcatttatggatctttccttaatgcaagcgacctgccctggcctttcctctggattcccttttgtagtgttaatatttgcatagtgattcttattttgctttgctttgtattcattatttttagtgcttgtcttattttacctcctaaactataattttcttgagagtttttctcatctaatttttttgtctttgtagcatttggcatagtgcttcatgaattgtattaatgaacatcagtaggtattagttaaataaaattcaattaaataaaggccagagtaagatgtgcagttggaacagccaggtgttagattttctctgactcagagatgaacagcttcccagcaagggaagaagttcgaggagagaggccggtaggagaggaagccacttctataatttggcactaataagaaatttactctggaaaatctcagtttttcacaaaccatctttcacttttctcatgatggagaatatccctttattagtcaggaccttctgcaaattaatgggcaagtctcatgtcctcataaagccataaccctatttatgacattacaattggttacttagtgataattataatgtcacaaatagaggattattatgatttgaggtgcaaaacagctgtaacaaagaaagtcagcaataagtggacatgatgtagtaaatttgcagctggaaaagaataattcccagaaagatattaaaaatcattttaatagtttttggggaacaggtggttttaggttacatggatacattcttgagtagcgatttctgagattttggtgcacctgtcacccaagcagtgtacactgtacacaatgtgtagtcttttatccctcatccacctcccacccttccctctgagtccccaaagttcatatattatccttatgtctttgcctcctcatagcttagcttccacttagagaacatacagtatttggttttccaatcctgagttacttcacatagaataatggcctccagctccatccgggttgctgcaaatgccattgtttcattcctttttgtggctgagtagtattccatgctgtaattataccacattttctttatccactcattggttgatgggcatttaggcccattttatatttttgcaattgccaattgtgctgctatgaacacgtgtgtgctcgtgtcttccaaaaatgcatttttttgcataaagttttccactgagtgatggggcaggggggcacatgctaaagttgaagcttttgccaaggagagagagctgagggctgcaattcttttggaggatgcttttcccagccacaaacccatattgatttcttccagaacatttactaatcctctctccccagctctcacccccagtgggtgcaagcctgtgcatataaacacactcccttgtttcccattcaggatatggaatcttatacatcataaaagagactgatctccatcctgattcataggactgtcagcagatggcagagagagtgataatgccacttactatcaggtcactccgaattattatttattctgtggagagtgagactgaggactgaaacctgatgtttaatttttcaaaatcacatggttagaaactggagggtcccaagctttctggtcctacatctaatgaactaatgcttttgttgtttatttttgcactatactttatagctatgtaatgatgtaaaggacacagttgttttatgaaatccatttccccttgctccttccttttgaaaccttgatcttttttttctctttctagtagctaatgagattcaggaaagccgatcccatttccaactccagggagcaagaaagtataatatttgaccttccagcctcttagcatcagctggtacttccttcttttctcttcctgagccatgagtcatgcttcatcaaaagtttcccaggctcctgaagtgaaaatgacaaatcagtgcataagagtgataggaagagaagtacaagattgtattagacagtatagaacaaaacactttgcagaatgaaaaattgcagagtgctgacacttgttctacagaaagggcatcagcacttagatcactgttgaacaacattcattttgggatgaatattgtctaaggtgaggctgaaattctttgcttcaaattctacaaaattcttattctacagaatggtggattatttagctaccaaactttactgagtatatagttattgaggatcaactgggagatgcataattgggcatcatgagcattggatggagcattgggtgggggcagaaaatgttaaggtcatacttgaaatatcaaagtgcacaacctaggaatagacttcaatatcaacaagatttgactcagctgaatctctgttttgccagtcttttctaggtctagttttatacctgttaaacatgaacattaaaacatttcactctgtgttagtcagttcttgcattgctgtaaagaaaacctgagactaggtaatttgtaaaaaaagatgtttaatgggctcatggttctgtagcctgtacagaaagcatagccctggcatctgcttctggtgaggcctgaggaagcttccaatcatggcggaaatcgaagagggagcaggtgtctcacatggcaggagaaggagcaaaactgagagttggggggaggtagcacacagttttaaacaaccagatctcttgagaactcactcactatcctgaggacagcaccaagccatgagggatctgcccccatgacccaaacgcctcccaccaggccccacctccaacactggggattacatttcaacaggatatttgggtggggacaaacatccaaaccatattacactccttgcctgtaaccagtgagaacccatttggctggtatatcactccagtttgttctaaggatgtagtaggtatttgccaattctgttgagcaacaatctcaactccaaccttgccatattctataggggggaaattggaatccccaaatctcttgggtacctgagatttctcattctccttaaaaggtcctggttgtcctaaagcaaccatgcctcctatccctgccacccctggtatttgcttcctgttttatttctaacagttgtctagagagaaccgtactgaaaaactgaatcaggtgatttctaatgccattaaatacttaaagttagcatagaactaatcattatagaagaagatttcaaaagcttcaaatacatggttcataatctcattgaattaaaaagctggctaaagattcaaaatggacgcacctaatgggacagcaaacaatatctaagttgtatgggagatgttgtaattaatctctcatttaatcatcctttcattcaagcattcctttgattggtagatgaggctggctggcttacatcagaagcagattttgatcagttttccttaggaaagcatgtgattgacttcttaaccaatccagcccaaaatggatgaaccataatatcaaaataatcacttttaaaagagtaaattctaggcagaataactgttctcagtatgttcttatgaggagttggactggttttgttaataatgacattatgagatacaatttatataccataaaattcatccttttaaagtgtacacttttgtatattttagtgtgttcacagagtttgactatcatcactactttcttggcaatcttttaatcatcctcagaagaaattgtgtacccattaatagtcacttccccgttccccacagtccctggcaaacactaatctactttctatctgtatattggcctattctgggcatttcaaataagtggaattatgcaaatgtaagtttttgtgactgtcttctttcatttaacataataatttcaaggttcatctatgttatcggatgtatcaggccttccttccttgtaattgctggatattattcaattgtatgaatataccagtactgtgttgaatagaagtgatgaaagaagacatcttttttgccttatctaagagagaaaacattcagtcttttactattaagtgtgatgttggcagtgagtttttttaaaaaaatagatgtcctttattaggttgaggacgttcccttatattcctagttttgttgagtggtttttaatcatggacagatgttgggtttttacaaaaatgctatttctatgtctattgagatgatcatgtgggtttggtcacttagtctattaatatggtatattatattgattgattttactgtgctaaactaaccttgcactcctagggtaaaatctccttgatcataggtataatcctttttatatgttgctgggttgggtttgataatattttgttgaggatttttgcattgatgtatttaaaagagtctggacacagtggctcatgcctgtaatcacagcactttgggaggctgaagtgggtggattgcttgagctcaggagttcaagactagcctgagcaacatgataaaataccctctctacaaaaaatacaaaaattagctaggcgtgatggtgcacacctgtggccagctactcaggaggctgaggtgggaagatcacaggagcccaggaagttgaggctgtagtgagccatgattgtgccactgcactccagcctgggtgatggactgagatcctaactcaaaaataaaaaataaaaataaaaaaagcagatatcggcctgctcttttcttttttgcgatgcttttgtttggttttaagatcatgataatactggccacgtagagtaggttgaaaggttttccttcctctttcagttctcacaagattttatgaatgattggtatgaattctttaaatgattggtagaattccccagtggagccctctgggtctgggctttccattgtgagaacttttaaaattactaattcagtctctttggttattataggtctcttcacattttctgtttttttctttagtcagtctcagtagtttatgtctttataggaatttttaaatttaatctaggtcatctaattagttggcatatagttgtttatagtattcccttatatttcagtaagatcagtactgatgttcccccatttagtaatttgagtcttccttctttttttcttggtcagcttagctgagtttttcaattttatttattacacttttcaaagaatcaacttttgattttgctgattttctctattgtttaagtcctctctatttcatttatttaggctctaagttttattattttcttccttctgtttgcttttggtttagtttttcttcttctagtttcttaaggtgtgaggatatattatttgcttgaaatctttctttatattttttctccattctttcattactgtcttcttttgtgttaaacatctatttcctaatgtatcattttaattatctcttccacctatttttgagttactttattactgcttttttctgaggattacatttgaaatcctaaaacaatgtagttcaggttaatatcaacttaattttaatagttttcaaaaacttagttcatatacagctctgtttccttctcttttgtgtaattattgtcatatcaatgacctctttacacattataactatatcaacattatcttataattattggtttatgctgtttccatttaaatctgatagaagaattataaacaaaacttattaatactgtccttcatatttacctatgtggttacctttattggtggtctttatttctccatggatactcaagttactgtaaagtgttccttcattttagcagaagggttctttttagtatttcttgtaggatggatcttcttatgatgggttctctcagtgtttgattatctgggaatgtcttaatttctcataaaatttgaagaatagttttgctagatttggtcttcttgctgacagtccctttctaccagccttttaaatatgtcattccttctgactctggcttccatgttttaggataagtcagctgttagtgttattgaagattgctggcatattatttttctcttgctgatctcaagattctgtctgattcggtttttgacagtttaactatattaaatgtataggtatgaatttctgagtttatcctacttggaattcattgtgcttcttagatgtatagactaatactttttattatttaggatattttcagactttattttgtcaaatacactctctgtccctttctttcttttctctccttctggaactctccttgcatgtatgttggtatgctggctcatgtcccacaagtctctgaggctttgtttattttccttcattcttttctgtttctcaaactggatgatctcaattgccttatttccaagtttgttaattctttcttctgtccgcatagttgtgctgttgacctccttcagtgaatttttcatttacgttattgcactttcgaactctagaatttctatttggctcttttttaaatgatttctatttctgttgaaattgtctatttggtgagacatcattctcatattttcctttaactctctaggcaagatgtactttagttctttgaacatacgtaaagcttttttttttttaaatggagttttgctctgtcacccaggctggagtgcagtggtgcaatcttggctcactgcaatctccatctcctgggttcaagtgattctcctgcctcagcctcctgagtagctgggattacaggcatccaccaccatgcccagctaattttttgtatcttttagtagagatggggttttgccatgttgatcaggctggtcttgaactcttgacctcaggtgacccacccgccttggcctcccaaagtgctgggattacaggcgtgagccaccatgcctggccttaaagctttttatttaaaactttgtgtaaccccaatatctaggctttctcagaggcagtttctgttggctgtttttccttcatgtgtatggaccatgctttcctattttactatgtatcttattttttgttgttgttgaaaactggactgttaaagtaatataatagagcatccttggaaatcatatccttactttttgtttttgttgccattactagtagtagtagtagttgttgatgctgtgtgtttgtatgttttttagtgacttttaaaattctgtaaagtctgtgttctttgttgtgtgcagcatctaaaatctctgcttggttagcttagtggtcagctaataattggacagacatttcctcaaatttattcaaccaataactttcccactacttttttgtgatctatatgtgtgagttagagtatgcaataaatactttggtaacttgataactctaccttagcctttacttcctgctttgtcagccaaaagtgagagattggggtcttctcagatccttcctgggaatactcacagcttgcgcatatgcatggctttccagattcccaagaatatgtcagaactttccaaagctcccgtggacttctcatttcccatattttgatttttaagtttttcgatcagcttcttaatttgccgcaacagatagggccacctcaggcagctatgatattaaacaattcctgattcttttggaaaaatcccctgggtacagggatttcctcactgagtaatagctgacttaggtcaaatgaggataattccatgtgaatgagaatttcccagggagcttccaaacaagtacaatagtgataattctctgaggatgggccttttgtggcggatccaaacctattctgctctctccaatagctactaggccactggttttcacagctaccatctttctaaagctgctggttttcaagggtactgcagagatagggaaagggagatgggaataggaatagggtaggtttaagtatcacagagctcactgttctgtagaataagccatttttatttcaaccttttggttaatttttagaattctgaaaatgttgattttgacaatttttgcaactgctctcatactttcagggagcaccattctgtctggagtgcttctttttcctaggtggttttcatatcaggactgacttcttttgagacacaaatatcagactaggaagttgttttgtgagtacagaatcagaaaaagggaaatagatgtgttaaaaaggacgtagctggacgatgaagtctgatgcttgtctcctctttaggaagattgatatctgtgtctccaaggggaatggtatatctaatatttctgtgaacaataaccaccactaaatatttatcttaagtcttgagatcatgaaatgaggatgttggtggtatttgctgctgataaaacctgagtagatatctgtctcaacttagaaacctgataaagccagcagaacacaactgaggcagtaaagctttgggattgactggggactcttgagatacacttgctatccacttgctacttgaagtatggttcaaagagtgcagcatcagcatcacctgagaacttgtcagaaatgtagaatttcaggtcccactccagactttagtaagttagaatcttcatttcaacaaggtgatttatgcacacattaaagtttgataaatacatgcctgtagcatgtttacatcttcatgtggttgtcctgggaggattcctgcaatttgctagcttcatctatttaatgttcatttgtatcaacttaaatttcagaagtatctgctcctaaagtcttggagaatattaatctttgtacagtcttgtccttcttgtaactctttatggtaagaataaatagttgagcttcaagaatatcagagagggagaaaatctgtgcaggctggaatggtccaaaaggcattatttgagttaggctttgaggaaaggatggggagaaagtgaatgcgtgtcatgcagatgaaagaacatgggccaacctacagaggtgggaattatttattatgtgcagtagaggtctaaactgtaacatttttggggacatgcattatgtcttgcttatatatgtatcctcagtgactggatttcatagatgctctataaattattttcaaactgaatagtaggaagattagtttaactcaaggtgagggtttatataagaattatgggaattgatgcaaatttattagcatatggctagatgatggtgactttgaaaacttggtaggagtttgtatttaaatttgttgggtaatcttcagtaagttacgtgggaatggaaggggactaatttgtgattattagaaaattattaacagattaaataactttattcaaactccagaaaataaagtccttcaaaatcttcttggctcttccagatatgtggatctttgaatgagaacatattgtaggaatcacattaaggagaaaaaaagttgaagaaatatggtaaacattagtagcccattttaatgttttatataagttcttaagcaggggaatgacatgtgaaaatggtgtttgtaagagattaaaatgtaggccgggtgcagtggctcaagcctgtaatcccagcaccttggccaggtgaggccaaggcgggtggatcacctgaggtcaggagttcaagaccagcctggccaacatggtgaaaccctgtttctactaaaaatacaaaaattagccgggcatggtggtgtgtgcctgtgatcccagctactcaggaggctgaggcaggagactcgcttgaacccgggaggtggaggttgcagtgagctgagatcataccactgcactccagcctgggcgacagagtgagactccatctcaaaaaaaaaaacaaaaaaaaggcagcaaaatgctagatggattggaaggggaagagaatgggtcaggtagactaactagggctttttttcgttatctagagatgaaggcagatggacagagaccaaggtaatgtcaggacagaggaacgaacgttgctccttgaagtccctagtattacaaagtagagacatctaattaagcagtttagcttttacacaaaaagaaaaaagaaaagaggaaagagataaactatctgatgcaatagcaataatagcaactattctttaccatcctcataagacaatggtgagaattaaatgagtgaatgcttgtaagttgctgtattaatctgttttacattgctgtaggaatacctgagactgggtaatttaaaatgaaaagaagtttatttggttcacggttctgcaggccatgcaagcatggcaccagcctctgctaggcttctggtgaggccctcagggagcttttactcatggcagaagcaaagggagatcagacatgtcacatggtgaaagagggagatgccaagttcctttaaacaaccagctcccatgtgaactaatagagtgagaagtaactcatcaccaaggggatggcaccaagccattcatgagggatccagcaccatgacccaaacacctcctgccaggccccatctccaacaatgtggatcacatttcaacatgagatttggaaggaacaaatatccaaaccatactagttgcctagaaaaatgcctggcacatggcaagcactcataaatgttagtgataagctattgttaactggaagaaagaacctcctggtgctatcgagtagcacttctgtttctcaaaatcagcacccaacacagtgcttatttgtaatagatgcttaatagatgcttaatgaatggatgaaggggaaataaaatatctctcaatgtaggaatgaaatatgttgattatagggtcacattttgctgttgatttctattatacatataatcccccaatggaggattgggggaaagtagttattgatttctcatattctgttctccaaactaactttatctctatctcattctctttctctctttgtccacacccatcctaagggatttccatctctatgcttgtgattcttggaagccggctccccctgtctgtgtttcatagcacaggtgctcagtcgacatttgtgttcattgctaaaccaatatattctagacctatggctcatgcctcagagcagtgctctcagggaaaaagacactctcttttctctgctgtatttaattcagtccttttcaatagtttatcctttctgaatggccactgagatgtttgatacagccaacttaatgagttgtggctaaactgctttattttatgtggctgaaatgtattcaactgcgcatgtgtacataagacttaatctctagacatttcatgataatttgacagcataattgaagtgagggggaaaggattgagtggtttgtttcacttacatttcttcacccacccctaaaataaaatattctctgaagcaaatgtcaggaacttcttccaccactgtcaccatgtgacaatgagttagggaatggaattaaattcgttatctagcgtctctttccaaagagctaaaaggtttttttgttcattaccagagcatctctccaacagaatagagaccttcccatatacagctgcagctgagtttcacacttaagaaatcttataggatcttataaattttaagggacatagctctacctgaaaaagtctgtagaaacctgaggtccagctcttctgattgccttgggtccttttatttaaagttggcttgccttttgtaatgaaacaagccttttctttagtgtttaataccaatgaatcttttggagaagatatgctagaaagattttgagcaggggtagagaatcttcctatgtcaggaccactgacccaccaaaataatcaggcacatttaagaaaggacaacctttaggtcacttgcaaaagaatgcaaacccattaaataagtattcttctagttcatattatggccagctgaggaagatgagagaagagatataggaggagaaatagagtggataagaaggaaagagagaaaaacaggagaggtagacacatacacacagaaatcaagagggatagagaggaggaggtttgtgagtactgaggtgagagttactgagatgtggtgcttgtcacatgccattgctcacttgggctggtttccttgctaatgagttgcttaagccttgctcacagctccttctacagcagtttttcaggtgaaaaaaattatcctttggactgtagcaacactgaccccagtggtgcctctctgagagaacagagaaaattaagccaagtgctgaaggttgcctaatcctttgaggggaatgcaactaacattaattgaattcttattctgtaggaagtgctttatagaggttatctaatttaatcttcaacaaatctaacaacaggcactgttatacccattttccaggtgataatacagtcattaagtgctttgtcaggtaacaccaccagttagcagggagagaatgggattcatgcaccagccatcttctgagtcctgctctttctgtttcaccagctgcatccacgtctctttctagagcttaaagaaatttcagaaaatcatccaagtttgcaaattggtagaaattgctccacgcctcagactgataataatttgctttattgattagtgcgtcattgggccccatgccaggcatctgagctttttatctatttaaagtagagcagcagccagttggttggaagtattgtacctacccttctttgacagatggctttctatttggcttttgaaattccataagaaagaatttcacagtttctcacagtagcttattgcagtcatatccagagtcagtcttcggatcatgaatacattgatcccttttctctggctttgaatgcagcatactgtcataggcctgggcgaaagagtggttccagtgtgtgtgtgtgtgtgtgtgtgtgtgtgtgtgtgtgtgttggtaatacacaatctgtaacatagtcaaagaagaaataaagagtcggcaaactatggcccatggaccagatctcgctggctgtttttgtaaataaagttttactggaatacagccatgcttattcatttatgtattatctgtggctacttttgtgctacagtgacagagtggagtagttgtgactgagattgtgtggtcttcaaaggctaaaatatttattttcttgttcttttctgaagaagtgtgcaatccttgctatagattaacatatcaactagagaattcttgaaaagaacagagcatgaatatagcaaaactatggtgttacctaggtaatagtactatgaggatctactacagataatattttccaagtgccccttgttgtgtttgggggaatacaaagaggaggttctcttacttgtatgttgaaataactccttagaataaggttggagaatttctgataggaatgttgcttgtgtatcaaaatacagaattgcgcttctccgttctgactgtggttcttgtccaggcaagtttggaaattgtgactccttgaaaccattcaggcagccaagtgttccagctgatgttttgtgtgtttttttttcctccttcatttaaaaatacactttgtagaatgttttctttttcacggctccctaaatattctgttttgaaacatttaattacccaggttatttatatggaaaggtttgataatgtttctatgggagtctgttatttatttcttttgctaaatcttatcttatattaggggaagggctgaggttggttactatggcaacattctcaaaactgcaacaatcccattacggatgctaaaactatagtcatttcagtgggagggtagcatggggagtgggtggtagtctttttatttttattttattttttttaaaaaaacctctcccacttccaaatcttttgcattcatttattttaagctttgcagcttagggtactaaaatgagaaacaaaaagtaaaaaagagtgtcatgtctctctccattaaatttctgtagtcctttatcagctccctttgtggggatacccagttttctacctactcttttattcatttatgctttcagttattccccaaactttcattgagacctgtgttatgggtgaataagagaatccttgttcttgtttctccttttaaattataaattctttgaagccattaattcacttcactgtaattcatttaaacaaatacttattgagcaatttgctttgtatcaagaatcatacttgcataagaagacaaaaaagaaaaaagggattctgttgaagattaacattttgttttgttgggcagcacagggaagggcacatagtgaagcacagagatgattgaaataaaatttgataaatgcttacacaggggcacttaatccacttaactccccagcctagaaagcatagaaatgactgcagggaggtgacatttgggttaccagataggcattttctggttagggcctagatgtgtgtgtgtatggcagggggatggaggtgtgtgtgtgtgtgtatgtgtgtgtgtgtgtgtgtgtgtgtgtgtatttatgggtttgggtatgcagggcattccaaccaatctagaccaacaagaatagagatatacaggcgaggagtccttggccatgagcaggagaatttagaaaacacatggatgattggtagaagaacagtctggagacgtagccatcaagagaagtcatgtctgggaggttggatttcgacattgggaaccattgaaaagttcagaaggaggagcaattgagtgttccagtttagaagtggaagacagtgaagggaagggaagggggaagatgggattgggaagagatatggagacttgtaaaaatggcaagattcaccttgggacatgatgagttttaaatgaaccccatcaagttggaccgtccagtaggcagctggaaatgtggctccagaactgacaagaagtgtggatgggacccagagatctggatatgatcagagaaggctttgaaggaggaacaggaacctcaagagaaattacacattatcgtatccctaatatgctgtctcacttttagtaaaatattaagtatttctaaaaagatttttaagtgttgatgtgaccaaaatatttttataattttttattttttatttcaataggtttttagggaacaggtggtgtttggttacatgaataagttctttaggggtgatttctgagattttggtgcaccatcacttgagcagtgtacactgtacccaatgtgtagtcttttttcccttgctacccctgacagtttcccctgagttcccagagtccaatgtgtcattcttatgcttttgtgtcctcatagcataatagtgtccagtttcatccaggttgctgcaaatgccattatttcattccttttcatggctgagtagtattccgtctgtatatacaccaaattttctttatccactcattgattgatgggcatttgggctggttccatatttttgctattgcaagttgtgccgcttaaacatgtgtgtgcaagtatctttttcatataatgacttcctctgagtagatacctagtagtgggattgctggatcaaatggtagatctatttttagttctttaaggaatctccacactgttttccatagtggaactatgtactagtttacattccaccaacagtgtaaaaatgttttcattgcatccatgccaacatctattactttatggttttttgcttatgggcattcttgcaggagtaaggtcgtatcaaaatgcaattttgatttgcatttccctgataattagtgatgctgagcatttttcctgtgcttgttggtcatttgtatatcttttcttgagaattgtctatgcctgtccttagcccactttttgatgggatttttttttcttgctgatttgtttgcgttctttgtagattctggatattagtcatttgtcagatgtatagattgtgaatattttttaccactctgtgggttgtctgttaattctgctaattatttcttttgctgtgcagaaggtttttagtttaagtgctatctatttatctttgttttagttgcatttgcttttgggttcttggtcatgaagtctttggctaagccaatgtctagaagggtttttccaatgttgtcttctataatctttatggtttcaggtcttagatttaagtatttgacctatcttgagttgatttttgtataaggtgagagatgaggatcaagtttcattctgctacatgtgacttgccaattatcccagcaccatttgttgaatagggtgtcctctcccctctttatgttgttgtttgttttgttgaagatcagttggctgtaagtatttggctttatttctgggttctctattctgctccactggtctatgtgctgatttttataccagtaccacgctgttttcctaactgtggccttatagtatagtttagagttgagtaatgtgatgcctccagatttttttttttttctttgcttagtcttgctttggctatgcaggctcttttttggttccatatgaattttaggattgttttttctagttctgtgaagaatgatggtggtattttgatgggaattgcattaaatttgtggattttttttggcagtgtggtcattttcacaatattgattctacccactcatgagcatgggatgtgtttccatttgctgtggcatctatgatttctttcagcagtgttttgtagttttccttgtagaggtctttcacctccttggttaggtatattcctaagcatttcatttttttgcagctattacgaaagggattgagttcttgatttgattctcaacttggtcactgttggtgtatagcagagctactgatttgtgtacattaattttgtatcctgaaacattgctgaattcatttaccagttctaggagctttctggataactctagggttttctaggtatacaatgatatcatcagcacacagcaacagtttgacttcctctttaccaatttggatgccctttatttctttctcttgcctgattgctctagccaggacttctagtactgtgtttaatacaagtggtgaaagtgggcattcttgttttgttccagttctcagggggaatgctttcaacttttccccattcagcataatgtaggtggtgggtttgtcttggatggcttttattcccttaagttatgtcccttctatgccgattttgctgagggttttaatcataaagtgatgctggattttgtcaaatgctttttctgcatctattgagatgatcatgtgatttttgttttcaattctgttagtggtgtatcacacttactgactcatatatgttaaaccatccctgcatccctggtatgaaacacacttgatcatgtggattatctttttgatatgctcttggcttcagttcactagtattttgttggggatttttgcatctgtgttgatcaagggtattggtctgtagttttctgtttttttaatgtccttccctggttttggtattagggtgatactggcttcataaaatgatttagggaggattccttctttgtctatcttgcggaatagtgtcaataggattggtactaattttctttacatgtctgatagaattcagctgtgaatttgtctggtcctggacttttttttttgttggcaatttttacattactatttcaatcacgctgcttgttattggtctgttcagagattctctatcttcctggtttaatctaggagggttgtatattttcaggaatttatcctgaaatttatctcctccaggttttctggtttatgcacgtgaaggtgttcatagtagccttgtatttctgtggtattagttgtaatatctcccattttgtttctaattgagcttatttggatcttctttcttcttttcttggttaatctcactaatggtctatcaattttatttatattttcaaagaaccagctttttgtttaatctatcttttgtattgtttttttgttgttgtttcagtttcatttagttctgctctgatctttgttatttcttttcttctgcttggtttgagtttagattgttcttgtttctccagttccatgaggtgtgaccttagatcgtctatttgtgctctttcagactttttgatacaggcatttaatgctatgaactttcctcttagcactgcttttgctgtatcccagaggttttgataggttgtgtcactattatcattcagttcaaataattttttaatttccatcgtgatttgtttacccagtgatcattcaggaacaagttatttaatttccatgtgcttatatggttttgaggggttcttttggagttgatttacagttttattccactgtggtctgggagggtacttgatataatttctattttcttaaatttactgagacttgttttgtggcctatcatatggtctatcttggagaatgtaccatgtgctgatgaatagaatgtaaagtctatagttgttgggtagaatgttctataaatatctgttaagttcatttgttatagggtatagtttaagtccattgtttctttgttcattttcgatcttgatgacctgtctagtgctgtcagtggagtattaaagtcccccactattattatattgccatctatctcatttcttaggtctagtagtaattgttttataaatttgggagctccagtgttaggtgcatacgtatttaaaattgtgatattttcctgttggacttgtctttttatcattctataatgtccctctttgtcttttttagctgctgttgctttaaagtttgttttgcctgatataagaattgctactactgctggattttagtgtccagttgcatggaatatctttttctacccctttgccttaaatttatctgagtccttatgtgtcaggtgagtttcctgaagacagcagaaacttggttggtgaattctttatccattctgccattctgtatcttttaagtggaacatttaggccatttacattcaatgtcagtattgagatgtgaaatactattctattcatcatgctatttgttgcctgaataccttgtgttttttacactgtgttattgttatataggtactgtgaggtttatgatttaagaaggttctattttgaggatttgtttcaagatttagagcttcttttagcagttcttgtaatgctgacttgggagtggcaaattctctcagcatttgtttgtctggaaaagactgtatctatccctcatttatgaagcttagtttcactggatacaaaattcttggctggtaactgttttgcttaaggaggctaaaaatagaatcccagtcccttctagtttatatggtttctgctaagaaatctgctgttaatctgataggtttttctgtataggttacctgctgcttttgcctcacagctcttaagactctttcctttgtctggactttggataacctgacaactatgtgcctaggcaatgatcttttcacaatgaatttcccaggtgttctttgagctgcttttatttggatgtctagatctctagcaaggccaggaagttttcctccattattccctcagatatgttttccaaacttttagatttctcttcttcttcaggaacaccaattattcttggttttggacatttaacatagtctcaaacttcttggaggctttgttcattttttaaaattcttttttctttgtctttgacagattgggttaatttgaaagccttgtctttgagctttgaaattcttccttctgtttgtttgattctattgctgagactttctagtgcattttgcatttctgtgtgtccttgatttccagaagttgtgatggtttcttatttatgcagtctatttcactgaagaactttcctttcatatcctgtatcacgtttttgatttgtttaagttggactacacctttctctggtgcctccttgattagcttaatagtcggccttctgaattctttttttgtcaattcagagatttcatcttggtttggatccattgctcatgagctggtatgatttttcagggtgttaataatcttgttttgtcatattaccagaattgtttttctggtttcttctcatttgggtagactatgtcagaggaaagatctgggcttcaagcgctgctgtttagattcatttgtcccacggggtgctcccttgatgtggtgttctcccctttcgcctaggaatgggacttcctgagagccgaactatagtgattgttttgctagccacccagtggagctacagagctctgagctggtactggagagtgtctgcaatgagtcctgtgatgtgatccatcttcaggtctttcagctgtggttaccagcacctgctccggtggaagtgacaggggagtaaagtggactctgtgagggtccttggttgtttttgtttagtgcactggttttgtgttggttggcctccagccaggaggtggtgctttcaagagtgcatcagctgcggtcctatagggaggatgcaaaccttccccagggatacctggttagtattcaggtttctcaggtggtggacggggccatagagctcccaagagattatgacctttgtctttggctaccaggctaggtagagaaagaccactaggtgagggcagggctaggcgtgtcttagctcagcctctccttgggcagggctccctgtggctgctgtgggggatgggggtgtggttcccaggccaatggagttatgttcccagggggattttggctgcctctgctgagtcatacaggttgtcagggatgtgggggaaagcggggagtcacaggcctcacccatcgtccacacagcctgcagtcctaatggccggtctcactctcatcatgcccccacgacagcaccgagtctatttccaggcagccagtgaccagggctgagaacttgtcccagaccatgagccttcccattgagaaagcaagcagactcacagttttttggtgtctcaaggagtctgcagaggtgatctagttcgttacttgaaagggtctgtggattttctcagcttttctggtatgttcctacagtagttcttggagcaaaagttcatggtgtgagtctccacatgctgctctgtctgtctgagcaggagctgcaagctattcctgcctcctatccaccatcttaattgacagtggtaaccaaaatgtttagagccattttgacagattgaggaatcactgctatgattaaaatgtagcacttgagatgaccatgctcaactcgtaggatgccatcatcaaacagctttgccttctccctccatttattctttaaacctgcacagtgggacatgtccttccctggcaattccggtcactcttaggcaattaaaaaacaaaacaaaacaaaacattcaggttaaaaacaccagataattcagtacctgaaacgtccagcattatgtactagcaaaaacactggagttgatttagaattgagctttcttccctcctccaacaggggcctgccccagccctgcagtcatggaaggagagtggtcagcttccctctttctcctcagtattccttcaccccttttcttctctaggctagcctcagtctcagaccccattaaattgggttgagagagaggaggaggaaggaaatataagggaaacagtaaagtgcttacttaactgctgatgaattgttagtctagtttcagtgctttctgaatctagcagatatgtaagtttacttctctgtggagttcttttgtgtattctttgcccaaaaagaacataccctccccccattgctaagggtctcatatctgtagttctctgagacaaaaacaatgcgttgctactgggctacacctttcccgacccttaggctcctggccacacctccagctaatttctgctatgccttttgagtagtacctgaacagtcctgatatggctgtctcagatgcacagcccacaccttgttcatggaagacactcaaataccctttgcttctgcaaactctgggagtgcaaccacctctcctagatccaccaacaaaacagccagcaagcctagatgctatcatgtctgatgtcagatgtggttcagacacaaatctatttgttccccaaactgcacagactgctgaggacagatgtgaagccctctgtctgcctttttaaagtccctctttcttgacatgaggtgaagcggcaagccccactaaccactggctctccttgattgaagggttgtggactctcaacacatcaatagcttccttgaacaatccctccaaaactgtccaattcttgatccttttaaggaattatgagttttataaacagtttatagcaccttttttggtaaattttgcaaaacgtctagctcttttaaaaaaattatttcttgatgcttgaaagaaaatattcactgaaacatcatgttatgtgagcatcatttttctacccccatttagaaaaaagcatttctgactagttgcagaaggaattttgttacatggatatagaattggctgcatctagggatagattgaatggatgacaaagtgaaaccacgctttctttatgaaggttgtattttcaccttccttgtagacacccttccttttccagggtgcccttagataaacagctgtgcatcttacaggaattgcttacaatgatagatttcccctaagctcatgactgccaaatttgtctttgtagcccagacctctttctgagatgcagatccatatatctgatagcttactctacttctctgatcaaagtattacaagtttagctcacatcatcattactctaaataccattcctcattctgaatatctatttgccttcatgtaatttatctttagtcttaagaaatggtacttagaaacccttagttgtttaaatcagaaagttgggagtcatcaacagattcttaagttcttgtcaaccatgccactttagcaatctggtgatgtctctgaccgcctttcaaaacagtgtttgtaagaatacaggactactatggaaaccaatgatatggaaacacagttctgttatgaatgacttggaattcatgaattgttttccttctcatctctcacattgattcagtatatcattcacagatcatctcctgaatagcagtcagactcattttattttctctatcttcactgatgctttcttacttcactccttcatcatctctcactgaatgactgaagtttcatttaaaaaacaacttatactgataaatttcaaatatagacaaaggacacaaaataatataatgtaccccatgttgctgttacctagttttacattcccactccccactctattataatgacgaatttatagactttattttaagtaaaacttataaactgtcttagtctgttttgtgcagctgtaacagaataccacagactgggtaattcttttgtcaaacgtctgttcaagtttttatttttgactatttttaattgtttaaaaatgtttattagtagttgcaggagttaaaaaaatctggatacaaatcgattatcagattcatggttggtaaatatgtttttccaatctgaagcatacttattaattttcttaatgtaatttttataagcaaaaacttttaatttttaaaaatgatattatgttctatgtccttctgagaaatctttacttatctgcaagtcatgaagatcttcttctgttttcttctaaaaattttatgtgttagctttcacacttaggtctatgtatgattcatcttgaattaatttttatgcttgctataagatagaggttgaggttcattctttttttttccatatgaacatctagctgttccagcataatttgttgaaattattgcttgctttattgaatttctttggtggctttttcaaaaatcaattgactatagacttgtactatttctggactctctattctgttctgttaatctatttttctatctttatgccaataacaccctgtaggtttaaagtaaatttcaagtcatgtggtatgaattctctatcttttttctgttttcaagattaatgtattctggatcctttacatttccaaataaattttagaattaacatgtcaatttttattttcagaagacctgctggagttatgattgggatttcattgacttagaagattaacctgtatgtatagtttattttttagccagtgatttgggagagagatttatttgcagattttagggatcactgcctttgtgacttctctctatttaacatattccccctaactttctgcagttttgccttcccctaagttatctgatactttgatcaagtaaggaaactgaggctttctgcaaccccagctatgtgcaaattgggagtgctaacagtcaaatatttgcaaacttgcaaatttcattcattgcagtttgtcttttaatgggggtctctgctccagattttgcctaaccatgttcactttgtagtgcctttgagtagtttttttttttaattgtccagatctaaaaattgttatctgtggaacaattgttctgacctagctactttgctattaacagaagacagagcacctccttcttgcctcctctttcatctccctgtaacacacctgcccattgtcccctaagtaatctttcaaaaaagcaaacccaagcaaaccattttctggttgaaagcccatcaatgactcttcattgctttctctctgctttcttatcttccttttttagattcctcctcacttatcctatgcactctctggctttattgaaccatttggcatttcctagacacacccttcccttaaaagtctccccttcttgggcttatatcatgatcctgactaaaatgcctctatgttctttgtagccgggctaactcctagttcttcaaaagtcagctcgaagtaccaactcattggtgaaaacttctgggcgttattgaaagtgggctactcatactttcatattttcctaatgtttttgttatgttttagtatcacaaaactcatcaacttatatttaattgtttaatcacttattacactgtgagctgtgtacgccttggtagggtccatgtcttacctgtgattgccaatcgcctagtattcttgttgaggaaataagggaaggtgaacggactgaatagccacatgatggttgcattttaggtgtatttatgacgaaattttaggtatctggtcattcccaaatattttccctttgtcttctcactcatggcactgaatatttaaataccaatatgcgattaacaaggtaaagttagaaccacagaaatgcctcagttatccagaggaaagctttccaggagcctcagaaaatgaaccagatgaagacttaaaaatctatgtatataaatagaagaattctttaaagagaataaaagacattgatgagtcgaaagcagtgacatagtaaataactaaagagccaatgatgccaatatttcatctgttgagatatgacttaaagttttatgaacacaaaggaaaaggctgattctgatttcaaaaattaagcagctcttgaagctttaattggcgtggctacagtatgacacagaggaacactgagggagctagaccatagccgtcgctgctgtgagacacagggagccagaatcctttcacattttcctggacatgtcaacctttctttgtttcttttttgactgctacataatcatataggcattgcatactttttatggagattctttcttggtggaatcccagttttaattactgtttccatgtaagttattgttggtgagcagacaatgccttttccactttttaaaataatgccatagaattccatattactaccatgcatatatactaaagtttctcccgcctcatcctttttttaacagattggtgggggtctcactctgtcgcctgggctgaagctcagtggcatgatcataattcactgcagcctcaaactcctgggcttaagcaatcatctgctctagcctcctggttagctaggactacaggcatgtgccaccatgcccagctaattaaaaaaaatttttttttttggtagaaacagggtcttgctgtgtttcccaggctggtcttgaactcttggcctcaagcatttcttttgcctcagcctcccaaactgctgggattataggcatcagctatcctgcctggtctttttaaaaggccttttcttacaattgattattatctcattactcctccttttctcatgtatttttcgtctcttctccagtccatttttgctttgagcctctcccacatacacctgccccctcaaatatctgtcatttatcacaaaggctttctcatactgtcatgctttaagacactgataatccacttcttccattaagttgccctgtaccaatcatagatgatcgattgcgtggttatatgaaatagataatacaaaatgaaaaatgaacgtttcttctttaagtacaccttcctcagatacacctcttcccctaccctcagaggtaaccacacttaaccattttctgtgttgtgtaatccttctatattttttctaagcatctatgaataaacacacacacgtaaagtaagatgatggtcaaaatgtttaaccactgcatggtaatataaaacttagcacttaaaaatatgttctattctctaggcagaccaaactatatataattgcctaccaggtgatctatgttagaggttaaatcattcatcaaactattccaataattttcaaagcatttattgatttttaatgggtataatcttttgtttgatgcagctgtcggtagttaagtgatgtccctgtatcaaccatgatttgaaacagggaaacacatcaatctattccaatgattcactcattgcataatactgccacttgcttctttcatttaagaatatacttttagctgggcgtggtggctcacgcctgtaatcttagcactttgggaggccaaggcaggtggatcacctaaggtcaggagtttgagaccagcctgaccaacatggagaaaccccatccctactaaaaatacaaaattagctaagcatggtggcacatgcttataatcccagctactcgggaggctgaagcaggagaatcgcttgaacccaggaggcggaggttgcagtgagccgagatcacaccattgcactccagcctgggcaaaaagggcgaaaaactctgccaaaaaaagaaaaaaaaaagaatatacttttgacatctttccctgtgagactataataaatctactttattgtatctaatgataggatagtatcccataatatggatataagtttatctatcgagttccctactgtttaaatgtttccagtgttttgctattacacgtaatgttgctaaaacattctcttacatctttgtctgcttcggtgcatacttttgtaagatagacttatagacgaggaattgttggttcaaagtagatgtgccaatcaagaatttgcccacttataagtaactacacacatcttgtgtgcacatgcaccgacatacatattatcacctgaaaatataaacccagatgcaaacacaggtgagcactaaattaattctaaaattcatttgaggatttggcaccatgaagttgcatagccacataccctcaggtagacaagacaggggaatggcagaggtaccttggtagaaagtgaaggagaagaagaaaggttggtggtccagagaagtcagtatttccttgcctggaatgagtgcctgcctatcgaattttgataaaacttcttgattgtcatccttgtttcattacggtcctcccaggaatattttgcttttttctaagctttaaagatcatagcttcgtgacttaatctttggactggatttccccacttatatgagaagaactaataatgccacatggagcacaccttttcaggactcaaggagtctaaaaaaaagaaaagaaaaatgagtcagaacttctgcctgtgagtctgagtcagcttagtgtgttaaaaaaaataataataaaaaaagaaaagaaaaaaaaaaccgtgtgaggagacctgcctggaaaaactgctgaatggaaagacttgagaacagcttatagatattgacggcagatgaagaattttcatgtcttttcagaaatggttagcagccactcataacagtcctgtgacgtcacagaaatcttgactcctgcttgtctttctcgttctcctttaagcccttccctcctccttttcatataggaccttaacacaagagggtcaggaagagaagagaagggttgctcacaggaggaaagaaggcaaggggtagctgttactttacctggtgggccatgtgtcgctacaaatcaggtggtctctttggaggagatgccacttggtaagggaggcttcctgagcactcgaatactactagcaactcagaatgtgggaccgctggaaggaaaaacacccctggatggggcgaaggttgagttcaattttattttttactctgtgtgtgtgtagggggagggtaatgggaaatgtgtgttttgcagacacattaacataaggagaatagcggatgcgactttattatcctcattcacgtaaaggtggacatttaaatttttttttacagtagggaaaaagaaccttctgagttgatttggtatagtggaaattgcatggaaatgtttagcttcctctgttttcacaaacatgtaaccttctaagaaaatctctctttgacctatttcaaagtttgatttttttttttaaaacagtttggaaaataggagctaacatgaattgccccttttccaacagtgaaaatgtttgtaatgtaccttttcatgttgctctaattatgaccataacttcttttttattcaatcctgaatctgttatattttaaaattatataaaattataaaacactggccaaaattagtcacccaggaaatagtataagggacccagttaagaaagtaagtgtaagtgactgaaaaagtttggtgccttctcattgaggcagacttgcttatttgtttgttaacctcagaagtattaccatacatactgtctatggatttagatacatgatttttctcaccttctagacatccaccttgttgtgatagaaggagcatggatttagagtcaggcagccttggatctgaatcactttactacttctgtggcccttagcaggctatatagcttctgtgagcctcagtttcctcatccataaaatgaaaataatgtctacaggttagtattgtaacaagggatcactcagattaactttggaaaagctttctgctattaagcatttggaaaacatgagtttctattttttttttgtattttggttatcattattggcttggttttctttctaggccttggattctccttcactttatgtagaatatgatcttcttgtagtagatagatgtgagtcctgccaacagaatttttctgaattggcttcttgtcttttctttaccaatagctgcctattcagttcagctgcctgatcaacatcttgtctctcaattcctgtgtgccctcacagatctattaaagcatcctgagaagagggtccctcagagtcaccaggtttcagggctccagcttttcctggggatcagaataccccttcagaggccaacactctaaggcagtaatgtgtttctctggccaaacgcctgatagtatcttcttggcaagttcattatttattcccctttactggtgtgagggttttcccaaagtgtcatgtctttgcagagtttttcctacccttccgtgctatacgtgtggtaccattttatgcatttgtttttgctaatatgaaataaatcccattataaataattccaagggattttgcagatgattgtactgttcagaataagaggagtgttccgtgaatcatggagctgctttggtacacagtttgtagaagtaaaatgtggtataatgtaattgacccatgggtcccttcttgtacagagtgtcacttgctgagaagtaagcaaaaaagggagtgcattcctgcatctggcaattcacccccatcctgcaagagtaactcatagagcagcagcttattccattgtgacactgactcacccttcctctctccacccccattgtctagtgctgatgtgttctgtccccactaattctagggtcacactgacttatgccttcatcatcctaagtggagaagaaagcttgtctgtgttgatgaaagtatgaaaatagaaatgccataacttttaatgcaaacaatatatgtttgttgaatgtatgaatacaacaacttggaataactgctgacagtgtttccaaatattttgggtctatttaagtaaagagacatgaataatttgaaactggcattctttttcttcttctttttttttgaattagcaatacatgtgatgaaaccttaaaaacaaattctcatagttacgaatggttgcctttagtgagcaggatggggaacagatctgggggcttaggtcattcattataaaccattctgcaagctttcttttttctaaccagatgtgtgtattactttaatgtttttttgatacctcccttaagtaggcccagtccagtttaagtgcaatctcttgagtgccttgtgtcagacactgtgccggtcacccagggctccagggtgaatcacgaatagctctcacatgtgaattcacagtctagttggggagacagaacagaccaaaagcagataatatttaaataacatgatgctggctaagagagaggtagccatggagttaagtatcttcctctccattttattcagccttttgttttaaaattctacctttatgatgtatttcaacagagttctgtgtcatgattttggatttagtggaaaaagaacagaggagattttcttgttaccttaattttcccaacatggaagatttgggaatgaagaaggacactgcaaagagtgaggcctaaaatggaaaccagtcatgatttttattttgctactttctttacggacacgaatgcacacagtgtagagcagccttaactctgaattggaacaaggtcgtgtaagtgccaggacgttatttccagaagcccacagctgctgattcctacacccagtgatttccactgccttttcatgattctggaattcccaagaacagtgtcatcttattagaaggtatttcccagttcgagttggagacaaaccaaccttccctcacaggctgagtccttctggtttcactgccaaagcttccagactcacccagggtctgttagacatatttgaatgaatctgtcagattgttcagtcgttaatgaggtcacactttccatgaagaccatagtggcgtcattttgtgtaccaacaattgtatcaagtcatgatgattttttaaatatcattgaaataatcattaaaatattattgagataaagatgcatgtttattggtatctatttattcctttctcttgtttaagagagaatttacttagatgtgtacaaaactgctttctggcatacttaattttatgggtttctgatttccacatcactgaaagtatctggaatacctatgatgcaatgtgaatcttgtttccactaactagtaagtaaatgctttgttcgagatttaagaaagttggcctggcacggtggctcacacctgtagtcccagcactttgggaggctgaagcgggtggatcacctgaggtccggagtttgagaccagcctggccaacatggcgaaaccccatctctactaaaaatacaaaaattagctgggcatggtggcacgcacctgtgatcctagctactcaggaggctgaggcaggagaatcgcttgaacccgggaggtggaggttgcagtgaactgagattgcaccactgcactccagcttaagtgacagaggtgagatgccatctcaaaaaaaataaataaaaataaataaagaatgaatataattgcaaagataaaacgtaaacccagattgggaataagaagcagaattataccaaaatggaagctgacgattacacagattcactccttatttactcattcaaagcttgcctcacataccataggtaaagtgggtaactctttctgatttttttggttcacttcaagactatatgatcttgaaattttaaataaataagctaaaaaggccctaaaatattttattaaaacccactgagggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaacccactgagtataatttattgatttttataaaactaattctttttttttctgttttacttataagttttgggatatgtgtgtagaatgcgtaggtttgttacataggtatacatgtgccatggtggtttgctgcacctatcaacccgtcatctaggttttaagcccctcatgcattaggtatttgtcctaatgctctccctcccctgcctcccacccccagacaggccctgatgtgtgttgttcccctccctgtgtccatgtgttctcattgtttcactcccgcttatgagagagaacatgcagtgtttggttttctgttcctgtgttagtttgctgagaatgatggcttccagcttcatccatgtccctgcaaaggacatttcatttttatggctgcatagtattccatggtgtatatgtgccacattttctttatccagtctatcactgatgggcatttgggtaggttctaagtctttgctattgtaaatagtgctgcggtaaacatacatacgcatgtgtctttatagaacaatgatttataatcctttgggtatatacccagtaatgggattgctgggtccaatggtatttctggttctagatccttgaggaatcgccacactggcttccacaatggttgaactaatttatactcccaccaacagtgtaaaagcgttcccatttctccacagccttgccagcatctattgtttcctgactttttaacaattgccgttctgactggcatgtgatagtatctcattgtggttttgatttgcatttctctagtgatcagtgatgatgagctatttttcatgtttgttggccgcataaatgtcttcttttgagaagtgtctgttcatatcctttgcccactttttgatggggttgtttttttttcttgtaaatttgtttaagttccttgtagattctgcatattagacctttgtcaaatgagtagattgcaaaaattttctcccattcataggttgcctgttcactctgatggtagtttcttttgctgtgcagaagctgtttagtttaattggatctcatttgtcaattttggcttttgttgcaattgcttttggtgataaaactaattcttaattgttatcactcagtgaatggtactagtttgatcttcccttgctgattaatccagttctttccagttcacttgaaacccatttctttgactcagatagctttcactttagttccaaattttcagggacatttggtaccaaactcttcttacagaactttaccctcgaccaccattgctggatctgccacagtcagagttcatctaccgggtctaacacgtctcggcttcttttgcattttctcccgtgtctcccttgggtgtcgcagaagcagcaagagattattatcatgtagtagggctccgtaatcagaatgcgaaatccctatgcataaatgctgtcttttctcagaatttcctgacccactttctattttttgagaagacaaaattgacttttttttctgacttcttcagaaatctcttatagtgactggtattttcatctgctggcacctctgacaatgactattacaacgtgcctcagaatacagagtgctaacacctcatcttctaaaagaaatgcttcctctgtaaaagtgttttctctgatgaagccgccatatagaccattgaataggaactgcagaagactccggaacacaatttgatagccgttcagccaagcggctgcaatttattttgtccctgagtgtgaaggaggcagcccaaagaatgttggctctggaggaggaaggcaaggatatggggaaacaggggccagagaagggcaggatggggcaaagattcagggcaccttatgtaatgaggcacagcgtgattctgcccggggcctgtacgtgcatgcagtcgggttgcctccctttcccctggaaatgtgccctttgcttactttttgtttggttttaaagcagctggaaaggatattttttgctcagaattggtgcttagcttttgcagaagctgcttcttgagagtcgtctcttgtcatccctctgggttttagctcagtgtgacgaagctatttaaaatatgtgtgtttttaaatgattctaaaaatgaagtattcacattgttatgcctcactccctccccactattgagtcctgctcccctgacagcaactttccatttctctagcttatccttctggtatttatttatatctgtgtttctaaatactatgtttatactatgatcatttggtttgccaattgtagacattatctgttaggttggtgcaaaagtaattttggttttgccaagatgatagtattaggtaccgacctaataccatcatctttctatgagatggtaccattttagatgaacatcttgtgtccacttaacatcctcccactttctgtagcttcctcatatatgtagatcaaagttcttggttagactcatgatcagattatttgttttttgtttgtttgtgtttgttttgtagggacagggtcttgctgtgttgcccagtctggtcttggagtcctggcttcaggtgatccttctgcctctcatactggaatattatataatatttttaaaaatagctcacctttattatgtattttctgggtgcaagacactgtcgaagagctttagacatgtattaactaatctttatagcaaccatgtaaagcagatactgttattctttccattttgcagatacggacattgagacctgggttaactaactttccaaagtcatgtaggtagtagctggtggagccagacttcaaaccaaagtaaacgaggctccagagtctacttttaaccactacactttttaaatgattaagattttacaaatactatttatagtggagccacatgtatattattatctcttctccttctcttctcttctcttctccttctccttctcttctcttctcttctcttcctcttcctcctactctactcttctcttctcttctcttctcttctcttctcttctcttctcttctcttctcttctcttcccttctcttctcttttggaactcttattagatggaagttgtatgtcctgaatttatcctctaattttcttacctttatctcttcattacctttgacctacattctgggagattgctttaactttatcttgtaactcttaccaaagagttttttttcccctgtgacactttaaaagcccagtagctgtttcttatttttgttctgttcttttatttttcagttctttcttcctaattgagtactttggccctgtctttcatactggtggctttcctgcaatggcaggagatctgcagccatcaggtcacatacatgaacaaggctctgaagagctgacaggataacttccgtgggtggcccaggctcatctggtagtggcccccccatcaggtcacagacatgaataaggctctgaagagctgacaggacaccttctgtgggtggccccggctcgtctggtagtggccccccactgcagagtggcctaggatcacagatctgttcacttggaggatcctcagatgtcagcatctggaagcttttcccttgggctggccagaatctccataatagaaccacccagacttgttcctggggctgtgcacctgctgcaggtgttgtgggagccaagtttggagtgggaaacagaaagatctcattgtgggtgttgactttcactcaattctctcttttcagactcacgtttacccatgcaccaccctcaccaccctgcaagccctccctatttgagtccctagttcctgaggatccctctttcagtttctctagaaaaagaaattcctcctgtcctgccctgggtgtgctgagtgggaaggagggaataaggaagattctctttgccctggaggaagtccatgacacttccaattcctcctccaattcctcagcttttctgaggggctccgtgcaaattggcttgctttttcttggttttgctctttgagatttgtaactttctttgtgctaataggttagtaataacttgtcaattcactttccatcttccagaagactgttaacatttatttctacctctccatttctctgtgtccttgtggaactttactttttaaaaaaacttaattactttcattatgttggaggttgggaagggagtagagatgaacatcacgttgacacaaccatatttgatggaagtccgattagatcaccattggaaatatttgtttcttagagtttgcttcattttcctgttaggctggaggatcccatgatatttgtctcagaataacgggagggttcacttttcattctgtttgagctttcctggtgtatacctttcttcctttcctcttaggatcgtaagtcctgaacaatcttgttctagctcttttctcctcttatcttcatctgtaaatgaaaggggctgagagctggtttcaggcaggaactagatctgacatttaggaaatctcctgttcaggtagcttctcttggccttttcctttcagtgatattttctgaaaacctgacttgccatactgatttaaatgcctgataccagtgtaaggtatagatgtgacttctcctaggaacatagataaagctttgggggtgaaattgacaatagagtgtgtctcctttctctctttagccagtgggaaggttgggtgacttggggctgcaggattccgggaggcctccgtatcgtatgctgcctgtccttagagtccatccagacctgagggctacttagctgaattgtttagtaaacgacgtgggattcagctgcatcatctctatgaagactctcatgttgacttatcattacaaagggctgatggtggcagtggttctaaaccttgacaagtgaacggtttctgcaggaaggctctttggaagactgtgacatcacagacaagacaaggaatatcattagtgaggtcattttaaaattctcagatcttggacttgctctgggcagtgactttgccagcaagttggaagagggcacaagaagtgtgctcatcaaatttgtggcagacacaaaactggaaaggatggccaatgtaatcgatgacaaaaacaaaaatatgtctcaaaatgatatagatatgctggaatgctgggttaaaaataacacaatgacatttcaaagggataaatgtaaaatcttattttggaataaaaaaatcaacgatacataatggtgggagaaaaaaatctactggcagtagttctggtagagaaagacactgaagttttatttgactaaaagctcagtataagccactaaatctgactgaggcaactaaaaagctgcattaatggaacgttaatgtattgaactcaggaagtaacacccctcttcaatggttggactgcacctggcgcctcatgtttgcccagagaagggcaattagcaggtgcctgagggtctggaagcatgtctcaggagaaaccatggaaggaactgagtatattcagatggaaaagaaaactgtcttctccttattagctgtgaaactttaggcaagttaccctggaagcccctgtagcctcttgggtaaaatgtggaaggagaccatttctctgtggtataggtagggggcagaaagaaggaagtactggaggaagagattggagaggtaggaggtggggatgggattgagaacatattcatagctcagggtaaggcattcacagtttatcctgagctgcaggaaaataatatgggcactgtattatctttcaaaccaggacattcagagtgaaagccaggcttattcaataaaacaggacaaaaggtaccaactagggctgttgcaggtaccctagacaaaccaggaggaaaggccatactgccgaagagcactgtcagtagaggacatctgccttttggggtggtgagtggtctgcctttggaggcatctaagcagggcttgaatgaacttctcttgtggaccagcacaagagaagtcgggtggaaatgaacgaaatgaactttcagatccttattgagtactgctacaagggatgctatgttagagaatatatgaaacaaattaaacaggagccatcctggctctctgcaaattcttttagatgtgtatatttggcaaaaagagggcagaaaaaggaactctgaccctttctcaatgtaaaagttccttctgaaggatgaaattaacttaaaggttcagaatctgttcacctggaacaataattctggtgtgctcaggaagctttttaaaaacacagcttcccagggtgccaccctggacaaagagtcagaggaggggaggggcactttaaggaatatgatctgtcctagggcaacaccgttcacatctagggtgagcatccacctactgcatatttagtaaatattcgtgggctctgggcctagatctgtgatagcgtctgatcaaagtccatgtgggagccatcacttgacactgttaggggcttaaaataaatgttgtgacaatatgcaaacactgaacaaatgccaaagcaggtagacgacctgtcccttatttagcggtctgtttttcaggcctagactaccctatccttactggttagaagtattacagcatgctttgctaattattacaagagactgaaaattgctctatgtggaggttgagaccttattggagacttggagcagacaggcatggcctgaaattctctctggatgaggaaggtgtaaggaaacactggcctgagctacatgagtcaaaactttttagcccagatgaattacattctagatacagagagaagctatagaattactgtttagaatctttggagaatcgtggataataaatgggacaggagctggaaagctgagataggcaaacattttctaagttttcaaaaatgaggatactttggatttcacacactgtagatgagagaatctgacataatttccataaaacattcttgaacaggttatgaaacaagcagtttgggagtcgttggacaggagatgagtgatccctaaatgcaaacactggcccactgagaatgttaagccaaagcagcatgatttctttttaggaaaattaaagttgcaaagccttaaatagagcaaatacagcagatgtggcatatctaggatcctgcgagacatttgaggtgtgtgtcagttcacacccgtagcttcctggacaaggctggtgcatataaactgtataataggacagtcagatagtcagatagcatcattcttgtttgaatggcctctccagtatttcacaggcaggcagacatttgacggtagtcattctgttgcctataaaaatataaaagtgtccagtcctttgcagtccttaccataccacttgagtgaatgagtacctaaccagagagaattctcatgtggactctgtaccttggcccctgatttgaaacttttcatcagcaatttagatgagaataaagagaacatggaaatcaaaatgctaagtgatatgaaattgggagggaaaatgaatactttggatgaggccataaggttttgaacagatatgaatagctggacaatggagctaaagcctactggaatcattctttgtcactcagtccacaatattaaattccctatttgtctggaacaggctaggtgctgagatcaggagatgtgcacgccatagcaaggagagcaggaggcagacgtatcctgtaatactttggtggaggtcagccccggatgctataggagcacacaatgaaccagatctcatgaaagcttgaggtgggtaagggcttggggagagctattgaaccgagcaaggagatcagatatctggagaaggtgatatttgaatggttttgaaaaaaaggagttagctgtgatccatgctggggtgagggtgttccacattcaggcagcaactataatgatgtcataaccaggacctgggtgtgagacaacatggaaaaccaatttgcaatgctcatcaatggcagagaactggaagagagagaggtgttacatatttttctcactttagcgttccctgctgctggagtatagaatgtgagaaagactctagggatactctaaaaaggagcagttgtaacataaagggcatgctcttttatcttagaggccagcattttccaaacttacctgatcattagaatcacttggtccttgttacaaatgttctcaggccactttcttggcaaatctgatttcaggtgtgtcagagtgtttcccaggaatctattaagaagatcgctagttaagtttgggatatactgttatagacatggggaactattggagatttaatatcgggaatgaactggtcacattggcattaaagtgggctgttctggctaccgtatacggaatgatttgagaggggtaaatacatttgacactctaggccagaaataatgagaaataattaagaaaatcagtaatagtagacagctgttggcttgagagagactgaagtggaaccaagtgggtttaattactacctggacttagaaaatgagggatgaggacgaggtgattgacggcaccagttttcaggcttgggcttttaggtggtgccatttattgggatagaatcttgcttcggtcaagttgagtttaggctgcctgtgagacattgaggtggagatatacagtaggcagatgtatgggtctggagtctaggagagaagtctggaggaacatagagatttgtgggcccaccatctactgtggtagttaaagccttgggtataactcagattgcttagtgagaatgtttagttgagaggaacagatggtccagaacaggaatctgtggaccattctatgaaagaaagctaatgaggctttcaaatgggagcccaagggggaaaatacagggaaagaagaagaaagaggagaacatggtgaagagtatcaagaggaagagatcgctgagtgctgctgagggattcaggtaagaaaatagtcattaatgatttctgtgtactttctttgagtgagcactgctgtggttgttttacaaatgttgtcttatttaatcaccacaataaccaggtgaggtagcccctgctatttacgtcaaggaaacatggggaaactgaggcagcagaaagggtaaataacttgaccaaaggcacaaagttgataaatgccagggccaagatttgaacataaatgaaaggatgccgaagtcctgtgtgttgaccaccacaatcacttgttaggaaacacagtggcaaaaaggctacaaagggcttgcagaatttaacaacagggaagttcttcataaccttggctctggcatggtcctgaagcaaaccaccgtgcagtggcttgaaggcaaaacaaagaaacagacagaaaggggagatgactttccaaaaaggtgagttgctggttatcaaagggtaatacgggccaactagggatgtcgttttaagatgggaaattgtgtttcgatgctgagaggaaagagtaggtagagagaaattggtttaagattcaagagaggaaattttggttgaattaagatctctaaggaggcatgggagaacagagtgcagaacagcctaaagggaattgcctggactagagatggaaatgtcgtccctctggactggaaggaaggagggatatgacataaggatgcaagaggaggggaaggattacctctttgaagcaggatgtaaggtcttattctgaggggtggcttgttgggtgaagtggtattagtggacctcagcagacccatctaataactttagccatcagcttctttttgccaaccgaaatggttcctattggacttcccccttctggctctcctctctccctttctcctccatttctggagcctgtgtagaaccttcattttcaatcactgcttgttgctgtcatgagtggtgcttttccattcgggaacagaaaagaaaccctcccgataaaatccagtagactagagtggggtagggggaaggaacagtgattgctgttctttccttttatccctcagggaaagaaggggacgaagatggggcgggagggaagtagtgaaggccacagaggtaggaagaaccaggaggtgggctggagcagagccagcttgtttagcaagcaaagcagataaagattagagtaaccatgacaacaggctactggcaaaggcgctcagcatttggggaggagagagggaggtggaatggcttggctgggtataagcccagagttttggaaaatgccgtttcttcccgcagggctcttggttgttagagaaatcaccatagtcaccaacagtgagtgcaagggaaagaaaggagagggcccgcaggaaagattagtaggtgaggtgggctctgctgattcaaagaaagagggagtgactcctctgtgactggaggcacagaagaggattaggaggattccctgtcgattgcctcaattgcctcagtctatctgtgtgtctcagggtacatatatttttctgtttagctctattttctcactcacgctatggtagcaaaggcgccacaactagtatgcctttttgtttctagtttttcaggataccacattttttacttctggagaatgaggcatgagaatatcaagactctgtttttttttctgaggatgctcaaaatgtgtgtgagggagggagggacgaaaaggaggagagagaaacagagaaagaaagggagaatgagttcatcttggtgtaaactcttcacccagcctaggcctgtaattagttaagaatttcttggaaatctttttcccttgttctattgccacccacttctatagctgcttgagaatctctatcaataagaatgtagaagggctgggcatggtggcttacgcctgtaatcctagcactttgggaggctgaggcgggcagatcacctgaggtcaggagttcgagacgagcctggccaacatggtgaaaccccgtctctactaaaaatacaaaaattagccaggcgtggtggcaggcgcctgtaatcccagctactcgggaggctgaggcaagagaatcgtttgaacctgggaggcggaggttgcagtgagctgagatcgcgccatcgcactccagcctgggggacaagagtgagacttcatctcaaaaaaataaagaaaaaaaaaaaagaatgtagagcagccatagaaaataatgaaattatgtcatttgcagcaaaatggatggagctggaggccattgtctcagtgaactaagataactaagtgaactaagaaatagaaaatcaaatattgtgtgttgtcacttataagtaggcgctaaacagtggatacacatggacataaacatgaaagtaatagacactgagagctccaaaagctgagggagtaggagagggagggggttgaaaaattacctgttgggtacaatgttcactgtttgggtaatgagtatacttgaagcccaatccccaccagtatgccatgtacccatgtaacaagcatgcgcatgtatcccctgcatctaaaataaaatttaaaaaatttaagaagaatatacatacttttaacatctgtgaatatagttgttcctttgtgagtaagcccaaagcgcctatatgggaaaattaaaaaaatggtatgattacaaacaaatggtgctttaggtttgagtatctatctcctgataacacccagtgtgatcttgcccaaaaaagcaccagcactgttggggaaggacatatcacactcttccttagtctgatacgtcagactgagatatatatatatataattttatttatttattattatttttgagacggagtcttgctctgtcacttagacttgagtgcagtggtgcaaccttggctcactgcaacctctgcttcccaggttcaagtggttctcctacctcagcctcccgagtagctgggattacaggcactcaccatcatgcccggctaatttttatatttttagtagagatggggtttcatcgtgttggccaggctagtctcaaactcctgacctcaagtgatccatccaccttggcttcccaaaatgctgggattacaggtgtaagccaccgcacatggcctctgagatatgtttttaatataaagtgtatcacaagcatggctttgagaggagagtccactcccttccttttctaccagactactacttcgttgcctacagaaatggatgctggagctaccacttgggccaggacctgagtcccagaatgagcccatagctcacccaggggctcatagaaccccactggttccataagtgtgggtgtttcagatatcattgctgagacttctccgttttgattgaggaggaggtagtaaagtggattcatttccatttccaaatctctttccttccaaataagcatgtatagcccaagatattggaaaaagaaggttcttttgcacaaaggaaacttaaaccaggagatacaggacttgagctttgttctaaactgtcataaatagctgtgaaaagagaaaacattaagaagactgatttccccagggtgcagaggggaacaagctctctcaaagttggaaagagtgttacgattctccaatttcgctatatgtcttaaactactttttagagaaatatctacttctgccaggtggatatagttatcttgttcttctcagctacgttctaattcatgaacacatagatttggccagcagtgatgtcaagtgcccagtgccttggggaaccggcttggcattgagattttattggttaagagagagatttcctgaaccaatattgagctgtttgccaggttctggcttgagtaatttttttttctaataggaagtagaggtggagggacaggtgttgagggtcagataatgggtacggttttagacattttgaatatgagccattcccttccagcgggtcaggagaatggtctctgacagggagagaatgttgggactccttaccgtatgggactagctggggcatgaaagtggatgacttctagggaaatcacatggagaggaagaggggctgaacacagaatcccagctgacaccaacggttaagaaatgggaagatgagaagcctgggaaggagagggtgtaggaaaactgggaatgaatcatacacaaaagttagattaagaaagagtggtaaagagaaggaagtggttaccagtgtctgtggctgaagagcaggactgagaaatactaaggggttctgtctccatggggatggtattgctgactctggggagagatttttcctgaagtggggtgggggaagcccgatgacccaggtttaagaagtggatgcagcgttaagtggagcagaacatagtgttggtacccagggcaccagtggtgctttgaaaagtcaggggcggctttcatgcctttattttggagaggattaaaaaaaaaatcctggagaatgtttactgagaaattccagagaagaaacaaatacaaaaaggaaatattaaaaaatataaccaaacagttatataccccaaacacatccaaaatatatggaacccacatggttgagagaagaaggcagataaatatatctggatgagaaattgaaaattaaattgtgggtaggtattagtggtccttgtgtggttaggagagggctttggaatggaagggcaagggaaatgtgttgggcagttagtcttaggaacccagtactaatcaactcttaaatctacacaatgtagtctctgaggcaagttcattttaaaattggaactaattttttttttaaacccacaagtcaaaatacttagtcttttagatcgtagatatggatgaagttaaatagctctttaagaacagcactgcatggaaaataactaggtttactagctaagtttagcatataaagctctttactgaatggcttctttgtcaaccccaggctggaggagttcaattcctttttatttggtgaattccttaattggattttgtttgccgatcttactttctcacattgtaagattttaataaatcattataatcattccctcatgtcttacaaaaataacctttctgacggttcccgaatgactttttttcttctgtgtttgcatcatgggattattagtgtagcttacaaatgaatcagaaaagggctgtgcagctgagggtatatttccattattttctaggtgtgaacttggagcctgataacaaggaacctgtgaggtcacgcttggctgggagggcacagcaggtcttggcatattatctcctgtctggattattgatgagatccactgcttggaaacaggagagagatctcctatctgcttggttattaaagcctctgcaggaaacaggtttattggtgatgtatgtacactggggcttctgttgcattctcagctcagattcttctgtgtctgttactgttgatgactgcataaggaagaacttattttgttcaactgacgtgtttgttgaatgtctggctcaaaatatacctctcctaagaacttccatgactgaccttttgcaaggctgaaggacatgcttggttacccattaggaactggaccaggaacccaagtctttttctttcaattttcagagttttgcagtttgctctttggcttgtggatgccaacacttagagtttatatagtcagtttctgcgatcctgagatgtatttttttttgcaattgcagttggttgtttctcctcctacagtttgtttagcctcttcctcatccattatcctccaggctgtatctgaagtgggcataggaggagtgcccttcccatgacctgcacaatgttcacagcccctttcctgttggtggggcttttggagaagttggggttcccttgggggattggcagttacaagatttttcagatgaggactgtggtttatttggcaattcaatgccctaagagacttaagagcattcaggtcgatttgtttccactttgttccacgtgtgagtgaccaaggcaaagatctcaatctagacctagaagcaatttttaagcctgaaaagctcacttgtctcgattctctgtttctccctcctccctctgcccttaaactaaagtcaaccatcttgaggccatgtgaaaaaataggcttggatggaaaggtgcacccttaatctaatctttgccatggattggccccctcgtttggtggggaactcttcatgggacatgttgaaaaagacctcacatctttatcattttttaattcatgtttcttaccatattgaattggtttttgccacttgtaacaaaaggattcctgatgaatgcctcctgtgtttggagtcttattttattcttcctctctgtagctgcagggtctaatatatacctaatttataatctgtgtaggtgccaattacatatgtaattgtgtgagcatatgtatataaaaacttagaagcagatatgcccctgagagcaaaataaagaataaagttcctaaaacatacagagaaaaagataatgtaggagaaagaaagcagacgttttaaagtatgcgttgtttgagcttttatgcgtctgtcaaacaaccctgaaagttccatcacgtgtgatattttaaattttgctcccaaatggagaaaggcatcttcccacccctctgctgtgagtcaaaccactcaagcagggctgtggctgtcagtgtgaagccagctcttccaaggacccaggggaagctgccatcgctgccgtttctgcctctgcctttctttgctcaaaagttggcaaatgctggtcatgtcgtggatctatttatagtaggcacacgtctacccaccttgttcttttcttagcatcaacttgacatgctatcaattatccatgaggtgaatgacaacacaagggaagttatttgaggcaggtgccctgaggtgagagatgagggggtggcagaggtcgcacagtgacagctccgaatgaaaagggtaaaacaaacgtcccttgctgcatctggctggtgaatgattgcagacaggttggtgggaaaccctgagctggtcacgcagcagtctcccactgcccttcttccctgtgcctgctgatgtttgaaaagcccatttgaaacagacaaggggcaggacctgaagatgtgatctccctccagtggaggtcatttttgttattctcttaagccacaggaggggaggacacaaggacctcctggggacagggggtggatgtggcagaggctgatactcttcctccacgtaggagcatttctggtgggagtgaagcagccaccgggggatgaaaacagggtgccccattcctcactgcctttgaaccagcagggaggctattcctggcagcagcagtgcacctgcccctggcccacagtgcctcccaccttctttacataaccccccatgacccctcttggattctagactaccctgtttttgctcctcctcactgacaacatagttcccagttaggggaactactacttcttcttctcctccccctccacgctcctcctcctcctcctcttttttaatgttgtaatagaaacattgattgcccatttcagtgggactggctaccctggtgtcctttttttatttatatgccattaatttggggctgctctgtaggagctggtggcatttactctcaaagctgctctaacgatgatgctgatgttattgttttagctccaggaattgaattgctcatggcaatagaggcgacttctgctttgtctgtagcctcatagatcacccctcctgtctatgtcctctgtccaccttggattttgaatgtgaagagagagagaaagattgaattatggtcaaagagagtggaaagcaaattaattaaacctctatcagccttgccttcagatataaactgactcagactttacaacccgttcctctctaagtttgctcaactcccctcctcctgctcccactctgttccgttcctttgggcaatgaggtactaaactacctctgtgataaatgtgtgtgttgattccttagggatagagcggctgtgccctgaaaggccttggaaccctcgcaaaattcctaaatacatgtggtgggcactccagcagttgctggcagactctcccagggatcccggctgagtttaatactgtctgccaggctaatccactttccggggcagtgtctagcaccagagactctctgtctggaagtatcctggccatttaaatgactccaggttcctggggatcagtttgcagcctttgttatcttttggcagagccaccttgcttttcctttctcatcttctctgtagtcagaccactcaagtgtaactttgtttattatttagggacctcatggggagaagttgagatgattatcctgagtacagaatagccaacttccaagtgggtattgtgggtgtgcgtgtgtgtgtgtgtgtgtgtatgtacattcgtatgtactagcatgcactagtaacacgtgtatgtttgtgagtgatactggctgtctaggaaggatgagtagggtttggatgaatctcttttgcaggaaccaaaacaggtgcaaaatacccgtgtcagagtcctcagatggctggtgagtggaggtgtagcaggacaagccgcagacaaaacccctcagacactgagttaaagaaggaagggctttattcggccgggagcttcggcaagactcacatctccaaaaaccaagctccccaagtgagcgattcctgttccttttaagggcttacaactctaagggggtccatgtgagagggtcgtgatcgattgagcaagcaggggttatgtgactgggggctgcaagcactggtaatcagaatggaacagaacaggacagggattttcacaatgcttttccatacaatgtctggaatctacagataacataacccgttaggtcaggggtcaatctgtaaccaggcccaaggtgcggcgctgggctatctgcctgtggatttcatttctgccttttagtttttacttcttctttctttggaggcagaaattgggcataagacaatatgaggggtggtctcctcccttagcggaattccgtacattttgttctaagttataaccaaaaaactgaagtttataaatatgaggccttccttttccctctttgtagactaaagtttgtgaaccaggaccccctatcgatacctttttagggattgtgagatctgactttttttttttgtattgttgattttgctatttctcagggatgggagttcaccacccacacttttgtgctgttactatttgaccacctcttcctctttgctccccccacaacttttattatccagggagaaatcttttggaataggatagaagaggtttctggggataagttttggaaataggcaaatttttagtctgaaggacattgtagtaggatttatgattctgaaatgtagtgattgtatgtagttatgtatttgggtacacagccttatgtacattgcgttaaatacatttaaataattggataatgcctagacataattaataaagtgatgctgctttgtttcttttgttattatcatgttattattattttatatcatcttatgcttgctttttggttctgaggttgattgcaagggttagaaaatgacagcgtacaggtcaatttttgtaaataaagttttattggaatgcaggctggctcacttgtttatatattgtctatagttgcttttgtgttacaatagcacaggaaagtagttgtgacacagattacctggccaacaaagcttaaaatatttagtatttggcctttcgatacaggtttccaccctcaggtttaatttagtcttttcctttacatactttcaaaagtgctagaacaatgctttagaaagtgctagtgtctttaatggaagaatgagtcattatctatactcaagcatattctaaaccaatcagaagagcttgagagacacgtctgaaacgtgtgtaggaacacatatgataaaaatatatgaaaagatactcagcagatgtttgtcagatgccaccaagtacaaggtagcttttcaggtgctatgagaggtactcggtgaatggaataccatcttattctcagagagttaactgcccaataggaggaatctgctaacataacagagatgtctgatagtggctatagacaatatacatttttataaaactgaaaggaggtagaatggcttttgtagccaagtctatgtgtagaaaatttggaatggaaattaagaaactgtagtgatgactgctgcttctaacagtaaaggaaatatttatgtgtatcttccagatgtttactgaagtagaaccttagtaagttatttgacatgaagcccaaagttataatagacacaaagatgcttcatttcaagccttagataggaacaaaaatatgattgaaaccaaaattagcctagaactagaagtggcctttacagatcatctactaatatcctgctcattttgcagctgaaaagactggggctgagagatctagttgtataaaattgtctctgaaacctaggacttctgacttccaggtctttactaaattccagtgtaatttttaaaattttcaagccagattctctgtggatgtggagaatatcaacatgaagtcttgcactgccttaaagatcttcattagcatgctattcctttcctttatcttcctgagtccccaaggtcacagatgtaggagtaaagtattgaaaagccattcaggactctgtcttctccccgttgccttgttgaactgcttatgggggtgatgttcaggggctgggctagggcattccactagagtgcccaatatctttatacagatgctgattgctgccctgaatacccacagcaggaatttttttgagagaggaaggtgagtgtgggcaattgggaaaacagcccacaggtaatggagggagggaaccttaagtttccttttaactgccaatcagtaattctttgttcatttattcaagtatttattaagcacctactatgtgccaggctttgttctaggcacttgtgatacaacagcgatctacacaggatcctccccttgagggctttgcattttggtgtgcttcatggtggaggagtgtgtttttcatggtgaagccatttggaatctgccaggttgaagcactgaaccaggagtaggaagacctgcatctaggcctcagcactaccccctcaccagctctatagccctgtgcatctcatttctctgcagccgagtcctttcttgttagaaccttcaccctggctcctctacgacaagggtatctttcttctttattctggtgcttgcctccttatctggtttccccacttcttcttgcccttagtttctgctgatatgttcttttgtccagttgcctcttactgggtctccctgatgccagttgtgtgtccctgtgcaggtctctgctctactgtgacaatatgttctgcctgtttgcactttctcagtctttgcacttctgctcctacccaaccccactgagcaggtctagctccatatcctggatcccacccataggcttatccacaccagggagagttccacccctggctatgtctggaatcaggacttgctgcatgttgattcactcattcagcagtatttattgagcaccatttagggatgtgattggaagaagatctagtctcggtgctcatagacctcatgtgaaccaatgaggaatcagaattgaattttgattaaactcagggaccctgattcctcaaaaaaaatgataaatttggagtaaacttcaacaaccctttaagctcaagcactcagtccacaaaatttctctatttcagacatttctccctagcccttaaatcctctgtctacaagctgattgactaatatattcagctaaggttataaaagcaaccagggtttcttaggcagccaaaaagaagtcagagagcgaagaggagagaaaaagccaagaatgccatagatcctggatcaggtgggccagctaggggagcaaggtgggaagtacaagctttttgatgcctgagaccagtggtttgagtggggagcttgcttgggaaaaatcagcagggtccacagaaatgaaaggggatgtctaccaggagcagctaagaagagccgggagggaggtctggggggctcctggtcctcaccttgttttagggtgctgcccttgcctttttcaattaaagaaacagaaacagcagctatttggggttttgagcatggaaaggtggaggacagaggagctgtctgagttatcttaagaatctggttttactgtttattgaaataaaatggtcagagcttgaaggaaaaagtaatttaatttataaatagttgctgatcactcttgtgaatagtatattctgttgtcttcagaaataatcctgtagacatcacctgcatgtcaatatttggttcagaaaatataatcaccagttgctgttattgtctataaggcacgatactaaattatcttgtcatctaactcagtttttatcattatctcttggtaattttattgaaagaaaccagtaacttgtaaatcataaaaagatgaataatcccagttataaattcttttccttaacagatgtctttaagacaatctgacttaagttctcaattctgactaatttttttctaatggtttttagagagctgcatcatgatctgtgtgatgggatatgtttgggaatggtggatttaaaatggatttctgatagtatatgaagggtatatatctttgaaaaaattgaaggcagaaaaatatacagaagaaaataaaagttccccatggcttcctcttttccaagaactaatactagactgtaagaggactgtgaggggcagatacattgtctgttttatgctctgtgcctgtgtcaaaaagtgcttggcaaatagaagggactcaataaatagttgtaggatgaccaaatgaatattttgtgcgtttccttcaaaccttttttctatagatatatgtatgaatactatgtaataatgattacttttatatctttaaataatattctgtatttcagttttatattccgcccccattcttttttttttttctttaaccacaatagatgtgtttatatacataagtttttcgggggatcagaagaaagtataatacaaatagtattatatgtggagtgatttaaaatgttttgtttatattttaatagttagtgactaagaaatttgaagtcagccttcctcctttgccttagtttctcagctacaaaactgtgtttgtagaattagcacttaggtacagagagccaatgttcagggatgataatgataaaatgatgttatatagataggattgagagcttatttactagagtcagaagagcctgaatttgaatcttttccctctcatagtattagattatgtgaccttgggcaagtgaccttggacaagtgtcaacctttataaatcttatttccttgtcgtaaaatgtgtttgcatttgttaggattggctagctagagtgtgttgccataacaagtcctggaatctgatcaatttagcaaaacaaaagaatgtttcttgctcacacaaagtctgagtagagcctggatagtgagtggcagtaggggtttaggttgcctactctttgttgtgctgccatcccatctaaacagatctttaatgtctctgcagcaaaggaaaaggaagcttggtgatggtgttaccagtagaaggtctccaggttcttggtgtcttgaacaaataattggacaaaacacacgtacaaagcaaggaaggaatgaagggttttattgaaaataaaagtacattccacaatgtgggagccggcctgagtataggggctcaaagaccccgttacagaatttttgggagtttacataccccctagaggattccactggttacttcggttatgccttgtgtaaatggagaggatgaggtaaagttacaaagtcatttacggattatgccctatggagagggtattttctgttatagctgaagtgtgaatcggccttatgttccctgcctccagaccctattttcctgcctcaatggcacactagctcttgctgccttgacaatgaagttacacattacatattacttctgctcacattttgttgtgcagatctagtcatatggccacacttgagtacaagggctgaaagtaaactttttaggtgcttaggaagaagaggagacccagaaataggtaagcactagtagtttttacaacagaggtgaataatagtaacttcaatcaaaattggtgtgatctaatcccctacccgcttgtgattaaaaaaaataggattacactttttttaaaaaaacctaaattattaggccaaggagcttcccactagcaaatcgctagaaataaattctcctcaaaatggcttttaatgattttgaggaattcccagggtcctgactcctgggtattttcaaagagatcttttaggtttccccattctagtcccttcatcttgccccaggctaactctgatgttttgagaggacttctttgttgtgcctatctgtcccccattggtggccaatgctctccctagttcttttcaggacacgataaggctgagttgatgagaacatattaaagtcttgaggataaagccagccaaacccaaggaacagcttacacctgataccaggtgggtttggactcacaacctcagatctacacctaaacttcagagtctccttttctgctagttcttagctcggttccatcttttccctgccatagggaataaatcaagcctgtgcatgcttgagcacctagacccaaatggtttgccctatttctaggcttaaaaaacaaacaaacaaacaaacaaacaaacaacatctctggattacttcctcccaggatggctgccagtgggaaattcattttcctccagaagagatttcacagtgtggcttggctccctgtctctgaatatgtaatgcgacgcttgacagcactttactctaaatctagattattcatgcgcaaatcatgccaccatggggaccaatagcctatccagattgtgctttgtcaagtttgtatcaccttcatgtgacttttcttccagcagttgatgagggaaaatagggctttacctctctcttgatattctaggtccagctccatcacccaaaagcagatgcctggacaacttaagcacagtctctccagaacaatccagaatgtcaagcattgatcaattttaatttaagctttgggaaccaaaccaaaccaaaaaaacctccaaaacaaaaacaagaaacacccctatctctgcacatacagttctgttagtgcagccaattccatcgttaaatagatacagtatccccccttggaaagccccccagtagatgcctgaaactgtgaattgaaccaaacttgattcccatcaattgtagcacatttctgtttgtctcttccaccgacaaatttaatgccttttccatcttaactaagcacttgtcatagactgtggccataatttttgcaatttgaggtgcaacagtaaatctagaacgaatttatttttccttcttcacgttttcaccaatgaaattggtcttactgtagatcttagtaacctcagcatatgtttttttttctatcctttttaagctgagaactctcatctattcactgaaagaaagcactttatggcttctctttggcatatctgagttgccaccatcactactcttgcattttggaaccattattaagtaaaacaagggttacttgaacacaagcactgggatattgtggtagttgatctgataattgagcccactactgagtgactgagggacaggtagcactgacagcatggataccgtggacaaagggaggattcactgcctgagcagaatggagcaggacagtgtgaaattttatcatgctagtcatagtgatgcataattgaaaacttgctgtttatttctggaattttccatttaatatttttggactgcagttgactgggtgtagtaactaaaaccttggaaaacatgtctgaataaggggggactactgcatttaatgtgtttgtctgaaggttttatactgggtgatttctttggacgtagtcttccccaaggaggagagagaggtactcactgccttccatctacataaacaaaggggtcatcaaagtaatcctttccataacaccggctagtttgtatctaacaacaaaacaaatacattcttcactttataaggcagaaacccacaaacggatgtttttacagctgcactacattttttttatttttatttttaaaatattattttagattcagggggcacgtgtatagatttgttacatgggtatattgcgtgatgctgagatttgggcttctaatgatcctgtcatccaagtagtgaacatagtacccttatcttgttccagttattagggggaatgcttccaacttttgcacattcagcatgatgttggctgtgagtttgtcatatagggctcttattattttcagatatttttcttgatacctaatttgttgagggtttatatcataaacggatgttggattttattgaatgctttttctgcatctactgagatgatcacatggttttgtttttaattctatttatgtggtaaatcacgcttattaattttcatatattgaaccatccttgcatcccaggattaaagctgactttatcatggtgaattcactttttgatatgctgctggattcagtttgctagtgttttattgaggatatttgcttctatgttcatcagggatattggcctatagttttattttcttggtgtgtctttatcagattttggtatcaggatgatactggttttgtagaatgagttaggaggagaccctccttgatttttttggaagagtatcagtaggattggtagcagctctcctttgtatatctggtagaatttggttgtaaatccatgtggtcccaggtttttttggatggtatatgtatatatttttttaattactgattcagtttctttacatgttattggtctgttcaggatctctgcttctgcctggttcaatcttcagaggttgtgtgcttttaggaatttattcattctctcaagattctctagtctgtgtgcatagagatattcacagtaatttctgataatcttttgtatttctgtgggatcggttgtgatatctttgtcatttctgattgtgcttatttggatcttctctttttctttgttaatctaggtagcagtccattaatcttatttatcctttcaaagaaccaattatctgtttttttgaccctttgtatggtttttgggtctcaatatcatttagttctactctgcttttagttatttctcttcttctactagctttgggattagttttttttttttttcttttttgagatggagtctcactctgtcacccaggctggagtgcagtggtgctatctcggctcactgcaacctctgcctcccgagttcacaccattctcctgcctcagcctcccgagtagctgggactacaggcgcctgccaccacgcccagctaattttttgtatttttagcagagacggggtttcactgtgttagccaggatggtcttgatctcctgacctcatgatccacctgcctcggcctcccaaagtgctgggattacaggtgtcagccaccgcgcccggccaagattagtttgttcttgtttttctagttcctttatgtgtgaagtttagattgttaatttaggacttttctatcttcttgatgtagacgttttggtatgttgtgtttctgttttcatttgtttcaaataattttttgatttttgccttaattttttgttgtttacccaaaagtcattcatgtgcaagttgtttagtttacatatatttttatggttttgaaggttcctcttagtgttgatttctatttttaatccctctatggtccaagaagatgctttgtataatttctactttttaaaaattgattgagacttgttttatgatcaagcatgtggtactttttacagtatgctccatgtgcagatgagaagaatgtattttctttggctgctggatgaagtatcctgtagatgtcaattagatccagttggttcagtgtccaatttaagtccagaatttctgtgccagttttctgcctcagtgatctgtctaatactgtcaatgtgttagaggtcccctactgttatcgtgtgtctgtcaaagtcttttcttaggtctaaaagtaattgttgtataaatctgggtcctccaatgttgggtacgtatatatttaggatatttaagtcttcttgttgaattgaattctttatcattatgtagtgtccttctttgtccttttttactcttgttggtttaaagtctattttatgtgactcaagattagcgactcctgctcttttttgttttctatttgtgacttcactataattttaaagcccagttcccactagaacttcgttttgttagatgctttgactgtaataaaacagccttcgatttttccatttttatctttttattcattatcttttgtaataaattccattatgcataaaattttagtggttacttctgggatcaagcctgttaacccactcacacaattaaattttcctttctgactttattttttttcccccggtagctgagtacctttcttgatgtaacattgagtaaaacattggctatttatacatctaggctttcattctcataagtgtgtgttttaagcatgggtattaatttcattatgtgggtccaaacctgtctctgacttggaaatgacttacgggtgcacatgggtctgcatattaaggtctcttgtggctgtgggagtgagtgggagtgacgggagctactgtgggcattcttgtgtacatctggccatagcagtgggtcccaggctagatcactggcacttctttaattaaggctctgtttctgcccagagcaaatttgaggttctctgcttcttttcctattgcagaaggggccctacctaggaaggattttgaagttctgtttcttcctttattttttttttatccttttggatgtaacagcgcaccaaccactgccagagctgacagaattggaatggaagtaggtgggtgggggttgggggtggaaggagggatggcagtcatcagtttgggaacaacctctgagccaaagaaatgcctttggcatatgagaacagtgtgagtttatctcttttcctgtttggaagaaggtacactataaatccgactctacccaggaactgtttatgggagatcgttattaaagaatagatatttgatttttccattggtttggagaaactaggagtcaggcactaaggacgtgctgtgtactcataacttttctccagctatccataaggctaatatacatttttgacaggaatttttttaagtaagaatttttttttacattgtatttatagatgtaaaagcactgagagcttcattactagaaagcagcccctatggttttcagcattgctagaatcaagagatgatattcttgttgactgttgaccatgcttttccagatcacccactgttgcacattcatgaaattggagtgagcatacaaatttgttgagagaattatcttaactagattcaacctctgtgcccatgaggtactgtcattctcagtgattcaaatagatatttgggtacaggtggtcatgtttggcgagctggtttctgtgcagattcagcacctgtggtttgtttcatcttatcgttcagacacagatgctcttagagcaccacaccatgcattccaatgaaatctttccactgaaaccataacctctgtgatcctaaaaggaaggagtcagtgtacagagggacatgacatattcaaaatcagaagttgggataagccagaaggaaccttgtgggattaattttcttctttaagtgtgggtaatgtttttcgcatgccctcttttcaaacctcagcacttcacttgtccatctgcattttctccaagtattgtaaatgtcaggtttgtgtgaagaggcatctgtaaaactgctggcatgaataatgactctgatgtttatgtacggaagagcgcacctgactttagcactcttattatcttttactaattaaaatcaagaagatgtttcagctagacattgcctgtgcatagcacctgctggattgcttttctccttttggtgtttctggtttggtggaaaggcaagaaaggtgagctgaatgacttggagcaaggaacagtggtgatgtcccatcactctcggacaagcactccttagcctatttaaatttatttttctagttctcaaaataataaaaaaaaaattaagacttagccaccctttttatcagtgaggaaattcaggctcagagaggtgagctcatttacctagttactcagcgtgtgacaggattaggatttggacccagagtcacttctgaagcttgttctacttccaatcttataattaccttaaaaatagggtgtggctgtatagaccagcttttgcatgagaaaagcctcattgttcatgaatttagtttatattggatggttattttaaattatagtcatgtgctgagcattatgtcaccagcaaatcatagccgttttccagagatatttccctggttaaatattcacatgacatttgaacatactgaacagccaagcatgttgcttagttgttatggttgtttttgtgcggggatatcgggtaggggaggggattaaaagtattgggctggtctggctaatttctagtctccatttcttgcagacgacctctgattctctggttttgaagtagggaagtgtgactgtggtgaatcccaagaaacagcttgatagctttacaccatacacctgccattgctgacatactttggaggggactgaagtggagatgcaaagcagtcaggctgtaggccccagggagcttatgaatctgacctcaggggtcctccctgtagagattcctcacaccaaacatctgaactcatgtcaggcagtactgttttaacctcactttttgcccagaatgatgggaataaaatcaaaattgacagacagaggaagctggtctttcctccagaattgataaaccaagatactttaaacttattcccaagaatgtggatttctgcatgtatgtatctcttcaaggttgcataaatggaatttgtgcttcaatttgtcagaatcctgaatttccaaatcctgatgtaaggatttaagtaggagagatacctggatttgaattgttgtgaaatacagtggtaggttgactagctttattccaacagagtgaggttgatagtctttgttgccatgagatgcttcaccttttcccctaccaaccttcaaagacatggtggagcggaatcactgggcaacaccagtgggaatagttcaaccaacagtagttctcacttagcagagacagacctcaggttcaaccttttcttgactgccatttcgattctgcaagtggcaaaaataaactggaaagtggatgatcactctcatatgctctattgacaaataagaaaaacagggaccaaaaacaactttctctgggcagtctggggaataaaagctgctgggaggatctagtgtacacatgcgtgtagcactttttacattcgctaaacccttttatagttactctgtcattggccattctgactatgttgtgtgcagggcaaatgagttttgttcttcccattggagaaaggctatctaaggaagacccatgggaaattagcaagtaagccagggctggagttcccagagaggccctgcatgaggtcccataggaagccgctaggatctcgaggtctagtcgttatttttcctctttggcagattacaccgtaactctgaaagagccagggaagcctaggttgtttgttctttagagtttttaacatggaaggaggtttagaatttattttgcccgtcttttcattttagagatgaggaaaatgagacccagggagatgtgatttcacaggtcaaatagtcctatgacactgggtagacaataggatacctgatgtgaatgttgaaaaatgtgccgtaggagaaaacagccctttaggcacttgacttggcaagctgaggttacttggtgcaaaggaagagatgcccttctttcaggtggatgtagatccatgctgagacacgtggctcagagtgctgagcatgggctggatttcagctcctgatccctctattttcagtccacaaactgcatactctgtgaagtggctctgcatggttttgctggttcacttaaaacatatttggataaaaaacatgactgaatgagggagtcagcttttcattaggtagaggaggtgtccatatgtctagtaattgccctcatttggcacaaatcaacgagacctgagggatgagggatgaatctgtgtcttcttttttatggttatgggcatgaacagttaggatgaaaccagacctgcgtgttctggtttggctgatgatggatactttcaaaattgtatcaaagaaaatagacaatggaagtctggcagactttacaatgagtatctagtaaatcggatatgaaaaggaaaggggggggggaacctcatcttctctgtgaatttctaaaaaagtgttcacataagacagggctagatagtttgaaggatattttccaagcccaaaactgtacaagaggaagttttctctgggagctggaatttgaatggacaaagtcaggttggtctcagtggttaatgcttaaagtttataaacacatctttttgtttttagcacatcctacaaatgcagtttattaatatggcattttatattgaaaggtaaatatcaccataccattgtgaataattctttggtagtgaaaatagccctatcttacagtgactagatccttcttataaatgctcttcaggtagcccaaagttctcctttgtataacccattataattagattatacatataattgtgtagaggtatgtatttaatatgtgtctctcctagtagcttggagtcagtatagcacagcagctaagggtccagccctcgagatctgctttcaaattctacttttgtcacttagtatctacattacaccgattaacttaatcagtgtcatgtggtcctgctaactgcattaatttgtctgtatttcattccgcatctacaaaatggtaataaacataggacatattttatagggctatatattgaatgtattaaatgagaaaatccttgagtattgcttagcactgtgcctagaacatgaaaactcttaataaagcttggctattagtcttgctaaacggtaaagactgtttctgtcttatcccttgtgttatccccagttctttgcacagaacttgtggcacgcagattaatcatagaaattattgaataaattaatggtcccatttttttcctagctccactgtggtgaagtctcagattcccaaggatgtggttgtgtgcagataggttccatgtggccagggctcttgttcagtttagtgtatttattctgccacactttgcttaattccagattgatttgcttttatatgaagatagtaatatatgggaggcattgattcttagcttcttaaaaactgacagctaatgtttagaggcatttcaaaatacagtatctaaataatatgtagggaaacaggagatgtaatttgggttgataggaaatgccttgggctcaagtaagaggttctgggttccattccgaagtctatcagagatgagctttcatgtcacctgcttaaacttaactttttttttttttaataaaacgaagggactaaagtccattatcatcaaggtttttgcttgtgtttgtattttatgacagtaagatgttagttacttttattaattccttaaatgcatggaacagatttgcctttatattatgaatagaatgcagattcaatttctgcaaataatgtttctttgtattccagggaaacttgctgttgaaagttctccttccatgagtatttcttgtaaatcaagaatcttttctaatacaaatagttatctcatgtttctgctttgaaaatttgtatgtattttttttttttttttttttttggtgaaatgaggcatatttgaatgctttgaagtaaaactaataccatttagtgagtatgcacagacccagcatagggaactaagtatttcaatgtttatgattttaaaacactgtcatatttcgtgctgtccaatcacgtttagctttaatagttttccgtccaatttttcggaacccaccagacttgatttttaagagttagttcaaagattgcccaaactttgattcaatctggcttataagagataacaaagattattatttaaagccacagtcattagtgatatgagggtagatatgaaaaagaaaaactgaatagactgcttatctcttactgtgatctgtatgacctctgattaatttaatcatggttctgtatctaatgttgagggcctgcaacaaggtcttgattgacaaaatctattttctcttcatactcattcaggcttcttggaagctaggggtttctgattaaattatgctatttttgtaacccacagaagatcccatatggtcaatttcaagttcccgttactttcagtatttttcctagatgttatttcacttaggacaaacaggatgcaatttgtggggtggttgtttgaccttctcgtattaaaaggttgtaagtgttgtctctttcagctgcccattttagaagttaaatttattgattgctgagcactttagtgcattctctcatttattcttcacagcaacgtgaagaggtaaggtctgctattaatcccattttgcctttgcaaaataagccatagaggagctaaataatttgcccactgtcacacggtaagaggttgagccatgtctgaaattcaggtttatttggctccagaacccctacattagccttacaataagatgcctcgtgcaacctagcttgatggagattgcatgctaaatatattttaatactggaaatggtttactgatgtttccagcattcataatgatcaggttgcaaaatctgtttggacatttattaagagattggaaccaaattaatgacatcttctctgaaatttctcttggcttatcttaggagaaattagaatgaactgaagcagggaaggataggaaagagctatgtgaaaaattaaacactgtgtttaccaatgttgagtggctttctacacaacatgtgtgatctgtgtgtggggccctgtgtccagtgctcaggttatggtcctactgtcattttcagccactgttcattgatgtacactcactgttcagggtagtagagtccacaaaagcatgcaatgtcactgacatagcggacggtagctagcacaggcgtttagtgtggccatgagcctcagctcttgctcctataatttcatttctcaggaattgttgttcttccctgttgctgggtcttggtagggtctgctctggtctatcctaatcggtgtgcttaactttacatttggagtactaagagttgaggttttgcttcctttcttcccagaattgctttggaatccttatgcagtttgctctgctttctttgtagtgaccaagtttatatactggcacttctgaatcccaagaaaatgacttgctattcaattgacatttcaaaatctaagatggtacccttgcaaccaagaaaatataatttattttataaaagaaaaaacccgtctacctcatcatatgcatcagatatacaactaaactgtggtaaatgcttgtacaccagtatcttcagggtcctggggagcacaaaaagggctacttggccaaatatgacagatgattcctgatttgactcttgggggataagtaaaatctaaccagatagagaaaggtggaaagagtattcaagcaaaagcacaggatgaacaaaagaaggaagcaatgaattgatgattagtaaagcaaaagcaaaatagattagcgttgctaaaacaaaagtatgaggcagagggtagcaaaagataagtttgaacatataggtagaagccctaaaatgcaatgccaaggagactggaatttattttaggttacagggcacccctaaagggtgttaaatgggacagacgtgtttttcacacagatgagtctaatttcagcataaaagatggatttcagggccagtagctagagtggaaacagggaaatcagtgaagagatgttaacatggtaccaatgtgaaatgagaaaggagccacccagggtaatggtaatagggatgcagaagatttttcaattatatagaagggcaaattgacaagccatcatgatcagcggtgatgtgtaaaggagagggagtagttgacaaatatttattgatcacgcactctgtgccaggcactttaaaggtcatgagtcacagaagtctggatttctaaaaatctacagaatgactgcaaggtctctcattgtgaattcattctctgttgctgcattggaaattgccctaaagcttagtggctagaaataatatttattatctcacagatttgtgggtcaggaatataggagtagctgagctcggggtctctggctcaaggtttctcttgaggtagcagtcaatttgttggctgggctgccatcatctcaaaacttacctgggtttgaagaatctgcttcgaaggtggatataggtccctagtcacaggggcctctctgcagagccacttaacaagaaggcagctggttctccccagtggaagcactctaaaagatatgacgaagagcacacacgtcagaaactgaagtcttttaaaatcttcatcttggaaatgacgtcaccagccactcctagattcctgacccgcaaatctgtgagataataaatgttatttttagtcactaagctttggggcaatttctaatgcagcaattgagaaagaattcacaaggagagatcttgcagtcattctgtagatttttagatttttatcatctcttccctgatctccctgctcccactctagctactggcccccaaatccatcttttatgctaaaattagactccccaatacttctgttgtattctgtttattagaagggagtcccaaagtccagctcacagttagaggagggaattacacaatggcataaatgccaggagacagggatctgcaggggccctttgagagactgcctaccacacctgtatgactgagtagatggcagtgcattaatgaagattaggaatgcagttgaaagagattttagggggttaatgaagagacttgtttcagatagaaactgttgcctattcaaatggatctgtgcagcagcattagtaatggagaagtagattggagggtggtcatcgttttataggtagcatgtgaaaccatacaagtgaccactaccttacctccttacaaatcattgctcagaggccaccctttcgatgaggtctgtcttcaccaatctcttaaaattttaactcttttttcactctaatatcccatctccaccttttgagttatgcatagcacttaccatcttctgtcacgcccatgatttacttattgttcattgtctgtttcttccaccagaatgtgagctcgattaaagcagagttctttgttttatacactgatgtacacttagtgcttagtagagtacctgatgtatagctgatacgcaatagttatgcaaagaaggataaaactttgtaaaagtagtacatctaagccaaaggtggaaataatccaagtattcattgatggatggatagataaaccagatgtggtacatacatacaatggaatactatttggccttaaaaagtaagaggattctgccacatgttacaacatgagtgagccttgaggacattatgctaagtgaaatgagccactcacaaaaggacaaatacagtatgatttcacttaaataaggtacttaacagtcatcaaatacatagagacagaaagtagaatggtggttaccaggtgctgaatggaggaaggaatgaggagttattgtttagtgactgcagagtttcatttggggaagatgaaaagttctggagatggttggtggtagatggttccacaacaatgtgaatgtagttaatgccacagaacagagcaattaaaatggtttaaatgatacattttatgttatatgtattttaccaaaaaaaaaaaatttcaaaggttgtggacgtagtaattaagataaggactgaagaatgcctattggatttgctaaaacagagacctcagtgagagctggttcagtgggacactgggagctgagatgatactgatgagtgattgagaagtgagggggatacgagctagaggaggcttctttataaagaatgggggggatctcagaatgtttcaggctgggagaagtggtagtggggtgcatgtgtgtgtatgtatgtgtgttgtggagactatgtggggcggggaggccacttggagatacagctattaaataagtgaacaacaatacaaaaggcgggctgggggaagggaggaaggaaaccgaaggaacctttcctgtctacttgtatggaggagtaatgtctgaaattttccaaatagccaaagttgtggcacatgaggaggtttggagcaaacattataatagcttgggttaattatcacagtctgcaccattcagacagtgtctatcagaacccaggaacagcctataagactaagctgtgccaaactgtggaaaggggtcgatggtttagggcagttagggctgcaggttctagggcagttatcatcatgaaaggctgtgataagacattaactgttgaacattcttacagcatattgtattgtaatagactctgaatttgaatattttattatagcaagtatgttgtatgcaaagtactcaggcattgcaaatcaggcaaagttgaaaacaccccagtattattagagctctaccacacagattctgcaacatggggaaactcaatttaatacattttcattgaatacctacctataagcctccgtggtatgaaaggcatacaaaatgtgtatttactatatatattgtaaagtgattatatatactattgtgaaactagatcactatttggtctactagctaatatttatatagatggtattagcatagctattgccacataggcaaagagatccatgttacagatgacagaattgcaggttttctcaagaacttctagtggattttaaagtattattggaaggtggaaacttttgttcagacacaaaagtgttgtactgaagtaaagattgctgcataaacatgcagtaatttatttaaaggtacatggtcctactagagcatgggcagttagtctagaggtcctgatcaagcatggtgtaggacagagagcttgtgtgggatttctatgtgggggcttggcaattctgggattaatttcagcaggttcctgaaggtcaagtgggccaagcttcaaacagaagacctgtggttatgtctattcagtggcgaggccagatttaggaagccgagaaatcaaacattatgaggaacaactagttccagaaatcaaggtcaggcaagggcaagaatgcaaggagaaatgtgagtcaagatagtgtcattgctgtcagaatacacatatgggcctgatttgaagaggaaagggtttgttctagggtttctttcagagtgagaggtttactacgtatggtggtgctaaggcacataatgatgatgaagaagaagatgacgatgatgccgtaatgataaaagctgccatttgttagatctgtgctatgtggcaagcactgttagttcaacaaatatttttagtacctagtatgtgcctacatactggggaaagaacaataagcaaaacagataaaattcttgttctcatgaagcttatgtttacgtggaaggagacaaataataaatctgtaggcaaaaatacaataatctagagaattataagccctttggaaaacacagaagaagcagagtgaatgaagacggtttggaagagggtaaatgtttcatgtacgatgcttaggaaaggtctggaaatttgaacagagatataatactagtatggagacaagccaagcaagtttggggaagactttgaacagagtgagatcaggtgtgaaggccccgtggtagggaattgcttgacaagtaaaaggaatagcaggagggccattgtggctgaggcggaatagtaggattctttagagcttttgcttgtggccatcttaccagctttgcctttgaacctagtgaaatgagaagcccttggaagcttctctgagcatcctgaaacttaggctgtattatcctccagatacttgtgtgagataggtaaaattattattgtaccttttacattaatgaaaaagctgagacatggagagagtttaagtgatttgcccaaaaccagctctaaagctttggaatgaggatttttaacgtggggagtgattttaggttgcacagaaaggatggcaaagggacacaaggacattttgcggggtgatggatgtgttcattatcttgtctggctggtttcatgcatgcatatgtatgtaaaacagtgtgctttaaatatgtgtcatttattgtatgtcactgatacctgagtaaactcataaaatacgtttcaaaaatgagggagaggccttgatggagtttaaagcagagaaatggcattcatattttgggaaggatggattagagatcaattagaaagccattacaaagatccaggaataaaccagtaaggaactgaaccaaggtagtgtagagaggaacaagagaggactttgactgtaaagatgacaagacttgaaaggtgatgagaatgaggcatgagagaaagaaggaattgagcatagttaccaagtcggctgtgttcagaggtgaaccacggtaccattaaccaaaacgtaaaatcccagaaaggcatcaggtcctgggaaaggtgatgacaggtgtagacagactgtgatctggttgttgtgggatatccaggacaggaggtagtttaacttagggagacttctggttgagaactagagatgtggagttggtgtgtaggcggcctattagagctataggcatgaatgccatgccagagataagaaggggtggaggagaaagctcgaaagctctggggagcaccagtatttaaaatgagacatagagaaaaacttggtctgcattgtgccctgtatctcatttcaaactcacaggaaacactgattgtcagtcacaacactctttccttcaggcgtctgtcaacacagtgttggtagaaaccactgcgtttgatcagtgtcaacgagcaagatgaatcctcttttccacccctgattttagtagtgaacatggaaccattaaggagatgaaggagtgtttgaaaaagttagtagaggcccaggagataatcatgtcttgaaggccaagaaaatttcaagaaaaagacagagtaagatacagacctcactcttataagaactgaaacatatccattgtttttggccattagaaggttaataatgactttgtggagtgtggtttctatggcatgagagggtaaaggtcaaattatagtggatccagggatgaaagtgaggactgtgctccccggaagcacaacttggaagtgaagaagtaggaattttattgaaaaagtctgtgttctttttataaatttctttacaaatcaaagagttatttagtttttatagattgtcacatttatttcttaaatataggaatatccttggagtctctttgctaggagacttttgggcacaaagcagatgcccttatttctgggtagtttcctgacctgaagtgtgggacaagactacctgagccttagagccatctgggatggtttcccagctgctggtctaccagcctttgccatctcagagtaagagaagttgcacatggtgcaaagaaaagtgagaaaactgagttttctataaagagcactgctttatcctgagattatctttttttcttatatttgggttgaaatgtctttgtattagtaggcagtatttttttcttttaaataccccacctagcaaaataaaaatttggcacctctctgagttactctgttttttctcaatgattctaattccttaattccttatgaacagccatcttttttgtgtgttttaagtttttatcttctctaggccagaattaatttggagaacgagaactaactagaacaatgatattgttagtcctcaggagctacaggcagatggcctatcacccaagaactccaaaatatagtacatgagattatcctgataaggagattattcttcctaaaattagagctcaaaatcaatcatagtagataagtgtgtaaagtcaccttgaagatatagaatagctcccctgccagccagatttaactttcatgtgattaaaaatattactatgtctaaggaaagaatgtgttaatgaacaaagaggttgattggctatgagaacatgggaaaccatggggggaaaagctggtgatatctgtctgagcactggttagacaagaggaaatgatggcagatggaggcctgaggatagttaggtttcactggcagagaccagatggacccactggattggagaggcccggctatgtgagcctgatgtcaccccttaccctcaatgcatccagctttccttcatcttttcccatgcctactctttgcatttgacttcccaagtaggaggagaatgcagtagtgctggggctaaactattgcttctcatacagactgaaagtttaagtccctgtgtggatcatttctcgatagaattttttaaaccagcattctggatttatccctcagtctcagctctggtagaaaaattctttaatgtgctgacaaagtctggtttctgagcttgtggtgctgaggtctgattgagcctcttgtgccttcagccaggaggaccctggctttccttagatgggagcagactttgacgttaccactgtgttggaccacattgtgacttgctgtaatttttcttttaaagtttcctccaaaattaccattttaaaagaaacaccaaattaaaaacatatttattgaccagacattctgcagaaaaccatgttcaagaataacttttgccatttttcactagacaatttttagaattttgtcatttcaacatttttttctttgtttctcactccaaacttctgtaaattttttattcactaaattttgttcacacaattataggtagtcttgtgatgattgtctccaagctggttccactttctttgtttttaattctgctccgatggattatttgtcttgaagatcttgaaagaagttgataaagaagagcttaatcatagcaaaatttcttagattcttaattcggaccacaagcaaaatggtctgttttaagcttctgctatgaaaaattacatggagtttttctcatggtttcaaattattttattcctaaggctcaaggctcttgatgtgatggtgaacatctgggagaaaaacttaagaaaaaatgtagtcatttgaatgtttgatgaacagtttgagaagttcacaaatttgtaaacattctgattttagtcattcgggttcttcccctacttctttcatctgctcttgtcattatgtaaatagagccctacagaggggatggagaaaaattagtttttgtccaaatattcctctcttttgcatttgatcagaatgttctctgttcttgacgatgggtgataaaattatgggcaaggagaagctttgcagaagggcaaaaggagtaagctggggctctgtgagtattgcctaattgagtggctttgctcaaaaatctttttctttttgatgataactttcttgtgttgttgtcatattacatatttagaaatgaaaataagatgaaatatttacttattgaacatctgcttttctcctagatggggtcacagtctccaagttccctgtttatttaggaaagattggctggtaattcctgtcccctttcctcccttttgtattactttagatatctgattattcataccatctctgttaaggaaaaaaatacttatttccatggaaataacattaggaagtggctttgggagctaaaaatcttcttttcatgagaaaacatttttttttcttttgcagatcttgaaaacaacggcatccttaacatacaatatacacaaatagatgttttgataaagaaaatagatccatataagaactattttatctgagtttacattagacctgcaataacatagtagtgagttgatactaggaagccataaagtcataaaagttttaccagtatgcttaagagaagattctcttgaggaaattaaaacagaagaagtgatatatcataatctttcacaaatctgtataatcaatagcagagatcaatagtaatatagctaaaaatctttgaaccctaaagatattttttgaagggacaacgttttaggaattcttagctcattcttggctgacgtctccatgaaaccagggttgtttgtgattttgcttcataggagaatccttgatcactccgtggaagaacttgtagttccagaagaagaaagctcatgatcatagaatgtgtgatttattaaattagaatctgcattttgctcaaattttgaaattctcagatctttttaacaacaaacatcatgatccagtaccattatattttggttaataatttcggtctaacagagttgtttttggtaactacggaattatcttacctgattttctcagaatagtgaccatgagaaaaatattttggaattggacttggattggaagggaaaagtggaggacaggagaaatcgatcagaagcatttgcagcaatctatgtggacatggctcagattggcctgtggggcagaggggatgcagtgaatggagagcttcaagacatatgggagagagagaattgactgcattcattcatcattgattgtggaggttgagagtgatgaagtctgaaaggaagatccctagcaactgaagtgagaaaaggaccattgcctgagaggggagaaggaccaaaagttcagtttggtgcatggtagttataaaggatcttcagggtgagatatagagcaggcagtgggagataggagttggggtttaaaagagtctcttggtccccagacaaggcatgttaaaatagctgacatttgatgagctttgagtattctatttaataactaattttagatactgtactatatgacagctataaaaataggagctgatgtatctgaaaatatccaaaaagaaaacgaaagaaatcacgttgggtctaataaaaatcagtcagtagatttaaagagaagaagagagttaggctaggagagaaatgtaaaactcccaatttggtctctttcggtttcatttacatggaaatctatgcttgaaagggaaatacagacgactattagaagtcagaaaacaaaggtacaggaaaagaatggaaagtcacctgggtttcccaccacttgtagttttctaaggttaattaaatctatttgcattttataatgagaaaaatatcacaaccttttttttttttaaagaaaacaagctacctttttttaaagtgatttgaaatagaaatgcctctgctagcttctctttttcatgctgagaggacatttcccagcaagccccaaggctttatcgtcttgtgatgtctccaggtcacctcagggacatagtggtataataaggaaaaccaaagggagaatggtagaggcataaaaatgtaatgaattgggggaaggttgattggaccaggcaaaatctggttattttgaccctttgtcaaggcggtcccaggtgtatctctgcccagaagaatatatttcaaatgtcttcagctgtagacttctgaagctacagatgattccactgatttatcacttctcccgtaggttgacaacattttgatactcaaaatgcagggaggaaagaagcataagaagtaggtatgaaagagaaatcacaggctttgggagggagtggtattaaagagcagaagggggataatacccacagaatacctgggatgagttcctcagggaatccttttcaaaccttctcgccctccccacctcatccccttctcacctctgtataaagagctttgcccttttctcctctgcttttcctcctccatcactggctgcttctttttagtctttttgctagaaacgatcttaccttctcaacttctaattgttggagagcccctgggtgcagtatgagtatagcatttcttttcttctttattcccagctactccctacttggctttcatctgttcctgtaactttatataccatttatatgctgcagatgttcaaatgtacatctctagtgcttgcctcccctgcactccacacctcctacttgacatctctgcttagaagtcttgtaggcatcttaaactcaatttgttcaaaaccacatctgcctaattccaatcacatcccaaacacttggtcctctgtcaatgtccccatctcagtaaatgtaccaccatttgtcctgggaccttgagtcatccttggcttttcttttttaccaacaattcatcattagttcattaatagtaatccattagcaagtggctctgctttcaagatatacctcgaatcttaccacttcttaccaccagcacagttaccactccaatccaagccatcactttctggactgttgtagtagcttgttaaatgatttctctagttatacccctcccctttcaaactaattcagatatgttctccacataccagcgaatgtgacccttgaaaacataaagatgttcatatcatttcctggctcaaaaacttatgttggtttctttttgcccttagaaaatccaaggtcctcaccatggcctataaatgcctctggccccagatgcctctccagccttatctcctgtcacctcctccctcgcttgctgaggtccaacctcacccactttctggctgttacctgaacaagctaaaaatctaagggactttgcatttcaagttacctttgtctggaatgttcttctaccaaatattcaattgactgtctctctctctctctctcttacctaatgtaggggtctgctcagaggatgtcatgataccttatcaaaaggaaatcatgggccaggtgcagtggctcacccctataatcccagcactttgggaggccgaggtgggcggatcacaaggtcaggagatcgagactatcctggccaacatggtgaaaccccgtctctactaaaacacaaaaaattagctggatatggtgatatgtgcctgtaatcccagctactcaggaggctgaggcaggggaatcacttgagcccaggaggcggagtttgcagtgagccaagattgcaccattgtactccagcctgggtgacagagaaagactctgtctcaaaaaaaaaaaaaaaaaaaaaaaaaaaagggatatcatgataccttatcaaaatcagcatcccttgccctactcttgatcttgttcttcatcactgctgtcatgatttcactgtatactaagagtgtatttgtttgttgtttgactcgtctcccaggcagtaagctatctcaagcgggggcattgttgggcttttttgttttatgcccaccatccagaagacttcctgcacatgaggcgtaactattagctccataaatactagctgactgaatagcaacgtcagtaaccaagggaattggtttttgatttgcgtggctttttattttgacagccttggaaacaacagtgagtctgcccagttctcacaagtgtctagcatggcgcctggagcagagtttgcacatataaatgtgttgggtaaattagtgaatgaccaaatgaatgaataaagtcactttagtgctttaatcaccagtacatcttcagctaccctttagacccattcattacacagagttactatggcaaaggaacctaaccttgtctaagggttccatgaaggcctccctgaggagggtacttcatcatcatcatcatacctaacaggttctgagcacttactatgagccatctactgctttatgaactctaactgatttaatcctcacaacaaatctatgaggttgataatataattagtcccattttacagatggggaaaataaggcacagagaagtagattcatttatctcaggataggtaactaataaatggtagtctgtttccagagcctgtgcacttcaccactcactatgctatactttttttttttttttaacgtagtcaactatttaattaagttcttaagacatttagaacaccaatttgtgaggataaattccattcgtcagggcaaccacagatcacaggtagccctggagctgaggaatagctttgatttttggtaaaatttgtgagtccacagctttctgctcaatcttgcactgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaggtggcaatgacaaatttctggtgtgttcttcgtagaggaactcgattgaggaccagaggtccagtcacaagtaataagccactagccagctgcttcaggaaaaccaccctcttgcccctgtggcgtccagtgaggatgatcagaatggtcccgggggtaatgctggctcgcagttttctcacgtgctgactgaagggtttttttttgctgtggctcaacagctttcgaggcacatcttcagtaggataatatctaggcattttgcgaagtttaaccacccgggtactgccgttcttgtcaccaccaactggttttgtaacagttgcaagaaccttctccttctttttcttttcaaccttggatttagcggctgagtacttcctcttgtacatggcctttctggaatacatagcagatcgggaatacctgccaattcctctgacaatgacagggttgcggctgcaatggggcttccccttcttgggctttttagccttgaggttaccctttttcaccttgccaccagcatcagccttcttggcttcaggtttcttctctttagtatctggcttctcaactttttcacccgccatcttgcaagatgggaaagagctcactatgctatacttctaagctgaggactgaggatggagtattagctggcttgatggaggattggaattaggcagaagttagcattctgggcaaatggaaccatgtgtgccaagggccagatcattgccagttccatgaaagacatgacaggtttagtgtaaccagggcacagactgggcatataagagggtaagagctgaacctggttattaagcaatggccagattgtataggcctggtaggctgtgctgagtttggacttaccttaggcaaagggaaacattaaatggttttaagcaaaaatgttaggtgtacagatttacttttttaagcagtcacattggtgaccctgtagaggatgagaggatgggctggaaagcaagcaggtggagggcagggagaccgttaggaaggtctcacaatagtccaagaaaggggtaatgatgacctggtctagggtattggtagaggcagtggagagatagtataggtttgaggtaaaatcaacaggccttgtgacttggggtgaagaagtgggaggtgtacagaaattgaggatgactcccagatctctggcttaggatggcaggtagaagatgttatttatagggaccaattagttgatcaattctcttctaggattttattctacagatagactagttactagtacagacacacaagcctttatacagaaagacattcattgtaggattgtttgtagtaggattagaaacaatgtggtgtagggccttgcacaactccaggatctgccattcacacagaatacaatgtggaggcctccctgaatttgcacaactgataaattaattcccgaattacaggatgtccaaaccatgggatataatacagcagttaaaaagtaggatgtgagtctttatggactggtaatggttgccaagataggttgttatgcaaaaaggtatcctatgatttgttttatgtaagtctattcatacacacacatatttacacttgtaaacacgtaacatagttctggaaagatacataaaattttgtaacagggctgcctctagggtagaggattaggagacgatagtaaaaaagcttttttgtcttgtctcatttttaaatttgtatgcattacctgttaaaataataatatgttaaaaatacatcatggagacttgataatgcagtgacaattaagtgattaaccaaataggaataaaggaagcgtgatactaatttataattacctttccattgaaacacttctgaaacaataaaaatttaagccataataataaatcccagggcaaaattaaatatgaaggtaataaatatggggctttgaaatagtgtatgggggatattaccaaaaatcccacctggcaaattattataaggactcaagactttttcggccgggcgcggtggctcacacctgtaatcccagcactttgggaggccgaggcgggcagatcacaaggtcaggagatcgagaccatcctggctaacacggtgaaacccggtctctactaaaaatacaaaaaaattagccaggcgcgatggcaggcgcctgtggtcccagccactcggggggctgaggcaggagaatggtgtgaacccgggaggtggagcttgcagtgagccgagatcgcaccactgcagtccagcctgggcgaaagagcgagactctgtctcaaaaaaaaaaaaaaaaaaaaaaaaagattttttcaagtgtgaaaaaccttaaagttgatgaattttagattgcacttctagttataatattagttgctcatgaagtatggggacctcagtgtctggcaggcaagtattacagctctagtgtaacttaaaggatctgctgtgttcaccagggcatgtgagaatcgtctgcaaaatgaatgcacactataagcaagaagaatacagtgaggcgggaccagaatattagatcaagtttgccattctagccttctttagattcttatcctgcacgtaatcatgctgttttgagaggggtcaggcttcaccagccctcacttatctgtgcagccatgaaaatgtttcaggaccaggttactgtctttttttattcagaacttccttggattttaggtgaatttagaattggaattagtttatagttgcagtggtaaaatttactattggcattacgtggatggcagaaaaccttaaaaaaaaaggcctgagtaacagaaatgacaaagtaaaggtaaattccagctagagagtacttatttctccttactcctgtcccatctgtagtaaaccagtaactcaaactattgaaagtataatacgtatatatctttgtgatttgcaagcacccaggtgattctgatagcaataaagtttgggcagcgtggtgctgaagagtgacactgccttcccaaccagcctcagatgaatcccgtcgagtacttcatttgtgaatcccttcttcaatatcattctgcttgggggcctatggaggagcaaaactctgctggaaaactctgatgattctgcctagaaaatgataggtttgtgttccagggggacgtggagatatattacttctaaattctctgatctgttgaccaaatgcggcaaggctaaccgagaaaatcatctggttttaaaagatattcctaaaaaagttgagacagttgcaactaattcttggctgctgcaaagattcctgctgtggaggggacttgaagcagaacatgcccctcactgccctttgtggctgtaattccatcaagggattctggcagcatacacctcagacacagagaatgtttgacttcagagactcctaggtagactgtgaaacattttaggacacgttcgacatgaactccagctttataccctgtttacatttcagagtcatctattaaaggtgggtatgagataatcagtggatacagaaaatctagttctccaagacattaaaatattatgtgccaagacctagatccttctgctgaccaaaatatcgatggcgtgaaagaccgtgccccttgtatattttacacagaagtccatcatactgaaaagtttgttccttttttgcagtgatcacattggccacaagtcccccaacaggaagagttttgctaatggcaggcagcctttaatcttacatcacatagtctgattctgcccttaaggagtcacctgggccttggagaggaggccgtcttctcctttgttgcccaggactgagagacctgctagtgtatcctggcaactgttgtgctcacctcaaggatgacaagtccctcagaactgtgacttttcttatgttgtccacatttcagaggcttctttttcacatgtgccagcaaatgactgcccacagcaagtctcttgttcttttgaggcagtgccactgagcctggagctgtgtgtctggagccttgcgtatccaaggagaaagcgcttgagtggccctgagtcagaaaaagcctttggcgttgcctctcccttttttgtaatagtgcctctttctccctggctgcggttcccttctcagcctcccctgtttggcatgcccattacacccctggcagggtgggcatctctcctctaaggggccacctttgggttcaaatcccagccccattgttatttacttacaatttgggacaagttacataacctccctgggtgtcattctcctcatccgtaaagctggtccaataacaataacaaccacaacaataatattactgcctagggtttgcttttaagaaacctcccacatgctgtccgacaaagtggatgccccgttgctcactgctgttgttctcaggaggctcacaagccatccagcccacccggctggtttttgttttaatcctcttgagatgctgtgagtgggcagcaccatttgggtgagtcatcactcctcattctaggtgggacggcactctaagcacattctgagaaagcaacctccgagcagtactcctcttgtcctggtagaagagaataggtctcatgatagctccttccgctgggtgggttgtgtaatttgcaacaaggattctaaaaggaagtttaaatcaatcagaggctgtgtatgtggaaacagtgcgattcatgtgctgagatgtttttctacccaggaatagccattaggcactggctttttacgtaagaagcctttgtgagaaggtaaagcatgctcttgttccaaccccttgttagaacttaatctttttcttctccatgcctcacttccccgcccccacataatattcctcttttcattaatttttatggcaattcaacttaatatttccaaatatgcaaatattagaaataaaaatcaacataaaaatatttctatatgagtatgtacacacacacataaaaatatatagtgtaggcattactgagtgctacctgctttcagttgtaaacggacagacagacatatgtttatgccctgcaagaagctccatagcatcttctaaaatgttaatatcacttacaatgtgcttacttactcttagattttatttcttttttcattttcctgagaactgttccttgtagccaaaatgccaattactcactttaaatagagttctaatttcttgtaagtcacaaagaaaaaaaatatgcaatttttcctcttccttttccttcttgagagccaaaaaaggcgtgtctgtgccatttcttctcacgactaaataatgggccctcccacatcccaccagctctgaaccagtacactgaagaaagccactcttttgacattttcctgtgtacagggcaacatttctttatgcagttttattcacattaaccagtactattggccaccttctatgtgctggtcacttcgtggcccaaagtaagacagagtctctgtcttctgtaatccaatcagaagggtcagaaaagcaagtttaccatatagtacaagtagaataggatgagttccataagaaaagataaaagcccatctggaaggagagagtaaggttactggtgagtaaaaggatgttgatatcaagttctgtaagagtcaggtaggaatggagtaaaaaacatgggtggaaaaattttcttaggccagaaggtagagctggttgttatttgtttttcacagaaggagaggcaaaggaataggctagctatcgtactgtgaaatgtttaaataggagcagagagaggtaaaggaggtgcctaccttgatcttggggaattcggacagaaggtattttgcacagaaggtgggagtggagatgaaatttgggacttgaggagagaacctttcttggtcagtgatgacatgtttgctcttggtttatctttcagtctttcaacacaccctgcatgtgttcagcagtctacattattgtttacttttaaagatcgttgagagaatagtgatttcatttttcattacctccctgctgagttttccttcactggcatctctggctttatgtttgagttaacctattctggatccggctgtcttctggtcactggtataaagtagaagtgagtggcaggttgttacagcaatagaatttgatagcagttggagatacctgtgggaattggtcatgagctcgaatagttagcaagctctttcttaggaaatttttacagtcatttaaaggcctttcttgcagtttttattctgacaatgagtcttttcatgaacgttcagattgtctgaagatgtcgcaaaattacaataagacagttgtaagaatgttccgtgattcccagagaactataacattgaatttcctattaaagtcgtgaataagaaagattttgcagagaccagattgtgaatgcaatctcttacacaaaagcattgggtgattcccttttgtctgtgacctccttcctaggtcattcagagcttcaaactcttgctctcagccatccaccttcatgccttgtttctttccttcctactccttacattctggccctagtgggtgactttttgtaaccagcacaaggcattcaccgtcacagccctggggcttcgctctgctttcccctcttgacagcacactttgaacctgattgtttatctggtaaagttcttctcaggctgagctcctcctctgtgaagacttccctacttctctcttccaagcagaattcactccctttctgagacaataccactaatataataggtttgggcttctatcaaggttgtctggttagtcatcagggagcacagagtatttctgagttatacatgcttttccctgttgctttgcacaccctttgttcatttgcatgctacagggcactgctgtgtgtgctcatacttgcttattcttttaggcatatgccatagtattgccctaagtgaagctgggactttaatagtgattctacaagactccatttaatacccaattggtggtctggatgaggctaaaaggaacaacgtttctggactttaagagactttcaaaataggaggggagagggcagtgggtctcataactttccaccctgctccaccatcagactgacacattgttttggccagcatttctcaatctgggtttgccaggaacctagattttcacaatacaaatgtctaggcttcagagcttctaattttgtaggtctggggatgataattaaggtatttcccaagcttggctggtgacttatacagtggactgagaagagttgatctcactgtggctttagccctggctgcacatttgaatcaccgagggaggttttccaaatattgaagcctagtttctacccgtaccatttagatcagattctcaaaaaccagaccactggtcttaggcttctctctgcttttcaccaaaaagcaagatgtagaaaagagcagtaaacagagaggggtgattatattatgggaaaccacagagaagattcagtgtagtcctttttatggcggttatttttgtttctgttttctgattaggaaggagggatggaggataacaatatgaatgcctagaagctaaggacaaagccatttcaggtggaaggattcatacttacgaaggcatagaaatgagcgattacttttcctggtggaaagaccacatatgtggattcatgagggacacccttgcatgaaggacgacagggaggtggtgagtagggaaacccaacatctaggttgaagataatggatttcatgttggagagaataggtagttactttgtttctaagcaaggagtaattttagagataatattgagtttcagtaagatgtcttattgctatggttagggtgaactgaaataaatggtaacacagcagggttttgttcagggccaacttgtgtgataggtgtgacaaggtggctgctttctgttctgcatgtccaatttgataaaccaagatctaccatgggatttgggcaatccatagcttcctgccctctctctactcctgcttctcttgcccttctccacttccatatctctttctctgctaaatatgccattgtcctctatttagggtaaacatctaaaaataggtataaagaaatagaagaaaaataaaaaagtagcaatgatgggcactcacattataaaagatgtaaattgttttagggaagacagaattgtttaaagtatgtatttaaaagcagatatgtgttagatgtttttaaacattttttttaaccttgaaaggaaaagaaaataatgttaaaattttagatctataaaggatatgaatttatgcccaatattgttttaattcaattaggataattattttaaaactggaaaaaggaatcaatattgataatagcaaataatccaaaatcagaaagaatctattaaaaaaactactttctttgaagagtgaagttttctacattcaaataaattataccacagatagtaagagatcctataaatttggtcataggactatgggtcaataatgtctgagaaatagtagaaatgggagagtttctgaaaaattggtggtaagaaaatatccccattcaaaattgggcaagtggccaggcacagtggctcatgccttataatctcagtgctttgggaggctgaggtgggaggataagttgaggccaggagtttgagaccaacctgggcaacatagtgagatcccatatctacaaataaatagataagtcagagatggtgatgtatgcctgtagtcctagctacttgaggcaccgaggtgggagcattgcttgagcctaggaatttgaggctgcagtgagctatgattgcaccactgcactccagcttgagtgacaaaaagagaccctgtctctaaaataaaaattaaaaaaaattgggtaggttaacttacagcttaataagttaatggcaacctctacaaaattatcctaacagtaattaaacagatgttttatgtagaattagaaaagaaaatagtggtcataaagagctagcatgagttccttaaaaataaatgtgtattatgtgtctcatttcatttattggatggggttattatagtgatagctttggaaaattccatagacaacttgtgtctaaatttcagcaatgtatctgataatattttgtgatttccctgtggttaaggtagaaacatatagataggctaaaattaggccaaatcacaaatgttacatcccaccctactccaccctatgtgaatattataaattaattccaagctggagccaggtatctatttgagcaggggtcctgcagttggttctgtgctggttgctatgtttatcaatgacaggtgaatcatacatgaatgcttatcaacttatcaacttgctcttattctcctctgggaaagacagctgagacacatggtgatagaaatcagatttagatatccatagactggaacgatggtcccatatcaactaatataaagattataagtttagaaactgtggcaattagcctttcaccacttgtgctctagggtgttttgtctagatctttgttacttagaaattccaagctgaagctggctgaccatttttcaggattcttcgcagaacaagttgctaagtggcgaggaagcttgaatttgattatttgctaaccctgaaagtctattattctttggaattacttggagaaactgttttatgaaacatatcatcatctcaattgtctatcatacagctaactcacctatctcatccatcaaacttagtttcaaataacttgttgctgttggaataaaatgaaatctatcctcaaaatatgacgactattaacattcagaatcttccaaagagtgcctgcaggttcaggaggcatttccaaaagaggaatcttcaatgctttaaacaagatactggaatctcagttaaataccatttgctattgggagagatgtagtgtgtattttctagggtgacagctttggacagcagcaatttgactgtgtaaaggcttacatatctttctattcctaattttataatgcttaaaatatttttattattgcacattcttgagatcattactagaatttgttgttaatatggcacactttcaattttgattagaacacaaaacatgaaatgttctaaatgtataattagaataaatctgatgcttggttaaaatatttttattgagaagagaatatatagtaggataccacaaaatatttggaaattataaagggtaataacccaacaaatatctgagtattccctacccattttaataacaaagggtaccatcgtaataacctctgaagtctgttgcttattttccttaatctattcctgagcatccccaataagcttaaatttttcacttattgttcccttgctttttattaacatttaaccaaatatttgtatctttactaatgatagcagcataaaactttcatatagtgatttctatgtgccaagcacttaaatgccatacattcatttaactcaaaagcaatcctcagaagcaggtatccccagccaggcatggtggctcacgcctgtaatccccagcactttgggaggcagaggtgggcggatcacgagatcaagagattgagaccatcctggccaacgtggtgaaaccccgtctctactaaaaatacaaaaactagctgggtgtgttggtgggcgcctgtaatcccagctactcgggaggctgaggcaggagaatcgcttaaacccaggaggcgtaggttgcagtgagccgagattgcaccactgcactccagccaggtgacagagcgagactccgtcttaaaaaaaaaaaaaaaaaaaaaaaaaaaggttggtatccccattttacggatgaggaaatcaagatatatagagattaacccgaattccagttcaggcagtctgactgcaaattctgtgctcttcccctctgttccatgccccctgtcaagaatacatagtatagctctatttgcatttaaaatgttatgtaaatgaaatactactgtgtgcaatctgcaattaacacttttagtcaccactgtgttcttgagtttcatatgttttgttctatgcaactgtagttcatttattttcatttgtaaagagtattatttcattgtatgactatattgcaatgtatttatctgttctgctttcatctgacatttgagttgcctttatatttttctgtaataaatagtgctgatatgatattttaactatcatcttgtgtgtatataccagagattatctagggtgcatatcctggagtataattcctgtgtttatgtgcaccttcaatattcctatagaacagcaagctgttttccatagtgatgaaccatgttgtcctccttgtgacagtatgtaagctctatatcttgccaagaggtaatattgtcacactttaaaatttttgtcagtctgtttagtttaaagtggtagaggaatgatgaggaggaaagaagaaaagggggaggaggaggacggggatgaatttccagttatctgatggatctgaacatgtttttctttttttactattaatatttggtttctccttttgtaaactacctgttcaaatctttggttcactttgtgggggaggatgtttatctttttcttattagtatctattagttgtagaaaacatcttttattttgtggctaatctttttaccttcttcatggtgtttttgatgaacagaattatttaattcaattgaatttataaatattttccttctaggatttctagatttttgtgtgtgtgtgttctatttattaaatacttctgttcactttgattttaaaaagatactttcctgtattatcttctaaaacttacatagttttgtatttcacatttccatttttaatctacctgggatcaaatgtatatatgcttcgaggtataaatacaattttatttaatttttctataaggataagcaattattgtgggaacatttgttgtaaagtgtatcttttctcattattctgtaatgccagttctgtcataaatcaagtttctatgtattttttggtctgtttctgactgtctttgtttcattggtcagtttgtttatttctgtcttaataccacactgtattaattgttaatggattataacaggtcttgatatctgctaatgccttccctacttccaaatctttttcgtagggagtcttaactccttttgttctttgttcttccttataaattttagaattagcttgtcaagttccctcaaaagcctgtgggacttttgattgaaattgtatggatccataaatcattcagggagaattgacatcttcaaaatattgagtcttccatggtatgaacacagctttccttttgtttgggttttaatgactttctaatatgtctttaaatattgtctgtacccaattctctcttcaattctctctgttctttttttgaatctctaataaacatgttagatttaccttttttctcttctctatgtctcttaatgctttaataatttatttagatctacattttaatttactattttttctgtttctgtctgctattataacccatttattaattttaatcatgattgtccttattaaaatttatttttgttctttttaaagtatttattcatttgtttatggtctcttctttagtcttagttttaaccccatcttttattttttagcattaatcataattattttatattctatttatgataatttcagttttctggagtttttgctggcttatactcattgattctttttcattctcctgtgtttgtgatttttgatgaggatttcatgtgtcttggtacttttctggaattctttgagacttgggtcttcagagaggatttgatttgcttcttggacatgcagggaaatttatgaagccataagtactttatactaagtatttggattgcagtctgttggataacctagagaacgaaggcatgtaagggctagtgtgtggtcagatatgttggaaagatgtttttccttccatcacttagtgccagtattcaagacgaacatttttcttgtagtctttaagatgagtggaatctttcagatttagtctttcatttttgctgacatcactttagacaatatgccagaagtgtttacatataaatgtatgtatactgttgactgtatgctgactgtatcctctctcctctccctacacacgaaactctgtgactcccagtacccagtggcccataagagcaagaggccctgaaatttaagcttccttagtttcataataaatccatctctgcttaagagtagatgttcattattttatcatatcaagtacactgaagctttaaaaacaaatatttttattatataaagtagtttatagtctcatatttcctgtaaaatgtagtcttctcttttacagttgaggaaaagaagggttggagcagcgaagtgacctgcccagagtcataaagttaatgcgttgaatctggttttctgtccagtccactttccactttacaatgccagtagttctctatttagttataatagatgcctttttcaaaacctttactgtgttttaggaaaaaggtacctttaatatgcttactgaattgcatcttcatggcttctactcgaggtcacttcaaatcctgtttctgtcacctcctcttagtagcctttccctatcaacatcattcccattttctaccacttattcccatcattccattcatagcagatctatatctattagcaataattcatgcatttgcttacttatgtattgtctggtttttcccctgagatcataagctaagcaagaagagggaccatgtgtattttgtttacttccatacaaacagcaattactttgagcctagaacatagtagaagctgaataaaaatattgaatgtctaaaagtctgattctaaaacccatttctttttgctaaatatatttattgaatcggatgtttcctgttatcttagaattacaaccaagttccaaagctgaactaagtatcctacattctaagttttgagagctgccagtggttaaggccagacatctactgggaggactgagatcagaaaattattcctccaaagctgtcacttccactcctgtaaattaatataaagcgagaatgggagagaagatattgcttttttggagtacaatgttaataaagcaagtttaattgcttcctttactctaaatctgccactaagagtagggcgagaggctcaaagagaatattaatccaagttatggttgtctcaaagaagacactacaggtattttaatctccattagaacatatgcttagccaggcttggcgacctggctatctggcagaagagaagaatctgtaaagagacatcttagtggggtactgccaggcaggaataggccacaagttggggtttacttcaagttctggttcgcagaaagtttggaagactgatgccatatctgctgtcaggctcagataattgaaaccttagggataggggtctagtcttgttagtatcctcacaatttggggagatttggaggcaaaaaacaaaacaaaacaaaataattccctgtgtattagaagaatggatcatgacgctaccatcctggtattaactggaagatctaacaagatcttggtcaggatggttgtattagtctgttctcactttgctataaaaaaatacctgagactgggtaatttataaagaaaagaggctcaattgattcatggttctgcaggctgtacaggaagtaaagtggcttctgcttctgaggaggcctcaggaaacttataatcatagcagaaggtgaaggggaaacaggcacatcttatatgaccagagcaggaggaagaaaaagagggtggagaggtgctatgcacttttaaacaaccagttctcacaagaactcactgtcatgatgacagctccaagagggatagtattaacccatgagaaaccacccctgtgatccagtcacctcccaccaggccccacctccaacattgggaattacagttgaacatgagatttggatatgaacacagatccagacatatcaatggtcagtgctgggagagctgtgtgggtcaatggagcgcactaaagctaccatcagtccaagacaataagctcaatgtgccctgatggcttgccaaggccagcgatgctaccaacgttatccaatcagttgaggacactgccttttccttctccttccttcttccaaaatgctagaggaatccgcataggtgaatagaggtacttacgataagcagaccaccccactccctaattcaaagccatttgtaccacaggtctaagggaggagtggtggcatttagaattagaaatgaaaaatgaaatgaacaagatcaaaatgaacaagattgaccagcggaaatcaaatgagactgttaggggagactgttaggaaggatagatttaacatgtcacgactggggaaatagctgttggaaaataaagctctttctcattcataatcagtgaagttgagagtccacattaaactattgaaatagttccctctggaaggtcaataacctaggactggttcttaggagagaattatttaaaataagggtgtttcggcggggtgtggtggctcacgcctgtaatcccagcactatgggaggccgaggtgggtggatcacgaggtcaggagatcgagaccattctggctaacatggtgaaaccccgtctctactaaaaatacaaaaaagtagccaggtatggtggcatgcgcctgtagtcccagctcctcaggaggctgaggcagaagaatcgcttgaacccgggaggcggaggttgcagtgatccaaaattgcaccattgcactccagcctaggctacacagcgagactgtgtctcaaaaaaaaaaataaaaataaaaataaaaaataaaaaatagataaataaaatgaaataaaatgaaataaaataaaatgaaataaaataaaataaaataaaataaaataaaataaggatgttttggtacttcagtataccacccagtctttgatttcctcttcaaggtaaacactgtggtataagacctaacattttgttttaactggaactaaaggccaaacttcatattttcccttggtggtctgcatatttcatctgtgtagctattttaatgtacctagagaacaaggaaaaggaaatacatcaaaagttacagaaaagaggagaccccagtggtttgtatctttgggtaaaaaggccctgtaagggggcattgataaattgtggtataaacaaaccttgatcctggcaatatagtagccaggatctttaaaaaagataaatatttaaatatttatctttaaattatcctttaaattatctttaaaaaagataaatatttctgaatatttgctaatctgggtggtgattccactattaaaattagcatagacctgagttttaatagactagcatgcttggtgcctagtaggaatgcaataaaaattagcttaaaaagatgagtttccaaatgattgttttgtgggctcataaataaagatgcttttaagtgttttattgttttcctcctgaccctctctcagggttatatctttactgcatgttccatatttaatttcatgatcacattgaatatcagagaaataagaaacaagttatgttcatggatactgacctccattgtttaataataatagctatcatttcaataaatatttattatttgtctattaatttacatgcctttttcttttttgtaatttttattaaggtatgtttaaatgcaagttatgagttttgcaaatgtgtacagttgtataatctatatatttattaagatatcaaacatttgcatcactccagagagttaacttgtgtgccttcccaatcagccatctcccctccactcagcaaccactgttctgatttctactgcaataggttagtttttcctgttctataactttatgtataatacatatacaatatgttctttctgtgtcccattttttttcactcagaataacgtttctgagattcattcatgttgttggaagtatctgtagttcattcttttttattcctgagtagtatttcactttataaatataccatagtttctttaatccattctcctattgctggacagttgaattgttttctttttctttactaatatgaataaagctgctatgaatatttatatataattttttatatctaggagtgaaatttctgggtcatattgcatatttatgtttaagtgcattaaaaactgtctaatagttgtcaaagtgatttactattttattcttccagcaacaatatatgagagttcttgttgttccacattcttgccaacatttagtgttctctatctttttattttagtgaaatgaaatcacatttcattttggatttactttacattacccagatagctaaagtattgagcatttttttctgggcttattgggcatatttatctttcttttgtgaagcatccacatagaatttctttcttcatttttgattgatagtcatgctggatataaaattcttggttgacagttactgtttttatttcctttcagcacatataacatatcgtctcactgccttctttctggtctccatattttctgaagaaaccatccattagtatgaaggatgccttgcatgtgatgatttattttcctctagctgctttcaagatactctctttatcttttacttttgacattttgactatgatgtttctagatgtgaaggtctttgagtttatcttagagtttattgagcctgttgaatgtatagattaatatttttcttccccctcaagattgggaattttctgtcatttctttaaatattctttttgcccccttttctcttcctttttcttctggaatatctattatgaatatgctggtatgcttgacggtctgccacaggtctctgaagatctgtttttttcttcatccccttttttttcctgtctctctaattgaacaattacaattcacctatcttcaagctcactgattccttcaactatcagcttcaatctgctgtccagcacctgtagtgaatttttacttcagttttgatatttttaacttcagaatttctatttggctccttttcaatattgtctgtctctttattgatattctctatttgataagacattgctctcatagtatcctttagctccttagacatggtttattttaattatttaaatatttttaatataggtgctgttatttatttatttccccaggctggagtgcagtggcacaatcttggctcactgcaacctccgcctgctgggttcaagtgattctcctgcctcagcctcctgagtagctggaactgcaggtatgtgctgccacactcagctaatttttgtacttttagtagagacggggtttcaacatgttggccaggctggtcacaaactcctgacctcaaatgatctgcctgccttagcctcccaaagtgctggggttacaggtgtgagcgactgtgcctggcctgcaatttttaaaaaatgtctgatcttctccaaaaaaatttttattgacttgctcatttcctgtgtatgcgtgatactttcttgtttctttgcatatctcataaaattttatttaaaacaggaccttttaaataatacaatgtgacaactctggaaatcagatcttctctcacttctctccagtgtttgtttatgttgctgattgtagtattgtcattgctgcttgtttgttgactaattctgtaaagtctattttctatgttgtgtatgactactgaagtctctggttagcttagtggccatctaatgatctaattattggacagatactttcttaaatacctgagtacagtaagtgtccccaattttttcaagtggctctgtatgaattgtggggcatgtcttcaacactcaggaatgtgtaagatggtttacaactttgcattggccatcacttcctgtttgtgtaatgcctcccttttagccagaagtgggacattagggccttctcagatttttcctgagcatgtgtacagtcttatacatggtttggatttgtgtccccacccaaatctcatgtcacattggaggaggggcctggtggaaggtgattggatcacgtgggtggatttcctctttgctgttctcgtgatagtgagtgagttctcatgagatctgatggtttaaaagtgtatggcacttcccccttctccctctctctcctgctgctatgtgaagaaagtgcttgttttcccttccgccgtgatcgtaagtttccggagaccttccagtcatgcttcctgttaaacctgcagaactgtgagtcaattaaacctcttttttttcataaattacccactctcaggtagttctttatagcagtgtgagaacagtcttccacctgtgcatggtcttctaaatttttaggaatacgttgaagctttctgaaacaacatatgtgtacagcttaattccagtttttccttttaagatttttgcttagtttcttatttgccccagttgttatcatcatcttaggccactatggtgttaaaaattcataactgattgttttcaacaaatgccgctggtgaaagtgctgagtggagtctgagccaggttgaagaaaaacaagccatggaatgggggttttcagagaatgtcagacatggcacattacgacagttgtctgagcatagttttttgggaagctccaaatgtattttgccctttccagtggctgctaggctgctggtttttactgggatcaaggagctgttggttttcagtgctactatggagctgagagataaggatggggatagggcaacttaaaatgccacaaaaatcactgttcttattgaggtttagttatttttcgtgaccaaatgcttctcagattgttgcaggatttcttgaaaaataatctcaagagttctgaggaaaatgattttgcccattattgccgttgtttttactgcttttgtggaggagcagctttccaggggtatggctctgctattcctgctagaagcacagaaataggaaggaggtgctgagtaagtagaagtattgcttgacatgtcttttacttcttttgataagtagatgttaattttgatgtagttgaattcatgaatttcttcttttatggttagaagtttctgcatcctatcttgaaaaaaatcattgccaactccaaggtcattcagttttttaaaatgctttcttttagaagctttatagttttaacttttaggtttctatctgtgatccttcttgatgtattatctgtataatgtgagatagggtcaatattattttttcccatgtgaataacctttttttcctagcatcttgtcttgaaaagaccttctctccattggattgtttcaatacctctgttgaagctgtacatgtgggggttatatttgaatctctgttcttttcaattgatcaaatgtcaattctttctttaatagcacatgttctggatttctatagctttataatacgtctagaaattgggtagtgaaagtcttccctccaactttttcttttttatcgaggttatttggctattttatgttttttttattgctatatacattttttaaatcacctggatttggatagagattgtgttgattttaagtatcagtttgggaagttttgatatcttaatgttagtagtactgatctttcaatacacaaatatggtatgtttatttacatctttaatttttatcagtgatgttttatagttttcagtgtaaggtcttacaaatattttattgtatctgtcctttaataatgcatgttttttagtgctattgttaacagtatttttaaatttttattttttaatttgtggttgcatatatacagaaatacagttgacttttgtatatagtgtctgtacactatgactccaaacttactcattctgtagaatgagttgatttttgcagattagttggaatttcaagtaatcatgacatttgcaaatgaagataattttactttttccttcccaatatgtatgcctttattattattattaactttattttccctctctttttacactggctagaacttccattacaatgttgaataaaagtggtgagggcagactcccagatttgtttgaatgttagggagatgatactcagttctgtaccattatgtatgatgttacttatagatttttcatatgtattctttatcagactgaggactttttttttcctcatcaattttttttttctgcaagtaggcctgcaggatacatgtgaagtattagagtctagttaatgatgagttagttgctagtgaggtaggggaaattaaaagaacaagtatatctgcaggccgaactggataggatgaacaaaggccatatgataggaatatagacaagctgggctggatgaagaaacctgacttctctttgtggctctgccaccaacttcctattaaaccttaaagaaggcactttattttatttatttatttatttatttatttatttgagacggagcttcgctcttgtcgcccaggctggagtgcagtggcgccatctcagctcactccaacttctgcctcccaggttcaagcaattctcctgcctcagcctcccaagtagctgggattataggctcccgccaccatgcctggctagtttttgtatttttagtagagaagaggtttcaccatgttggccaggctggtctcaaactcctgaactcaggtgatccacctgccttggcctcccaaagtgctgggattacaggcataagccactgcgctctgccatggcactttattttttacctagcactaaaagatatagctgagagccaggttggtatcagaaagaatttggtagagttgcaaaagtgattttaaaatttgaaaaataagaaatgtgagaagagattgataaggctagacttcctttatctgctatgaaaaaggctgagatttaaattttttgatactactttcagttcactgcaccaagacaaccattcatctgtctctgggtaccttcacatcccttttctccaaaaccacacgcccttggtttctttagctatattgcaggtcttgagatcaggtaatgctgtgttccccagctctacttttaagtaattattttgctaaagtatcttcacctgaatcatctgggatgacttctgtttccttccaggaccttcacctcactgatacaactggcactgatacaccctggcagtgtgtctcctcaacacataggtgtgctctggggtctttgtaggcttaaccattgtgcctaggcctgacatcgaagtaggtagttaggtctttgcctgtcaccacagacatcccattatatctatggcactctgaattacagcttaggaaaataattttaactactttgaatgtcatttgactccattccttagggtcatgcaggattttttcatttttatgagtcccttctgagaacacagatagccttatgagggacagttgccttcagttgacagccttgtgtgggggttgtctagtcagcgataccatcagttttgcaagactgtggttgtgacagtataggcgtccaggtgaaattgaagggggaagggaccaagtgtgctagcatcgaaatggggagtgggatgctaatgatacacttttcttgttgtcagttttactgggaacagccctgtggaaatttaaatcctttcccctaaaatttctttgaagtcccaaaaggcttatgttcttaaggttatttctgttcccaggctaatgcttttcctaaatttgttcaattctggattatctttttatctcagtaggcaaaatctattctgtattcattgacctggatataaaattcagccccttctccaatttccatattcattagacctcactgcctttaaggcaaaaagtagacttccctgaaggtacaagtccaggtgggaaatatggaggagacaaaggaggcatttccatgacagtgtgcaacaacttccaattgagcattagactgtgttcttaacatgctctttatttaccccataccagggcatttgcctgtatgtttatgccccctctcaatcctaaaatcctaacccccaaggtgatggtatcaggaagtggggccttttgagaggtgaataggtcatgagggtggagtctgcatgagtgggattagtgtccctttaaaagagacctaagcaagcacatttgcctcttcctccatgtgaagatccagtgaaatgacaccttctatgaccaggaagtagaccctcaccggacattgaatctgctggcaccttgatcttgggttctccaacctccagaactgtgagaaataaatgtctgttgttcataagcctcccagtttatggtgctttgttagagcagcccaaacagactaagatagcatttcatggacagcatttagtccattgcatgccctggtattataccatcttgtggatccttcccttcctttctattgtgtggcccttctctctcccttcctttcagagcgaatacagagtgagagagcctttggagccagacatctgggctccagtcttggttttatcactgattcactgtatggcttacctaaattacttaaactttctaatatcaatcgtcccattcataaaatgggcatagcaaaacgatccatttcataaacttgctatgcatatttgaggtgtgctgtggtttgctgcccacagggcttctcagaaccaaggtactcatttcaccgctgctgggagtgttggctgctgctggtccacatctgagccccttccgaggtattgtctctgacacaagaagatctctgccatggttatactctccccaggggctgcctgtactcaaagactggttgatgtaaagtttgagagtcttgttcttttaccttaaattggggcaatccagctccagaacttcttgtgaggccaactgaggcttccgttacaactatctcatagtccagcttctcactctgctaatcctgcctcctttaatccctgacaagcattcttcagtaaacctcttgaaaacttctgtctgagagtctgtttccaatcagaaagaaagtgggtaaaagaatttccaatgcatactgggtacccaagaaattattattattgctttgaaggtaagataatttatttcaaggtattttccaggatatggatctatctatatatctatctatctggagatatatatatatatatatttggagttatatctatatctatatctatatatatctggagttatatatatctctctatatagatatctgtctggagatatatatagatatctatatatatctgtatctatctatctgtctgtttatctatctatagctatctatctggagatctggagagatatctatatatatatagctatctccagatagatagatagatagctatatatacatatagatatagatatataaagctacataaggaattctaattaatagtttgaaccatgagtagtgagaataaaattattctaaattttgacaagggaaattgttattgttttattttttaagatgttattttactggagcatattctaattagtctcctccaataaaagcagaatctttttatttagtaattgactctcatctgatactcttgggtactataattttgttgtttctgtatatttgagtattatcaataatccaaaactgatagaggtgctgatagtttatatttctggaaggctagaagataacctgtgaaaagctgatgttttatgattttatagaccgaaagagaagttaatgccacagaggttaagatcttattcactgatagagtgtaaactactcttatatctaatttagcagtctttttaggcatttctttcccgacttttatcaatctcaatttcttatttatactttgactttgcatttgtcttctctacttgttactttactagtgagttaaataaaacttggtcagatgctcactactatgtataagagaatgatgtttttcatgggaatgtgtttctgtttaagtattattagtttataaagggtagcattattatgggaaggcatccaaggtttcatgggggcaactggaaaagagaagtcagcattttgaagttagccaaaccctatcatgctaaattcaaactttgggtgtggttttgaagtatgtgtatttgctagggttgccataacaaagtaccacacattgagtggtttaaacaaccaaaatgtattgtctcacagttctggaggctgaaagtctatgatcaaaatgtcggcagggttggttctctctgagggctgtgagggagaatctctcccctagctgctggtggttgctggcaatcttcagtgttccttggctcatagaaccatcacccagatctctgccttcatcttcacatggctttctccctatgtgtgtgtctgggtccaaatctcccctttttataaagacacagtcatattaggttaggggcctgtcctaatgacctcagcttaacttgatgacctctgtaaagaccctatcttaaaatacggttaccttctgaggtactaggaattgggacttcaacatgggaactttggggtgacacagttcagcccataacagcatgattattttttctccattctcaaggattactttttccctcaagtgataccataaggagaagaatgtcattaactctggagagaatctcagtgaagtcatcttaccatgttttaaaatgaggtttgttgccacatcccacgccaagcccgtaccagtgttgccttatggatgtggttaggaaagttacacttgggaattaaatcctgtctgagaaatgagttcacaagttctcaggggcatttagctgccaggccatttttacacattaagcaaaaaaaaaaaaaaaaaaaaaaaaaaaaaaaagtcttttgggcattgcatttatttacatgaatataataaatacttccaatggcatttggattgcacatttgcatgtgtttaatatgatggtaaatctgtctgaggaaagtgtgcggtgctttctgattttgtattaggaagatgggttaggcagggaagaagaatgattcctttggcaaccgtggaattatttactgactagaagaggaaatcttctgtttgaataacccctttgaactgcctgacacgtggtggaagtttgtcaaatgtttgttgaatgaacagaagtgtccagggaacttagactgttttgagagcaatcaaaaagcacatatttattcagagatttaccatgtacctagctttggctggtgctgtgggggcccgctgatgtgtgtacgaacaataatagcagcaactatcgattgtgcttactctgtgccaagcatcctgcccaatttttttccactattctctgagttaggcgctatttttattttacgtataaggaaactgaggctaaaagacatcaagctatctgactacataaccattaattggtaaggtaaggtgtgtgcttaacttctgcactccagtgcctagtaaacatgtcctcttgctggtagaagtttgcattcttgttctagagacaggaaatttataattaaggcaattagagaagtagtatagaaaaggtgaattttatagtacgtctggtttgctatgtatatgtgtactgtcagcattttataaaagtgtcaggttgtgaaatggttaagtatataccttctggagttagatgcctccattcaaatcttactcggacctcttcttacctgtgtgttgttagacatggagcttacgtgttctccataagctccatggagaacatctattataaaaaaatgggaaatttattatgaaatagggatcataccttattattgtgagggatacgtaaaatatgtaaaaagattcagtgcctggcaaaatgtattttctgttcaaatgtaagcttctcaaaggcagcagtgattggggtctgttttatttgttcttgtaacctacacatttagaacagtgcttggcataaaatagacattcggtaaatacattgttgaatggatatatttcaatatgtaaaggcctgggcttagtcacattacagacaatgaagtagtcagatgtttgcacatctgtgtggaacagtggttcctagccaggatacacattagaaatacctggagggctttgaatggactcattcttaaaccccatggtaggcaaaggttgagtaccaatgttggagaatcactgtgaaggtaacaaacgtagaataatagttgtatattatgttgaagattcaataccaaaagtgattttttgagtgactcaatgggatgagtttcttaggaaacaaaacacaacctttggttcaatagtaattacatctttcaacatttcaatgtacattaaaataatcaaaaagtactttgagttcatatataatatgaagtaggatttaggctcaaataattacgcacagtttgttccctgacataaatcagaggtgaagtttgtgcggggcttgggacaatttttttattgcgtggactatcctttacattgtaggcagcttgtctaagtcagccaaaaagcactgtgagctgctttgaagacaagcaaagttagtgcccatatggtataagaaaaaagacaacaacacactaggtgattaagaactctcttggggaatcaaaccaagacactgagtaacttcttagacagctggttccttttctagaacaacaggatgagttcaccagtctctaatgtgtcaatctttaggaggtgttctgggtaagagacttcctgattctctggtgcttttctgctctgcaagaagaatcctgattctgttctcacgtgcagcatcacccagagagggagctggcaagatgaggatagatagaaaacgggagccacataaacctacaatcagactgaaactggaaccagaggaaattgagagaaatttgcaaagtgggtaattagaaaagggtatctctggcttatttgcatgttttccataaattttttttttttttttttgagacggagtctcgctgtcgcccaggctggagtgcagtggcacgatctccgctcactgcaggctccgccccctggggttcatgccattctctttcctcagcctcctaagtagctgggactacaggcgcccgccacctcgcccggctaattttttgtatttttagtagagatggggtttcaccgtgttagccaggatggtctcaatctcctgaccttgtgatctgcccgcctcggcctcccaaagtgctgggattacaggcgtgagccaccgtgcccggccttccataaatttttaaatttctatttatgaagagtatatgccacatgtttcattaaacacattgtaaaaatattaacactatcatatgccctttacgaatgtggcaaagggattccattttaatgttgaccacacaaagccgttttgatgtttcttaggcttcttaacactggattctaccttatttgcatttatttttaaagagctgctatgaaggatttctgactctctcaggcaagaatatcactgaaatgtaaggcatgggatataattcaaatcatcctaatcagatttctcaacccttgatctaatcagcaagctgtttttcttagcttcttggtcaagttcattcattaactcagaaagcatttcttgaatatagactgtgtctaccccagggctggaatgtaattaagattagtagatggattgagccctgtcctttaggagtttatagtcttattgaatgaagtgaagaaaataatatgatgctacttaaaatgtataatggcttttatattttaaatatattagaggtctttcaggtaattgatattaactgtgatgttgtattattgaaactgcattataggatattttcttttcatatctatttcacagttaatatcacagttcttttcaaagaagcatttgtgattatagccatctcctatgaagcgttgttgtgaaattaatagaaagaatcattggcatttcatggttttgctgaccgtgggcttgagaggattctgagcagaaggaaagaacaagttgaaaccccattgatttttttttaataggagcaaattgcagcataaaactactgccccctcatcccactcccaaccacacaccaagttctactagactcttaaattcgtcatctaccagcaagataaattcaaatagaaaaataactttcgctaacttatatttgaggtctgagatataataaaactattttcttattttggaagaaaatgtgtatgcatgtatgaattattggagaaaaggattttctcccatggttatttaaaagaatggaaagttctaatcagaagttatttcgtacaccctgttgtacctaaatatattttttctatttgtatgtccttttgtgagggcaattagagttacaaactggcagccactttcatgttttttacttatttttttctcctaattaatgtttatgtgtgtagacataaaaccaaccttaaatttgtatccacaaagagaaataagtgatcaacaaaaaggccttacttgtttctattcccaggctagaaaagagtgtgatttgactgtaatttctttcagggttaaatgtttgtatgtctctttatcatatagccacattatctttcatagacacacgtggcttgcatccttgaatcctaatttgattatttcagcaattggctcctcctggcagtcctaattaggaagagtaaccgggttttggcggtcagagtctacaagttctgatgagttaaactcatttgccctgtggtttctactggtgcctgacagtagcgttttgtttcctctcttaaaaaaatttttttgtatcaaaactgtctgggacagttaatgaaaaaatgaaagatctgtgtttttctcattaaaccaagatttagaaattcttcagccattctaagagtttgcacttgggtgtggtttggtattttttgtaaggacacttaatttaggttgtggtgactgttaaggaatcaaatgtagaacctgtgtattctgactcttcagagatctgattttcttatgaggaaaactgtagctcagagtccccatacagagcccttcaaagccagagaaaatcctaataaaaatgctaaagaagttccttcaacataggtggaggaaaactgttttgagatgaaagatcactgtataagattcttccactgttactttcttattgctcgatgatatggaatatgctttggggtgaggggccaaaattgatgttgctaattatttgccttggtgaaagtgaggaacgagaatattgtgtcatcattaaaggcctccatcttcataatgaccctttcggggattatataaagcaagtaaattgtctgttacccagtgggagcttttgaaagtaggctaccagcaagctcgatgtgatcgcttctaactactgaagacctaccccctatatctgggacttcctgtataggaatacaagagacttaaaaaaaaaaaaaaaaaaaaaaaaaaaaaaaaaaacccaaaggtctagacacttgctgagctctctgacatacttggtaattgattaatggttgcacaatcctggattcttactggcttctactcagtgtttcctcaggcttgggggctactgttcatcttgctcaactttacaaattattttttggagggagtttgcagaggtcgctgagcaggatgaaaagattacctgcccttcagggttcaagaaagcttttaaattctgttcctattccttcccgtttatatggggcaagtttcttttcctttggggactcatttgtgatgggagtcaccacagatctggccatcactgctttccttttctccattccactgtctggagctttgttcctctgtgtagtccaaggggttgagaagtctgaggatctgggcctttctggggatccagggtatctgcaggcctcatctcagagatggcagattcttactgcagtgttcaggtcatatgagattagctgaagacagccaaatgaagataaagtaaataatgcaattgctgatgttttctttagagctccccttgatgggctttggaaagttgtggtcccagctgcttaaatgtacatgctcccacagagcaaagtctaagaactttagtgcacagaagagaaccttaggagtgtgtgtaaatgcagcttcctgtgcctcaccctccaactgattcaggactcagagttgcagcatcacaagaccctcctgattctatttcaggtacttctcagaccacacttagatattattataggggaaaagcccctctcccttctagggagtgacttagttcaatcacaaatcagcgctcatgtttaagctctagacccttgtgagacattttttgggaggccattcagaaattgaacttccacggttcctgatgatcccacagatctccctaggtgatctctgctttttttttcttcttcttgctgttcttattctcaccactatgctctaaccgttcttcccttccctttgctcagcaatgatcatatttgctttgctaaagtagcccctcttgtttcatttctttgcagaccaagatcagggctgactatctcaacctctcccaattcataccctcctttctgacgtgaattctgttatgttccactcaacaaatctaaaatctaattagtgtttttaggctttatcttactgtgggtcttggtaagttattgaatgtgcaatttcttggcagatgcaaagcagtcttttcccatttagaacctcaaactcatgtagtcctctgcaggggtaaggaggatagggaaaggatgatattctcgagaggaaagcaaaataacagtgaactttcagctgtaaccagcttggagaatgctttgctggaaaatggaggaatttcagtaggagacctcatgagcccatttttcttgcttttagtcgctggcaatcttaaagttgttcaagtatggtggctgcccaaaccctaggtctttttccataaatgaagagtcaagacctttgctctttccctctactctgaatagaggattatattttaatttttggttctgaagcactatttccccacagtggtccccttgacctccctgtcttttgggacctgccaccctctttggacaccatgcactttagagaggtatattccaatactttggtaaagattttcagatgtggaagaggctaactcaggcattgtttctaccccatgggaaattttgagctctgtatgagattctgatgttggtttttctttgtttttgtttttgtttttcttcttgctgcaggaaagcaatctcccgggcaggcctccagcatctggctcctgcacatcccctcagccttcctgtggcaaatggtccagccaaggagcccagagcgactttggactggagtgtaggtgttggccttttcatttaaacatcacttcagtgcatgttttgtgtctctcattctcaggattcctctagttacaaggaagacttgcttaataattttcaacattgcctgctgacctgtcctcagataccttagctgtagctccattttcaaactcctatgaacatcactcctttatatgaagtcagatgtgttcaagactaagataaaagcttcctgaatcatttgaagtattactgcagctgtaagattaaaaagtacctcgtgcgcagtctttattggtttctgccaagttgacgatgaattgagcttacccttagtgcaacatctcgcaatctaagttttgatttcctcagcttgagctgagtttttctgggtgctttttttcccagaggattacaggcacttcatgtcattctattgcttttccttcctcccttaaccaaaggcagatgggtctggcatcagtaggttgggtatatgagctgatgttaacattttaaccataacacactcacaaaaactattaacttgacttgaagattatagtctgaaactctttagttgattaaacacatttattgagagtcttcagtgagtcgagttcttggccgagtaactgtttctaactgtagacccaaaggctttgtcccttcctgaagcaatatgaggaaaaggtatcaagggagagaagggcttccctgaagttctgccagccttccctgatgatgaaccttgtttagcacttttagttgagtctgaatagaagggataatccatgttctttttctccatatgaaagagaaaggtggggtgggggaaaggtaacccatgccatgatttgatatcctctgtattatagcatttcttcctctcctctcagcacacacttattaatatccttattttacatcttggatgcataccaatgtaaatgctgcccacatttatgaagtgcctggcaaaagactggatgtgcttgaactacagcttctcccttggtggagatattgttaccctgagagtgttcagatgctgcctgagcctgttgaattggtgtatagaaagaatattcctttcctggagtttacttctttattccaggacagctatttaataaactcttaacccacaatagagtatatttgcaccagtgtttgcataattaaaaacaattaaatgcataaacataaataaaacctaagagaggtatgcatggagcaatgatgagagtgtattatgtatcaaggaaccgaaagagttggtttgatattcacgatgttccaaacaaccctgtagtctgcagcagcagggccttctttgaggtgagacattccaggggtagtttaatcatttagaggcgaacattcattaaatcccttctctgcccttttgtgtgacattaggtaagtcactgatttctttcagcttcaacgtcctcatctgtagatggggataatcatggccctatttcatggacattgttaggatcgaatgtgacaataagtgaaaaagttttttttgtaaactgtgcagccagcagatttatttgttaaagtaattgatgaattcattaattcatcaaacatttgttgagttcctgctttgtactagaatctatattggttacttgggattctgaggtgaagaagatacggtttctgccttcaagggtcttagaatcctgtgggcagaaaggaaatcaacacgaaaatacagggaaatgaggacgtcactggaatgcaacaaaaggacattccattcccatttgatgttggaaatagttatcagaaaatgctttttaaaagaagtgtcctgcctgagccagagcttggcacaaggtattattttctgattcctatagagaggtatgtactctaatatttcatcaaaatggtatttttggccagtggtgggaggctgcagtacagaatgagggaaaaacaaataggaatgaaggctgggtttgtgcctagtgatcttttatccctccctcttctccccttttctttgattttaggtaccccatcttggaggtctgttgaaagtatggcatgacacgaaacacttagctgacatctaacaatggtgggaaaaccgaaagcccttccttgagacagtccatctgagggcttagagatctgatgtgtaaggagttatgagatgttactctggaaaaaaaccaacatctttgtgggctgattttggtgtcagcaaacagaaagcaaaccgtgaccaacacactacactcatttattacaatcgtgtaaagcatttgtttcagaaaagaggaaaaagccgattgttaaaaatatttcagtgactttttctttggctaaaactagattacttgtattactttagtatgctcttctgttcaaggagccagccagggatttctttgttctgtttaaggtgcaaaaacagtcacctctctgtgccattccctctcctccactctcttgtttgattccctcatcttctaccattagtctactcttctggactcaatgtatggaaatgagcaatctttatttaattcagtattactatttattgagcaatgaaaagggttggagcctctttgattctttcaaataaaaaggaaggtggcaggagcttataaaaaaggtagggggaactccagtctcttgcctttgataaggtagagggccccaatagtgctaagttgtgcttctgaaggtcttgaccacagtggcagatggggtccagcagggacgacgagggtcctgttgttccctttccccacttgactcttgggtggaaattctctctgctctgtaacactttggctcaggggaatcaatgggggtcatctcaaaggcgtctactactatgattctctggcttctgttactctattcttcttccttcatctgtaaggaaaaagattaaaaaaaacgttcatggtgtgtctgaagttgcaaagtcagagtgaacctggagttaggatcttagtccccaagtttctacttattgtggaatcccaaaagggccgtgttctgacactagcctatgtgccaaagtcatctgaagggacacaagtatttcctaaatatactttggcaaaaggctttgaggagaagtctgtttgtggggtgcctgagatacaggtgagcactgatttagtgcgcatagactataggcacctgcacttcttggccaggagggtgctgttatagcagacagtttttatgctttgggtacattaacttaatacttctctttaagcattccatttttatgttctcatttccttgtttgtgatatatacagtctctctctcttagttttaggttgtttctcaaaatcccaaacattctctcctgctgtgttttactcaaatggcttattatgacttttaggattctctgtcccacatgggctcattctttgaagatttttcggcaatagatatttactgaggctgcctgtgcacagtcattttcctccgtgcatgtcagggatagaacctgcagtggtgtgtggagagtatctggatcagtcttcagtatgatgcctgagtcttctattgacagcagtggacactgggctctacccagtatgaaaattatttcctctagagattttctcttttgctgtctgccaagccatgctcatcttttcaatcaaactgattctatgtatctgatgtagtctttgctttgtatcctcacaacacctctctgttggtagtgcattgtcttacaaaccttagaaccaaattagtgctttttgtttgactttcttatttgtggctgtcagatttcaggctgcttaaaaggaggggcaatgttttctgcttgttttctcttcacagtggagagtgcagcatcatagacctagtagctgcttggttactgatgtcaggggatgaattgattacagtttttctgctcaatcagtgagaaggggatatttcgctgggagttgacaggcactcagataatctctagttcctgaaaggcttggtaggcatgactccaaagtctgcttgaaaaataaatggatttatgccgttttaatcccaagtaactgtctttaaatttccttcctaattcaatgcattgtgttagattttaaggcgcacacagtactttggccttcctactcttcacaaggacatcatcttttcacttccacagtgacagcctgcagcagctgccccctctgacactggatgatgcctgtcagccaagccagttggggtaaaacaagttaaattactagaaaggaaggaagtaatgcctaagaaggaaaaaatattctcatctcctgggatggattccaagttcccagtttagagtgaattagtccatttagaagcatgtctgttccacagataatgtgtatcttcttttaaatgtcacatgtctcccttccaatggagacttcatttggacttccagcactcttccctgtttgtagtactgcagcagagagcccaggaagtgtgtctcccatctgtccccaccatttcataatttgtttttgcccattacactgcctaaaacaaccccctgaacagtggtggaaaagccaccaagatctttcttaaagggcacattggttttaaacccagcacccttgattttattttgttttccttcctcattggcaaactttcttcggtcccaagagctgtggaaaacagagcctcaacacaaacaaagccagatcttcagtccgaaccacctttcctttcctttcctttagttgacgatgctaagaaacactttctctgaggcagatagaaacatcacacagttggtgcactgcctcacagtttggttcagggacaagattaaggaaccagagtcttcatgtgggattggtttaaactgggttatgaaactaggtcatcttatctttagaaaccttgaatgaaaagccagaaggaggcagggctgtgtgtgtgcatgcgtgtttgtgcgtgcgtgctcgtccgtgtgcatgttctcatttcagtcctgtttcctgtgagtcctaggagacctggaccttaattttgggcgtcaggcccccctcttcatcaggtctgagtgtcatcacccacagccccacatctttccccactcccagccccatttcgaaaaactgaagtcagattaatcgataaatgagactgtttgttgagcagcgcataaggaactactcactataaatcagtgaagatcccagtcctggtcagccacgtaaatgaagggacaaatcgaccttaatttcagggactctcaccattcctttattttctgagaacgggggagtttttaaatcaaatcaccctggctgccgagggaaatcatggaattctgtaacttcacagacctgtgagaagtgtctcggtctaatcttctgccccgaggcaagtgattatctaaacaaacgctgtccagtagaaatagatatgagctgtaatgatacattttctagtagccacactttaaaaagtgagaagaaataggtaagattatttttaattccatattttgtttaagcaaatatattcaaaatattatttcaacatgtaatcaacataaaaattattagggagatgttttacattcttttctcacactaaatcttcaaaatctgctgtgaattgttcaaagagaagcacatctcagttagtgctaaccacattttaagtcctcagtagccatctgcgtattgtacagcacaaatctaaaacatccaacatggtgtgttatcaattcttgtcctgaagattttcaaggggaggcaatccactctttttcctttttgattttgtaaggacatttacataggatacatatttataattctcattgtttcaaaacatttttataagcaagcgtcttcattttgtgtggagtatttgcttcttgtgtgagcatactctttatctgtgttattcagtctcaaacactcacctcacctttgtctttttgcctgtaaccattactagaatttcggtagcacttgagcaagaaaacatgcctatatctagaaatctgtatttatgtctatttaggtgaatctccacttagatgaatagatctatcgatgtaaatctatcaatgtaaatatatatatagctatacagacttgtgagtctcagcactcacaagtacagaagaagtgctatctttgtttagaaataggagagttatttttctgtctggcacagatggatactctttgagttgtatactatttgagatggtatttcgagatgcatgtgtagagaagagagaaagatgtttccaggtagggacagtagaatgaacaaaaacgtggcaccaaaaagggaaatgcgaggtatgtttcaagaagagtgacagggagcccagtgtgttggcatatgcctgtaatgcagctactcaggaggctgaggtgggaggattgcttgaatccagcagtttgaggctgcagtgagctgtggtgatgccattgcagtccagcctgggcaacagagcaaggccctgtctcaaaaacaaacaaacaaacaaacaaacacaaacaaaaagagtgacaaggataaaagagtgacaaggataaaagagtgattgatgctgttattggagtctagtatgccaggttgaatttggattttattttataaatagggaaacatctaagcattctgaacaagggagaggcacaatcatggctctcttttggcggaaactaaatttatactaacgttaaataaatcggagagggtgtcagagttcagagcagaagaaaacaagactccgaaattagatgcactgtccagcgtatagtaagtaattgggggtatattcagataatgaaaagaaacctagacaaaaataaaagcaaagggaagaggcctgcatttgctggggtaaatgaggctctgcagcaaatgaaagactcaaatgtataatggcttaatacaagagagtgtctcacctatgtcatagaccaagactattccaggtggttggctgggtagtcaggccctttctcacatagctattcagtgacccatgctgaggatcactctgacatctcaccaagaggattccaaaagcctgacttcccaattgaccagtaagacaaaaaatcatggaggaatgtatgtgggaggatttaatggaacaagtctggaatttctgctctgtttcactgttcagaatttggccacacctaattgcaagagagactggggaaataaagtctaactatgtgtccaggaaaaggagaaataattattttgaggactggctagcagtcttggccacaaagaccaaggagagaaacgtagttaatgctaacatctgtggattgggaggaagaagggaaactagagagtaatagcaacaataataaatataatgaacatctattaacttcttgttttatgcggaacattgggctttatgcatttttatgtttaaacatcattgtagtcctgtaagggaggtacagtgatttttatgtgactgatgagtaaaatagggtctaggaaagtgagaagggccctgagtcatacaactattgggcaataagtctgactccaaagctcacattgattaatatggagctggagacgggttcctgagaattgtaggaagaaaacaaaaatagttcatttgtctactgcattcttgtgctaatgccacccaggctagacaactttatgcaggattcaagagtccccaagactaccctgtcttctgacatcagttgcaagttcgggacccccaagaccacactcagcttcagtaactcactagaaacactcatagaactccctgaaagctgttaatactcacatttgtggtttattacagtcctttccacgtagaatcatggttcactagctaacttctcccagcaaccatgtgctataatatacatggcatagagccaagcagggaagctcattcgaaccttgatgtccagagttttaagtgggggttggtcctgtagacagcgttgactgcccatttggttgacaatagcctctagcccctctgggggtcaagctgataccttatggcccaaggccgccagacaaacaaaaacacttttatcaggcaggactttccatgggcttagagattactttcttggagctgaaagctcattgctttatcagtaggttttgacattttacccactgctacattttggacttcactttctaaagtagttagtgggattttgctgtggtttccctcatattggctgctgttattatgcatctagttccatcttctctggtagatttttctccattgattaacacagaatctcagtgcctggcaccagtgttatcgaataaagaattgttgaataaattaaagaataacaaaatgaaaaggcattattctgtataaatggttataacttagagttggagaaaagttcccagtagtagaatattttaggttgtgtggattgatgtcttcaggataccttgcgaagaagtgcctttctactttttttaaagtgttgtcatcatccatcactatctgaaaacttttagggtctgaacccatagctatgcttctcttgcatctgctgttgtcccacaaggttgactgtgaggtgaagcctattttcccattgacttccttgaaaaaattgaacttgcaacagggaaaaattaccagtagagaagaaaaagttttggtgaacaggtgtccaccctttgatgtagagggcaatgatcctggtcagtgttgctctccctttaggaatggttttgaggcactgggagatgtggatggtgcactcctaccaccagggtctccctgtgcgttgtcctgaagcccttgacatctatatccctagtgactttcacattctcttgtcccttcctgcctcacttctgtggtccaggacttggacccacctttcttggatcctgaagcacctacatcacatgtcacaatacaaattttggttgttcttaccccagaattatttgagtcactaggccctgaaaggaaaatgtgttctatctgaatctgaagaaatacgtttattttaaaagatgggtgacacttggtattttttcccagcaaatgtcatttagtgtatattccttttttttttctcttttcttttgagtcagaatattgatccattgcccagactggagtgcaatggcacaatctcagctcactgcaacctctgcctcctgggtttcaagcaattctcttgcctcaggctcctgagtagctgggattacaggtgcctgccaccatgcctggcaaatttttgtatgtttagtagagatggggtttcaccatgttgtccaggctggtctcaagctcctggcctcaagtgatttgcctgcctcagcctcctgaagcgctgggattacaggcatgagccactgctcctggccatttggtatatatttctgctttgctgtactaagctttgagattcaaagggctatcgtgtggacactgctggagtaggttataataaaagtggctcatgtataagatgggttttcattacatgattattctatagaatttcttattgaagtcatctgctcaggctgctataacaaaatggcagacttgttagcttaaacaacagacttcatttcccacagttctggtggctgggaagtccaaggtcaaggtgctggcagattccagtcctgggtagaatcctcttcctcacttgcagacagctgctttcttgccgtgtgctcacatggctttttccttggtgtgtgcatgaggggaatctcccatgtgtctcttctataaggacactaatcccattatgagggctccacccccatgaactcattacttcccaaagtctcatctccacattctgtcacattgagggtgagggattcaacattggaatttttttttttttttttttttttgagatggagtctcactctgtcgcccaggctggagtgcagtggcatgatcttggctcactgcagcctccacctcccaggttcaagtgattctcctgcctcagcctcctgaatagctgggattaacaggcgcccaccaccacacccagctaatttttgtatttttttagttgagatgaggtttcaccatgttggccaggctggtctcaaactcctgacttcaagtgttctgcccacctcggcctcccaaagtgctgggattacaggtgtgagccaccgtgtctggccaacatatgatttttgaggagacacagtttagtccatagtatcccccataaaaaataattacatgcccatgtacatctgatgaataaaataaaaacaagagtaattttcctgtaagccatggagacttagtcttgtttctttatggttaatctaatacaatactttccctaacagctcagagctccttttaagcaaatgagcaaaatatacaattaatatataaatctataatttccaagatagagtcccataagaaggaatatggaattctattcatcgtacgattaaaaaaaaaaaaaaacagtttgcttccccctttccccaataccgcactacacatttctggaaaatagggttgttgctcatcaggtcatacattctagcagctctgttccccatccaaagtatatgaatatttttagaagcaataacatttagtttgaaaaattgagaagtaattgggtgaagaccttactgaattagtaagatgtgaattagcagaaacgtattatgctttgagtacacagggacttagttttaagaagcctctgcccttagaaatataatttacctattactggtataactgtgttttcaaactgtctttacttaaaatactttaatgctaccatcctcctttttagctaatttgttaagcttattcactaagcaaagtcaaattttaatataattttagtctcagttgtcatgacatttgcagtggtgggcctggtgaataaggtttgacatcgaactatttagaggtgttttttcctcatttgttgaatatgtttcaaaaatgtccacctccatggataaagcagctataaacctaatgtttattttagttatagctcaaagtttttccaaacacctttctccctttttagaatttcgggagaatcaactctagcagtacttttagtggtcaaatgagaaatgtttagactccttggtttcactaactttcttgtatcccaaatctaaatttgaaatagttttccttatccctggaaaaaaaaaattgatgtcaggtgggtcttttccttgcaggagaatgccgtgaatggagaacacctgtggctggagaccaacgtctcgggagacctctgctaccttggagaggagaactgccaagtcagatttgcagtgagtgtgcgctccgtcttgctgggggaaggcctgtggatctgaatgaatagaggggtcaccttgcctaaatttccaaggggaggtttgaacgagcctgtccttgtgagatggaaaactttccggatgttttcaaggtttgcagagagtttctcaagttaacatggctttcaggttgtcgctcgtaatggttttagggttcacttatgcaggccaggccttggtgtcatgtgttactttataatgatgcccagggtaggttgttgtgtgttggtggggggcagagggtaaatgtgtacgaggtagtgtctccttatggaggagttgttggtgtggggccaaggcctgtgtgtggaggaaggggctctgtctgtagggaagtggccacagtgggggctttactggtgggtgaaggtggaaagagagggaaacacctgtgctgggaatgggtgtaggctaacaaataatccagactaagttctggaggatacgattctagaaataatataaacaatcaacagtcaggtcaattggagttaacttttgttgtttaaaatttgctttgtgtccctatttagaacaatctatttagagggttaaaattctctttatgttgtgaggtaagtgtggttgccaagtagtgcattgtggagatatcaaaaccatagtgttgagaaattgaacttaaagtttgtgtgtagttttaaatgattggtccaaacagacagtaatgggaagcttaggatagtaaagaagagataaaagatgtattccttcttatttggggaaattagcaccagaatttatagaatgcttttttcttttttaaaaaaatatttgtttattatgtgaaagaaatatttgcagcaagatgtagggccttgaaattgcagatgaatatgtgtttgttaataaccaatatggaataaatcgagtttccatcaaagcttatagaaggatatgtatagcccccaacgattttaaccaggctgcctaaaagcacaaagtcccagaaccaagaccttttttgttgctttagctgttttaactccttgtttataaatttcatttggagagttttgagagttctggggagaacagggcctgtttaagtgaagttgggaatcaatgtcagggaaagacccagatgaacaggctctggattggaagtcgggaaacctggagctgaatctcagtgttactgctcagtgtgtgacattgagaactcgtgacctttgggccttggctaccttctaaaacagagagtaggattaaattcttttttattaatttatttttgtttctagacctgtaattaatcatttgcttctcttctaattttgttgtaaatttaattgacttaaatatcaggatttcaactttatgcatatgtatttttaattaaagtataattgcatggaattggattgaattaacgaaatccatgagaagctcagctgtttggactaaaatgctgtaaataatgaattaacattagtgtcttggttaattgcgtaaacactggtcctgggatgtaagataataaaaaatggaaaaaatgaaagccagtattacttacatatatacttttgaacaatttctactgatggactatgattttatacagagtcatcccttatttccaaattgctccctttaatccctttctgttactttttaggggatggctacctctcttgacaaatatatgaacagatacgtatatcctctttaaaccttgtatcagtaaatagcattgctatccactgaatgattattacttgttcactaatacctttaggccaggaaaagcaacaaggagaataaaggaaattttaggtagaagtaggaagaaacagagttgagaacgttcccagtttccttctgaagcttcctcataatttcataccaggtacttggccctattaactcatattacaaaacgtctgaaagatgaagaactctcctccaaaaaaatgttggttaaatgaaggaataaatcagtgaggaagctgaagacctaactgctgtaagtttcttgaagctcagtttctttacctataaagtgggggaaacactgttttgagggtttggtgagatgatacatagaaagggcttacttggctcagcaactgacctaatgaattaaaggcaaaaaaagaaaaaaaagaaaaaacccaggaaggacaaggacaggaaatttacaaaagaactaccaattgccaatagatatctgaagaatacaaaggcatcccaattaaaacaactcaggagtcaacttcatgtgcctattaaattagcaaagatttataaaatggtaatagttgctgctggttggtttaggctgaaatgggcaggctcatcatcagctgccaggagtgtaagtagatacactgtccttcacaaaattggcagtgtgtactgaaagcactgaaaatcctctcagtctctctccccacctcgcactgtgaggcgcatgtcatctctgggcatcccattttgagagagacattggcaagcagcagaggacccagagtggggtgcccaagttggtttaggggatggaagcttgttgtaaagaaatgttaggttacatgggctacagctgagtattaggagcgaaggcagagagatgtcttccagtatttgaagagttaatttgaagaaaagagaagtgacttgctatctgttgttagaaatggaaaagtcatagaggtagaatccaccgactctaactttataacaataaacaaacattacctgggaaacctaacaatgcacactcctgtttccctctttgctccaaatgctgattcagtatgcttggagttggacttgagagtctccgatttttttttttttttttttggatgtagtcttgctcggctgcccaggctggagtgcagtggtgtgatctcggctcactgcaacctccgcctcccgggttcaagaaattctcctgcctcagcctcctgagtagctggggttacaggtgcaagtcaccacacccagctgatttttgtatttttagtagagacggggtttcaccaggttgaccaggctggtctcaaactcctgacctcaggggatccacccgcctcggcctcccaaattgctgggattacaggcgcgagctaccacacctggctgggagtctgtgattttaacgagcacctcaaataattctgatgcagatgggtcgcaaacctaactttgagaaataccgtatgataagaaagaactttgtcagcctgagcttcccagcaagcgaacaaggtgcctggagagattgactggtgggatgtgtgtttgtggataacgtgggtggccatgtttaaaggatgctgtagttggggactctcagctgctttgggcaagaggtcacagagatctccaggcgagtctttagtttaaatgctctgtttgcagttttcttagaacaacagtcttttttgggaaaaaagtatgcataagcagatcatgtatttatattctaatttcttttaatgaaccacctttgaagaaagcctacctgttggggctgggactaaattaccataaccaggtactacctgcaggctcctaaacaaagtacaggcagagtgctcaggggaggagtgaatccatcatctacgatgtgcctttcactccttccctattttagcaaagcaaatgtcacaagtagaagttaagagaaggaagaagtcagtgtgggttgaagcagacagaggcagcttcatggaaatggggttcgagctcagttttgaaagatgggtaagatttacataagtgattttgaagaaggagaacatttcgggcagggaagaggaacatgagcagactcagaggtggggcaagctctgtacaaacgaggtggcaatcatgagccgtgcatgagcatgtgtcagagaaaaatggaagtaagaatggagttaggttttttgaaacaaaacttggagtgcatattgtaaatactggtgggcttaggaagcatgactatagaatacattgtctaaaccaagacacttttgagggtgaaagtggctgctgttaataatgatgccgtaacattagggataaaccagaactgcatcaccctagcttatgggacattagggcatctatgtaaaactaaaactgtcctgcaaagccgggacctcctgctgccatgtggattgatatttggggactgatattggagggtactgaaagccaggcaatgacttccaaaaccctagaacagctgtaggagagtttgttcccaagcttcagggctaaaactaaaccacgtgaccttttcctgttctacagctctctggtggcaacatttaatactgtagaatacctgtgagcagatacgtaatggaattaaatttgttcccaaattggcaacagttcccaaattagcaactgtttctttttctggtctagataaaatataaaaggatgcaaaagtaatgaaattgaagtagaaagatcactgtttcccaacctgattatgggcactggaaacctgaaataaaattccagccagaatcactgtcgtttggtgacatttatttttatgtacatttattcatttattcattcatttattctgtcagtgtttgtgagctgggttgagtacccagtgcctcaccgtttagcgggcacagccagatagaaactgttctcatgctctggggctaggctatacaaacatgtttagccaaatatttgtacctaaaggagctcacccctccagtagtaatccctggagtccataccatcgtgcacctactcagacttgaaagaaacttgcctacattgatatgcaaattatacacccaccgtggtcacacagacctgaataggcacagatgggtagcatgggtggtcagaaggaaatagactttgtgtggactgacctgggtttgaaaacctgctgttccatttatgtactgagtaaagttgggacatatcactttgcctttttttgcctcagtttcctgatttaaagtattgctactgagatagaccacagcgattcttatttctggatgagcattatagtcaattatgccattttaccttttaatcttacctttgaagtgttggttcccattctggatgtaccacatcaggatctctagggagtgggactcagcctgatgtcaaaaacaaacaaccagatctacagatgattctcttcactgtcagggtagagagacagtgatccacttcagaaacagagtgtcaggaccaaaaaccgtggcctggttctcacacctggtgtgtagtggctgtgatgggctaaatagtgtactccaaaagatatgtcgaagtcctgacgcctcaggacttcagtacctcagaatgtaacttgatttggacatagggttgttgcagatgtaattaattaggatgagttcatctggagtagagtgggccctaatccagcatgacatgtgccgttataagagaagacacacgctgggcgcggtggctcatgcctgtaatcccagcactttgggaggccgaggcaggtggatcacctgaggtcgggagttcaagaccagcctgactaacatggagaaaccccatctctactaaaaatagaaaattagccggggtagtgatgcatgcctgcaatcccggcggcattacaggaggctgaggcaggagaatcgcttgaacccaggaggcggaggttgcggtaagccgagatcgtgccattgcactccagcctgggcaaaaagagcgaaactccctctcaaaaaaaaaaaaaaaaaaaaaaaaaaaaaagacacacagagacacacacacagagaagaaggccatgtggtgatgggggcaggaattagagtgaggcagctgcaagccaaggccctccgaggatcgtggctctcctcagaagctaagagacaggcatgaaattcattctccctccaagccttcaaaagggtgttcaaccttgttgaaaccttgatttcagacttctagcctctaggagtgtgagagaatacatttctgttgttttaagctacccagtttgggttccccacagaacacccattgccattgagtgggatcttagtattcagtggaaaagtgtttgagaaatgctcacacaatgtttgcagttttcctaggactcatactcatcatctctgatccataacaacaaccttttggggtggtcatatcgggctgttcacttctacctaaagataaagaagagtcagagaggcttactcactatccagagctttatggcttctttgctttcttagggcagtgctaggaacctaatatagtagccattctataagtcgagttaccttatctagccatgcagataccgcagttacataggctcactgacacgtatgcacacaggtgcgtctacagcaggcttgagtgtttaggttgagtggtatgtggttgaggtgtaagtgagcagacaggcaggttggtgtcagaagctgggagctgcagggaacagagtaggtagatggtgaggtgagtgagcgtgtatgttgtgtaagaggaaaaatggaactgtcagacttcaggatgctgttaccagatatatcttctctatttttaaatgtgagcatgccaccctctttttgtggaccagctaataggtactgctttgcttttattattgttttgttcttgtattttgctttagtcttttcctcgtagataatgtttggtgaaaatggcttaaccctacctgtgacaccctgccttaattctaagttttcttctaatgttgcttgcaatttgccaaatacagttttactgagaaagtgaatgaattgagttagagaggccatgtgatatgagagttggaggattggagggcaagagcttcacagatccagagacaaaaagatctagataaaaatgcaagttctgctctgcctttctgagcctcagtttcctctgtaaaatagtggtgattaaatctacctctcagaatcagtagagggataaaatcagttaacaaatgtttgtattcattttcctcctcttctgtacctactatggttcaatgtcatggagctgaacaagctaattagcagatttggttggactttggcttaacaaggccttatatttgggatgattccaacactaagactcttatggcttcacctgtcattttgctgctgtgtgtagcatccatattcttaccaagtcatgactgcggacaactgagtgggacaaatcaaagtaacccattctgtgatctcatctcacaagctgtgtcttcttattggtgaatcagaagcctcatcattgtctgtaacggggtatcacaatatttgctcacaggaatgctggtcatgtccttagattcttggaagaaactttcaagaagagtacaagggtcatagctttctgccctatttgaaggaaactttcagctttctgctgtttaaaaatgaaaatgattttgagcccagttacaccttgtctgtttcatctcaggaagaatgagcaccaggcagcagcttgtgaaaatgctggttcccatgcatctgtgtgtgtgggtgagaagatgaggcaatcagagcccgacatgcattactggggactttctggccatctgcgtattcaggtctagctggtgtgtaacatggagcaccagcattggacttagaatgcaccaagatctgcctgcatgttgctcctgctctgtcagcctcaaatgccagttgtctggcacagcagactcatgatctgcaccccagatggcagtttggctgagctgggtgcaggctgtcagagggaaccacgtgtgtggcaataaagcccaggaggcaaagcccgctctctgagttgtttgggtgccagccattctctgccaggggcctttttcaccattaggatattgaggatctaatgaatcaagatgactcatggaaagtgtggccatcaacaaaaataagaaaagaattttcacagacacactgtctgctactgagttcctagtcagtggatatgagagagggagagagtggggtgctctcagtggcagaagtaatgtcaccctttaggtgtctggcctgatagctcagcatttccatgagatcgttcacgtgcacacttagtgtctggcacatggtagaccctcaggacatgttagccattgttactatgacaactgtcatggggatcgttataatttggtaccaagtgctgtctgtatattaaaggagaatctagtgctgatactgctcacttcatgtaatggggatagtgatagtatatgtaggctatgaagccaagggatctttaggattctgtcacttctaggtgaccctggatcaatagtaccattgtctatttgcacagcccattttcttttgacccaaaattgtgttctggagaacactaaactcaaaagaaaacaatatacggcattatacattaaaaggagctcatgaccataaattttgaaaacactgaatgactttaatatgcaaataggtcctgtgaagctcaacgaagcatataaggtatgcaggatttcctactttttttttgagtggatgggaggattgtggaacccataatttccccacagaacacccattgccattttgtaggatcttaggagtcagtggaaaagtatttgagaaatgctcacacaatgctttgcagttttcctaggactcatactcgtctctgatccataacaacaacattttgaagtagtcacattgggttgggttgttcacttctacctaaagataaaggaaaaaaagagtcacagaggcttactcactctctagagctttatgacttttttctatctttgtgcagttcttttgcctttatactaaactttcattaagccaaaatgcatgtgtcttattttattcttagagtttgaacctctgagaataattgtcatcttttctgtcatgacaattttagattgaggctgcatttgcgtgtttgtgtaagggtgtgtgtttctgtgaagcagttctgttgttattggatattgtatggtcctgttacctagtaataaaaataatttgcatctgatttagcataaggcttacatgttacctaggcaatgcccaggtgtacagaaatggtttctcttcttgcaatgttttccaggggcagggacccacagtactggggtttaaccagtattcctgttgcttagaggcactcaatcttgatggaagcattatttgcattatcggttactccaaaaccactactggcccccaaagttggtattgtctctgtttgttaggagcttgttgttgttgttccctgccacattgatgaggtggatacatattcagaaggtgatgctttaaaaacacgaggaaatggaaaatcctgcattgatgccttcatttaagggggtgcaggtaatgtgttgatgaagcgtgtgagctttggaatcagatgacctggttttgaatcctgatttccaggctttgagttgtgtgacactggtccttgttttaacctcgttaagcctaagttttacatctggaaaatgggattatactgcttcttgtggttgttgtgaaaattaaaagagttaatgcatatataacagcaggctggcaaatcacaggcactcaataaatattgaccactataatcattcctccttgaatgaaagtggttccaagaaacagagccaaaagagacaactcagagtactaggtttggagagtcttagcatcacctactacctctgtttcctcgaggaaagttaaggactgagcttgtgaggtgaaacaactagcctagctgacagtcaggctctccctcccctcttgctccttcaccattctgtcaaccttttacagcacacaccacttactagctatcatacttttaaaaattgctcgcttatttatctgtctccaacactacagcataagctccatttagctcaggaactctgcccttgttgtcctctcctgtattccccacactgaggataagtgattgaactgaatagttaccctgtgttacttaacattgaatgaatgaatgagttcaatgaggtgcttgttgagagagagacacatacacacacagacacctgtcaccagatcaaccctgccatttaagtattgttatatttataatccaggacgtctgaattcctgcctcctttttaagactctttagagggagatttaacacatgcaggtagctgacttgtgtaaggttttatgccctgtttagccagtgccatgccttttgcagtgcattttatttcattctcgtggagaacagagactgctttttgccatcttggcacagggggtcatgtgtggttgtcattagtcagttcccctagggatctcatgagaacagatcatatgaagcaatcacgttaaatatcatatttcttatctatcctcatcagtcttggtcccccaggttaccactagcaaagaaaagaggaaaacagtaagctgtaacacatagagatggctttgggttagaaagacttccactcttagctagtctttcttgggcaagttgcacagtctcatagggtctcagttcccttagctgggtaagtcgtacctacttggcatggcagaagtgagctctgtttacagtgtgggtaatgtgtatattacacagctagcctcctggcaaatctctgtgggtatgatgtcctcattaaaaaatgaaatgggcgggtgtgtatgtgtcagtgaaaacattaccaactggaggtacagtgttgagtaaacaatgactgagatgtctgtgggtcttcctggactagattggctggaagactgccttaattatgtcaccaaatagcttggaatgtgaaaaatggcagtgaaaggataactaacttaccacagcttgatatcgcttcttaactagaaatacagtattccatatcaaagcaaatatctctaaatttttggttagaaatattaagctgtgaactttaagaaaataattctatttccacaaagtaaactgataatggaaacatgtcaggattcataatacaagtaagatggtgtttatggtactgtcacaccagcaaggactgaaaaaggcaaagtgtttgggatttcctagtttatactaaggctcaaatctctgctgtacccgtgatatgctacctcagaactagagaaagccaccaagacatagaaacaccattttctattaacttgttttgttatgacttctgtaatatgtctagcccatcttcactcaagtctgtctgcttgaaatttgtgaatgcacatgggtgtgtatgtgtgtagggctctaatggtatgaatttctacttattagtgtctgtgtacctgtaattatatttatatccatatttgcgtgcatatcaatccttcaattactctactataagacacctggcaactttgacctgctggcacaaataataaccttgaagagcgtgtaaaaatatgacaaggaacagccacaaaaccacctgtaaagagccaaaatcaggaagattgcatctgatgagttgaaactagtgaccggctgtggttgtatactgacttctaagctgagaagcatagaaaaacaaatggggaaaaagaaataagagaaaagagaagcaggcaaattttaaagaagcagaaacaagaaacaagggcaacaaagtacagagaacttcaataataagaatgatgaaatatgaagtgtccttgggtaaaatgagagccagggtgggaaacagaattatggatttttaaggatttcttcaagttcattaggctggaaccctttttaatgtatcatgagcatgagggaagaggcagaaggaatacctgagctgcccagtaatctagatggaggggcacagtgagtatcattccccatgactctccgcctggcaactctgagggcatcagtttgttagtatcatttgattagacttgtgcaaacccattcaaacttatcaggcccttcgccatgcttgttataaagactggctgcaatatttgttttatatctcaataactgtgcctgaattgtaagaagatttccaaaagatggtggcagtacgcgatagtcacccaaatgaattccaaggtgtagacttctcctaagattcacgtcgtagctttctgtttttttgtttgtttgtgtgtttgttttagagacagaattctgccatgtcacccaggttggaatgtggcgatgtgatcctggctcactgcagcctcaaactcctgggcttaagtgatcctactgcctcagcctcctgagtatcagggaccacaggcttgctgtagatttctgttgaagcctatcagagaaactttgtgcctatcactttcttctcattaaaaagaagtattaaatccactaacataagtcacatttaaccatttaagagtgtgatttggtacaaattttagtttaagggtaaactgttgagatacagacatgtacctttttcctcccttaaaaagaatcctgtactgttctgactgtagtttttaccaaacttaatccagtgctcaaaacacgatggatgtatcattctttgtaaccagtcatgaacgttagctttgaattaacgcaatcctagcaatttggttcttaccaaattgtttctcctatgagccccgattggctgcttctcaggaagaggaaaggttttttgtgtgtctttctagttcttatattcagctcacagtcttttttttcccttggctttctgctgtaagattttggttttctttcccttcagatgaaaaatataaaatacactggctatctgggaaatagacaactttttctttctggttcaaacaacaacacacaggcactgctcttctttctccctgtaggtctctcgggaggtcatggaattgagcctgcctaggtggggttcagcctagtatctagaatctacctgcacatctgaggttactcaggggaggtgctaggaacatcaacataaacacttcatatgcagaatgcttctgataatgtgtttctcagaacagaacaaaacacgctgttcgaagagcatcaagtgagttttcctgcggtactcgagaggcaattccaaccataatagagcatgagactgtcaggtatgctgtcagcccagcatacacatgaacagcaaagctgcccaaggggtaggattgaagccctcctgagctgctgatgattctactgaaatacttaaggacaaaatataaggaattcacactgaccttagtggaggctggtgtggggctgggaagagggctgtgtgctctcagtcactcttgtgcctctgcctttcctttttgttccattcttgtcactccagttcaggcccccatcacctcatacgggaaattatcactgtgacccttgaatttcttattctctttcaggaaaaaaagccagtgtcttaaccacgacctgcaacacagcatgatctggcctgctgttatcatctgacctcatctctactccccaacactggcccccagccactccttagcatcctgacatcctcatgcctctgagctttgcatggctgtgccctttgcctagaatgtttttccgccagatatccacgtggtgaactctctcacttcctttgggtgtttgtcaaaatattcagtgaaaccttccctggtccacctgtctacaacttcaattttctgctactcttgatgtttcttatctccctttctctctttaattttctttttagtacttatttctgtcaatatattatatactaatctctcttgtttgttgtctgtctctcacaggagagtataatttctatgagatcaaaacaatttttcagggctgggcacggtgtctgatgcctgtaatccctggttctgtctgttttctctccactcctgcaactgttcccaaataaatattccaaggtttaactaacctgtagacacaggtggcatcacatgagccgcagtaatacagatgcaactgtttttaactctacgcagtctatgtaagacctcagtcttctgcaaaatagcccttctatcagatagtcctgtgggtccccagaagatatctgatttgtgctcacaaaaatattatagttgttcagctataattgtcatgcagcctctatgctttctttttctttttcctttccttttttttctttctttctttctttttttttttttttttttttgagatggagtcttgctctgtcacccagcctggagtgcagtggcacagtctcagttcactgcaacctccacctcccaggttcaagtgattctcatgcctcagcctcccgggtagctgggattacaggcgcccgccaccatgcccagctaattttttgtatttttagtagagacaggcttttgacacgttggccaggctggtcttgaactcccagcctcatgtaatcttcctgcctcggtctcccaaagttctgggattacaggcgtgaatcactgcacccagccgcactattttttccctattgtgggcagagggcttccattcctcaaacagtctgagggcacctcattactgttgcttttgggattgcttattacgagaatgtctatgtcccggtgggggttttgtctcctaatgtttcctaagccaccaattctccagaccggggctgattgagggttaagtggggagggagccctatgtcagaagccctttctcctttcttccctccccctttcctttcagaataactgtgtcaggcagtgttcttggttctcagtgctggaatatagcggcatggaaacacacagagaaatctccacctctctgtaactctgtaattttgaaccccatggcttctggggcgtagttctgtttccccttctcatgaagctcctcatagacagctcctctggcttcttaacacagccagtgtacctacttcccaggtttgagggctgccagcaacccccagacacaccgttcaaacctccacactcaaccaccagccctgagcccagtgactcctgtacatagacacccaggagcccaggaattgtcccgcagtggacatgccaaagcaggtctccatgccttttcagaggcgtcggtgcctactacgtaaagagacttcagatctttttcctgctggaatgcctttgatttttttgaatatacatattttaagcccaaattaaagaatttgctttctctgctagaccctttttactggttcagcctcagattttgccctcctctaggtgacagcttttcttgtctgggctgttgttgagcatgtcgccatgtgtggctctctcctgtgaatggccttttctaccaagttcctcttgtctcctcaagtagcttgccagctcttgcaaggacagaagcttcctcctgtttatatcctgtacagcactcacatagtcttatacacatagtgatggttaaaataattggtggactgaatttccataaatatattctggaaaagtcagcagtaacagattgtttcagccatatggaatcttctcttatgtaggataactcaaaccatcatgattccagatacccagcatctacagattcaggagtattggtgtatatctgagcattgcatgagtattttggtgtatcctttgtaagagtctccaacccaacttctagttgttcctactgcttttcttccagatattctgagatacttttggcaccatcccttatcaagggtgttggttgttgggggctatctcagaaggtttcagcctttaccaagtccttgtctgtccacagatcacattgcacaaacacatggagtctttacaaatgaaggcctgccctccaacatgggccaacactactcagggtctgggctgggaccttttaacatggagtgaggtctctctgcaattgaacctctaaggagaggtctgagtttccactcgggtcacagactcctccggacatgtggcatctttgctccttggtctggaatcatgagatcctgttgtcatagacagaatgagtgatatactgaggataaaagaagtgtgctgggccgggcgcggtggctcacgcctgtaatcccagcactttgggaggccaaggcaggtggatcacgagatcaggagatcgagaccatcccggctaacacagtgaaaccccgtctctactaaaaatacaaaaaattagccgggcgtggtggcgggcacctgtagtcccagctacttgggaggctgaggcaggagaatggcgtgaacccgggaggcagagcttgcagtgagccgagatcccgccactgcactccaaccccgggcaacaaagtgagactctgtctcgaaaaaaaaaaaaaaaaaaaggagtgtgctggaacttcagccggccaccctcctggcttgtccaaaatgttctatattcctttgaagaaaaagggaagcctgcatgagtgatggtggaggtcgggctttggccctgaaatcatattaatggaactttcagataatgtcattcttcatttttcctaatgccaatttatagattgcatcccagactccccagagaagtagaatttgccaaatatgcttgtcatttcttctaattaggtttttaaataaatcaaagaactcttgttttcatttaccttggattatacagcaacaatcttgttgtgtatgttgccagagagacaatgcctactgagaggacaccagattcctgacattctaagagcttaggaaggttcctcccctccactttcctaagcattccattagccccgccattgaagaggaggagaggacagtcctgcctgggctgcatggcgcctccttcctacccatctccaagatgctgctgtggaccgggctttgtggtctaaaagggaaggagaagggggaggaggagagcactctcctggcctctcttgcagtttcccctttgcttgattttcagccttccctcggtttctagtcctcggggtgaatcttcccatctaggaggctaaggggtagagaaaccatgggggagaaagctgggaggcagctgggggtaggcctggcccagcaacctcctctgtccttctccttggcttctcaccatgtggcccccctctggccctttccccagcatgccccatctgcccccttatgcactcacagtattgttggtttctgcctgaagcccctttcctggctgtcatccctttgctcactgtggcctcatagctggtgattccttgcattacgtctgggaattctggagtgaggtgccatgagctcagactttgccctggtgtttttggtcctgcagcagcctctggcctctgagctcctctgagatggggagactaagaaccggttgccatgctggctcttttcctactgccttccccatgtcccatctctggtgattccacctgtcgaggtgggcaagctcagtgggagctcttaggaccgcagtagaagctatgtagtcagcaggcagtgcagttggccccactgcaagaagaaataaagcttgccgtgtgcctcattcagaaggggacagccagccttgttgtacctgcttcctgggtgtcaaacttctgacaattgggaatgacagatatttaattttacttaccttgggcagcaaaaaggccccaatccttttatagatcatgggcctgtgaaagtagctaaccccaggccctgaaggacccacccctcttctcctttcctcccctctcctctcccttctctcctaccctttcccgtcttttccccttccctctttttcatctttatttttcatcatctttcccatccttcctttcctgtttttctccatcaaactctctcaactcccaccagatattcattgttacttagcagaaatcacatatcttgctcaaaggaagaaaaaaaatagctttcttggtacatatagatcagggacttaggcaagggaggtagttgggtgggataggattcaatattaatctctttattagggacaattgtatactctctaccactgcctgccactgatgcctctgtcctcctcaatccccattccctgctccagtggtctaaagctgtgacagtttttctcccttgcctgctatgagctgaagattggtggagagctgtcactactttcaatgccagcagggcctgcagcatgggaaatatgtaggatgtgttttctcttataaccactgtatggctgctggtgagatcatgcccaccatcctaaaacctagcatatatattattgtgttgttatttaagtaaatgttggtcatgtttttattagaacagtgtaatataatggactgtgatctatactgtattccatattgtcttagtttaaacggatatgttcccccctctgcccaccccgtaccacacacctacaaataagtttcttttgaataccaacaccagcaaaatcaggaaacccttagtaagggtgcttaggtgctgtttgatatttaaggcagtaagctcaactggcctttaaattcattgatgagagcaaattattgttttttaaataattttaatttttaaacatgtttcatgttctaggcaatatttgtttaaattatgtttttgtgctaggttctataacaactgtgtcccaatgtaaggaataagaggtaacctactgaatgcttcttttttgagatggagtctcgctctgtcgcccaggctggagtgcagtggcgcgatctcggctcactgcaagctctgcctcccgggttcacgccgttctcctgcctcagcctcctgagtagctgggactacaggtgcccaccaccatgcctggctaatttttttgtatttttagtagagacgagctttcactgtgttagccaggatggtctcgatctcctgaccttgtgatccgcccgcctcagcctcccagagtgctgggattacaggcatgagccactgctcccggcccctactgaatgcttttaagtgacttttcttggtttaatttatcacctttcgtagagaagtaagcactggctcatataagttatttgggaaaaagtgaatatttgtagtatttagaatgtccagattcctgcatcttacctttgtgtatagctgggaacttaaaaatgaaaaattgcaacctaactaagcacaaaattctaggtgttttgggcaatttctgtccggaagcttattatccaactacttcaaataactttaaccagttgaaatgtagtcatacaccgtgaagtcagtgattaaaatttccgatttgctaaaacagtttccctcaattaaggaactaaaaatctatttacttttctactatggcaaaagacctgggacctttattcagaatttatttacttaattttacatatgattgtaaactgtaattatctgatttctcagattaaaagctgttgagaagctgccatttaggaaattgagagcaacaaaagacagcaacactgactcaaaaggagctctacccaaacagaaggacaggaaagagaaaaatgactgttctttgtacagtgcatcatgttgtagtctttatgaagaaaaatttagaatatggtttatatattctgcctcaaaaggcacataagttcataatatattttaagaggatcttttaaaaatcaatatagttcagttaaaatcagttttagaacttacagcactcgactccatatattatcatctgcggaacgttgcacttcagtttttccatatgaatgatgttagtgcatttacatgacgttccagaaggctgagagatagcatatcttaatgcaccagttctcaaattcttctagcccagatcccttgtgcaaaagatgttttgactcagaatcctgatttgtaaaacaaaggaggaggcattgcatttcattgaatgcatgaggcttcctgagttttctccgcatcttccttccatcttcagtgactttcgtaacagactaagaaatccctggaactccatagaacttaatgcagagcgtagtgtcaagcacgaagctagactaggacaggagttattggcaaggagggaggcttttcaggcatccttaaatcacagcctgtaagtggttgcctacctgtggtaatattgcattgcttatccacaatgtaatttactaggagtttcatgggaaatgaatagactaaaatcaactccagtttcctttgtgtcgctataactctgattagcaatgtgactcaaatgccccatgcattttccacaggtggtgccaaagcagtgattcgcaccaggatatccataggaaacagaagggaaaccatgatttgcttatgggtgctctaccctgtagagcaaaatagaattttttgattgtccttttgattgctactgctgtgttactacgattactactgtatgttttcttgttcctccccctccttctttttctcttcttcttttcttttttagtagtagaacaagacactgttcagtagtgtagctagatgctttggtttcttttatcattgttatgtgcaaaagcaattgtcaaatgtatttcatgtgctacaccatgttcttccctcaggaagaggaaatccgagagtgataaaagcatctgcaagcagaataaaggaatctcagtcagtggatttcttctacaagtttcatggcagcggtactgcagtgttttaggttctttgttggtggctgataatgtgtaaataccccatgttgaatgaatgcagctgtccaagacctatgaggctgcattttctttcctaatcctacccctccaaagtggtggtttgcagctcttcaaatctctggccgcagcaatgctttatttcttctcacctacctgacacagttgactcaaaaattatacctcagcaggggaaaccactcctcggaaggggaaggttgccagcaatctctaagaggacaggaactcaggacctttcacacttggatgctttgatagcccatctgacagacaggcttagttatagtacatttctttcaggctcaaacacagaaattattcatacaaatcctccttccagtctgtcctttatagagagggctgaactttcctatcttagatcctgcatgacactggcagtcatgaaatgtagattctgctcattcatctctctccatgcagtccattttttatcattagagaaaaagataaactttaaaaagttttatttcattataattttaaactaatactgactgtcagagaggccgaattgtgtaatgcttataagcatgagctctgaagccagaccacttggccctgctgtgccttaattcactgaccttgggcagttttctcatcagtgaaatggaattaagaatagggcctgtttcatagggttgtgagggttaagtgaactaccatttgtgaagtgcttataagaacagatagcaaatactatattcctattagcagcgtttcctgcttttgttgctattcttattattgtttcctgggcgtaaaagctgaacttgccttcctttacttctggaagatttgggcagaaaccgaagtaacttagtctagactcatgcctgggatagaagcctaaaatgactggcccctggaaatctagactctttggcaatagggaaagaatgcctgttttcaacttagatctgagtttggatgttggtcttgccccttagctacttgagtgataatgtagaaaatattttaaaatggaagagaataatgcctatattgtaaggttctgaaacttagaaatgacagaacaaagagccagttcttgttatatgctcaaaatattggagctattattattattatttgaagagacaatctagcccaccctaaatcatgcagatgtggagctacttggtgagtgcagagactgttgataaagtttgtcagtttattcaatatttaagatgaagttttaaatttgctttgtaatagaaataattacaatgtttgctgtatttatgtatttattatatatgcccactttaatactagggaactcttcagaacagactgttaacatttcttttttgtcttttgaattgaatattgtagaaatcagctctcaggaggaagtgtgcagtctgtaaaatcgtcgtccacaccgcctgcattgagcagctagaaaaggtaagagcgcgccccctgctgcagttttgttacattgcaagtatttggtcttcagaggcccggtgtaaatttccagttccaactttttgaaaacaatgcccttaaaaaaaagctggaagtccaacattattaccagattactaatggaaagacaatgtttaagggtcgttcactctcttgtttgctgaagtgtaatttgatatcattttacgttgactcttgggaaaaggaagaacacagttagatggaaaagcctggtgtgcactgattctcttattatatcatctcagttcaagcattactatccacccataggctgttccacaagctgtttaagaaggaagaagttctataagctgtttataattgttgttcacatatatctgacttgtgtggtttacgtcttcctaaagtgcctgcaagggagcgagccacgctggaagccggctctcactctgctggggcagtgctcctcctgttgctgctcaaatgtgtgggtggggctggaagtgacatcccggtggtggtgtgcctccagaatcagtggattcggcaaagtccatttatttgtcatttaggggatgggaaaggctccaatagtgagttgcctgccatcctctttcctttcacacttcccactacattttaatgtgtgtgtttctctgtgtattatctatgttcttgagctgtcatgggtaaatgcattgaaatattttagtcccccatgacattcatgtagtttcactgacatgaccagttgatcctagctgatatcttgtggcaatgactaccaacatgttatcttaatattttcttttctgccccaacttcacttactcatctctgccttcattcttttgctcctttcactttatcgagtagctaaccgaaatgtcaatgtgcctactaggagacctccacatctaaaagaaaagcagtgctgaatccttttataaagaataactctgggctgggtgtggtggctcatgcctgtaatcccagcactttgggaggccaagatgggtggatcacgaggtcaggagatggagaccatcctggctaacacggtgaaaccccgtctctactaaaaatacaaaaaattagccagatgtggtggcacgcacctgtagtcccagctactcgggaggctgaggcaggagaattgcttgaatccaggaggcggaggttgcagtgagctgagatcacaccactgcactccagactgggtgacagaatgagactccatctcaaaaaaaaaaaaaaagaataactctgttgtctttgaataattgtcataatactaaaaaaactcaagtttatattttctacttttacaatcagaaacccagctgggtagtttaagctgccagtatctttcctctggctctttcttatctcagtttctcaaatttatggtgtaagagcattatcgtttaaagatacttagatttgatttgtgagaatgaaggaaaggggttggagatatagaatcacctgggatctctgttgattatctaatgtgatgatttcaaaagactaagaagagtattattccttgttctttggaggttttgcttttcagtctcaatatctgtcactgtttttttttttttcaggtaattcagtctagtctgatgcttatctctaatataatatacttttctttttgaatgacagattaatttcagatgtaaaccaacatttcgagaaggaggctcaaggtcaccaagagaagtgagtatttcagagcttgatttcaagtatcacctttgatttctcattgattcagtggattcatagatattcaccagggaataaaaaataaattctatctctttctgttgcatgccaattttttgttaacacatcaataagcacaatcaataaaatcttcaagtcttttcaacatgtgcacactggactttattctcataaaatgtactggggagtttaaggtcttaccaaatgaaccagagactagaggaaggtggtagtgatagaattgaaggggtaagaaagaaatagacttttattacttatttatttggagacagagtgtcgctctgttgccatgtgttctggttgattttaagtgcatttttcaattttgagtgggtataagccattcatggggcagcacagtaactggttattcctatgagccctggagtcagacggtctgctttcaaaaccagccttgatgtgtgtgatcttgggcgtctcacctaagctctctaaatctcagtgttttcatttgttaagtaaaaaataaatacatcataagctagaactatattcagttctcagtccctgaccctccagtctggtcgtgaagataaacaggtaaagaggaagttagaatgaagagttgttactgatgtgttagtgggaagcagaggtatgacaagaggagacagcacttatttgttcacattttatttagcagagacagcaagcacagttcaggcaagaaccctcctgtgttattctggacagttaagctccaggcccaaaattgcactccctaatcagtgaaacaaaagcctgcaatgaacagaacctgtcctcctagaatgtagttcagcctgcccagcagtcactcactgcctcccaaacattagcatcttatacggtatcctccttaagacaaagtctggtaaaaatgatttctgataagcatactttctcagggagacgaggttcagttccacttacagatttaccccttggaaacctccccagctggtctactcctcagatcagctctgtgtagtaacaaataggaaagagaggagaggggtcagagaaggggcttcctggaagaggcggcaattaagctgagaccttaaggagctaactaagttaagtgagaggagggtggttaggaggtgagtggcaagagccttccggatagaaagaagagcacacaagtccaagtgagagagggtgtactgagtaagacatgagatctgagatagcaagagctggaccctgaaggtccttgtaagccatgctgcaagttgagtgttttatcatcaggatagttgggaggtgagcattaaactactttaagccaaatattgttcaggctgcagcgtggaggaaataccatgcagttcaagagttggaggcatagagacaactttcagaagccatgctagtaatctaggcaagaaataatggtgacgtgaactaagaataacgttggtagatatgagtttgaaggaaacaaaattgacaggatgtagtaattgattggattttggacacaagaggagcccagactaaaccaagctactgctaagtgcgcgcacgcgcgcgcacacacacacacacaaacacacatacacacacacacacacctgaaaaactgattagatgttggaaaatgagttgatttgaggatgggctggggaggtaatgagtttagttgtagaactgtgaagtgtgaggtatccctgttgtcctcaactggagatgcccaatagaaggttgagtgggtatatgagtttggagcttatgaggaagactgggctggaggtcaggcattgtgagtcatcagcctatttacacagtaatgaaagctgtgggaatagatgaacgtggagagtggaaataggagatatctgagaatcacaaacatttaaagagagttgatgaaaaaagacaacatgaatatgaatgctataattgctagtgacaatgcaaaaggattgggagaacatgtggaaagagagtaggttgggatggaggttgtagaaagagaaaacatagttgtccccatcagttgtcttctcccattgtgtttgtgcagcatggcagcaataggaaggttgtgggccatgcgcagggtgaggaaagcaggagaagaatgatagggctgtggtgcctcagtgccacccagagtgcagacagtgtgggccagaaggtaattcagtggtgactcaattgaaggaggtgctttatttaggaaactagaaggggttgtttcaagttaagatggagtttatgactttccaaccaggggattcatatacccacctttagcttcctgccctccaatatgtatctctctcaattgataggtcaatgtggaggcaggggaagagagaaagagagacaattttaatcgtgcaatttttctaatacaagatgcttttggttttcattagtctgtaccacttctctgaagctagaccttccataagggttttggatattctcccttgtcttcttatcaaggacttgaaattcctttcttttatatattttcatcccctcatttctagataatttctatcagcataaacacactctaataatttctatctttaaaaaaacccaaaaacattccttagccacaaactgtgtcttacctactgctctaattctcagttttgtggtcactgccaagcttccagaaagtgttaactatataaattattttcggtatgtcactttctagtcattgtaacctgttctgatctgatatctactctacccatttactgaaattgcttcttttttcagtgttgcctatgatctcctatatgctaaatgtattaggtattatttatttttctgttctttccttatccagtctctcaaaaatattcaagatactacatattccatcctttttggaatgctctcctctcttggcttctcacatcaccctttcctaattttcttcttgtttcatcagatggcccttcctattctttttcattgcttcctcccccaacctctgcaaatccctccgagcttagttcttttctatgttctcttccgtctgcccactcctgttagaggagcttatccagtctcatggcttcaaataccatgtgggctgacaactcctaactttacatttccagtctgcccttcttggagttccacttggcatgtcttttgaatgtatcacagtcatctcaaatataatacatcaaacactagactatttccatcaccataaaaatgattttaagaaaatcgtatgcacctcaggaaatgagatggctgttaatctggcttctcaactgagaaaactggggagtcatgtttattccttctctcatagactccccacatctaattcatttgcctgtcctgtcaattttatttataaaatatatttcaaatccatccaactgtctccaattctgttatcagcaccttaaactaagacactgtgacctctcccctttgaccaatgtaatagcttcatgattcttcagttgtcactttcaatccacccatgacttaaaggagtgatctttcaaaatgaaaatcagattattaggttggtgcaaaagtaattgaaagtaatgacaaaaaccacagttacttttgagccagcctaatataattttccctggcttaaaactctccagtggtttccataactcttagagcaaaagcaaaccctctgtcttggcatgaaaaggtccacattgtctggcccctgcctgcccttccagccacctccagctcccacatgaactttctttccatttatgaggcatataccaagatattccccacctttggatatttgtgtatttcactgctgtactgaaaatctctttgcgtgactgtttcttacagttaggcctcagttcaaatatcatccccctcagccattgtcttagtctgtttaggctgttgtaatgaaataccatggactgggtggcttataagcaacaaaaattatttctcacagttctgcaagctggaagtccaagatcaatgtaccagcgtggtccaattctagtgagggccatctttggggttgcagactgccaccttctcattgtattctcatgtggaggaaagagggtgagagagctttctgtggtctcttttataaggagcctgattgcatccatgaagagtctactctcattacttgatcacctttcaaacaccttacctcctattaccattgcgttggggtttaggatttcaacataaaaattttgaggggacacaaaccccagtcctttgcagaggtcttcctttacaaccacctttaaatacatagcatattgttctttatcaaagtgtcttgttctttcttttcagggcactttgtataccataataatttatgcatattactgtttgcttgtctaaagaatatctcccttctttagtgtaaattttgggagatcactcctagattttgtcctaaattaattgcaccaaaacacagagtatgtcactgatggatatctgctgactgaatgcatttacaaaggtattcatttctctcaaaatgtttatgaactcttagtctaaaaggacattttgaagatgaaacttatgactcactgactatgacccatttgatattcttaattaaaaattaagaattcttactactactaattcagatgtttatttagtaaatgaaagaacatttgctttagaattagtttgaccctagttcacattatacctctgcttcgtttccactaagtggtaagagtctctggagcacagattgttggtcactatgccctggcatttgcatagtgcctgacatgtgacaagttttaaataaatatttgttggagtcatctaagttgaatctttctggatctcctttttcttagtcataagccataacggactgggttatgatttctaaggtcctttcaaactctatgaaatatatatatatatatatacatatatatataaaattttttatttctataggtttttgaggaacaggtggtatttgcttacgtgactaaattctttagtggtgatttgtgagattttggtgcacgcatcacctgagcagtatttaccgaacccaatttgtagtcttttatcccagttcaactggctgtttgaaaatagccaagcaattgtattgtgtatttttgctaacaatactgaatataagccctgaaataatgcattaccaatattttaacacctgtaagtaatagccctttccttgcccagtacttgaagttgtttatgaataattcagaagttattgacgagcaataaaaaggttttatggtgttagaagccttgctttgctatcttaacaacaatatatcaacagtcacatttgcagtgttaaggatcctgaatccaatgtcagttcagcaacttaggagctcttaataatggtcaaaagaaaagagtgtgagaaattaaagcacttgggatatgaggattagaataaatgattctatagtaactttttttccttatcgatgaaggcaattgatgatcctcccctcctccatggtaactatgtgatttaatcgtcaaagaaattaggtggataattccattcaattcaacacacatatattggatgtttgctttgttcaaactataattaagcagcagtagaataaatttatattgggcctaaaaagaactctgaacagaaggatgctggacatctcaaatcgcagagctgtagtttggagacaattactcattttcttctacgatagtgattttgtataagttagtttatcaatccatgccttagttttcggcttattttctaggaaggatgatattaaaaatatttaataaatggtagagccatagagagtaatatttaaataataatttttaaatgttcttttttattccctgactaaactatatgatattctacatctgcttaccaaattatatacagtagtcccctcttatccatgattttgctttccaaggtttcaattacccaaggtcaaccacagtccaaaaatattaaatggaaaatcccagaaataaacaattcgtaagttttaaattgcatgctgttctgagtagcacgacgaaatcttgtgccatcctgctctgtcctgggatatgaatcacccctctgtccagcatatccactacctgcccattcatcacttagtagttttctcagttatgagactgaagaatcgttgtatatgtaaagtttggtactatccctagtttcagtcacccactgggaatcttagaacatacctcctgggaagaagggataactgtgtgttgcagtgcaaatgatgaagtcagtgttaagatttctaaataattgttgatttatggacagtgttggctgactcttttgagtagagctgttacttgctaaatgatcccatgagtcagccatgatttcacacaggtaattgcatcaaatgtttccaacatgtttcttcttaaattgatagtcattaggtgatttataatctcaataattacagatttttttctgaacatcaatgatattgttccttttccctcggcttctgctacactaacagcaattatattacatttttctattctgtatgatactgtctgacatttttatatattcaatatttctactactgactgtcattgaaatcatttgttggtgtgtcatgttgaatagcgtgagccctgttttgcagaacagaggaaaggcacagtgacacaatggtaagggcacagattctgctgccaccctgtctgggtttggaccctcactttgacctttacattttgagtaaccacttctatgcattagtttccttatctgtaaaatgagaatgatgttgaccattcaagtcaagccctctgataatgtgccctactgtaatgcgaattgggatatgctgcagttggcagctggctctggttctccctaacccttattcctaagcaggcagtggactaaggttctcatcttatcggttgagtaggcagatgctaaaggtgtcagcagtagcctcagctgcaaagtaaagaggtagagggtccagtgccttcatcctcagtagaatttttgcactgaactgatgggatagatactgataactgggcaggttattctagaattgccgtcactttcttgaaagccacagccagccacaggacccagaattgtccatccaggtggatatttacgattgtacatacaaccaccaccagctgggcccagcccagcattctgagattctttgggggaaccagtaatattgctcagacagcatgatttgttttcagaagagagagatcattggaataggatcctggagacctattatgtcagaaattaacattataattgcttaataatgaggaggtagaagtggtctctaatgttgaggtgatgcaagggaggagtcagagagatggtaggggcactaaactgcaatttcccaatcaacatatatttcaatatttcaacaactcataggattttactgatatattccaactaagtggcatctctactcatgaaaattctcatgaagattagaagaattattacttataaaatattttttaaagcgcatggctcacagtactcaacaagtgttagctattataattagcttctttcttaggacaatctaagcttgtgtctttgttttattaaactgtggtagtaggaaaagtgagacaaacattagactaaattgtgggaccattgtgcttatttatatctgattatagttaaaagaccattgttcctccagggtctttgtttagttttagtttaagtggatttgacattattaagagaaatagaggtggcatttcagtattgataatgctaatgcttctcagtggtttcttgtcactctgaatttcatgccttgatatataaccttttttccctctacactgatctattttctgtccatctgtacgtactaatagaacagtgccttgcatgtaggaaaattttgaataattgaatatatattcaagtggtttttaaagagaaaataagggttatggctagaccctacaatagacatgttagaattagataaagtgtgttttcccagaaaagggcaaaagaaaacaatgagtactttaggggtattggtgtcagagggatgaattgtttgtaagttattagggcttgcctgcattcctagtcctgaggatgactttcttgtaatgtatcctgagaaccagtggtgaatggcgctgcttgactctgccccaggagtgcttgtctacttgggaggaagaggactttctgtgtttcctacagtctgagacaaagatagaccttgaaagctaatctgtaatagttcaaggtgcccaaggatggtttaaacacaataccattgcaaaaacatcattgatatgcttgtatctcttgtccttgacatctcttgccttcagcttttctctttcttcactctatctagtgaataattctcacgtctatgtcttgtattaggagatctctttctgagagtttgatctacattatctctagctagaatgtttggtatagtgtctgcctgccacagataaagcactacatacctatttgttaaattgaacctggatattgttgtttcagcttctccccttcacctttccacttttgtttgggtatttcttttacctgcctcagttacctcccagctcaaggtcctctactgtgttcacaaatctgcagagtgtttgactattaagacagtagagtaactgcaatctcgtgtggccacttgccactaggaagacgtggagggagggcatgagaagtggaatctacagatatgaaagatctttggggatggagaagtaacttaatttgtccacgtagattcatgtttattgttaaacaagtcatacccataaatatttgtttctgggctcatctgggcttagatgatggtttatataaatcaatagtattaccacattaaaaaatgaatcttgagatttgcaaattaaaacatactcaatcaagtgcagtagctcatgcctgtagttcccactattcaggaggctgagatgggtgaattgcttgagcagaggagttcgaggctgcagtgaactatgattataccactgcactccagtgtgggtgacagagcaagaccctgtctatagaaataaatttttaaaaatattcatttaattttgttttcccacagaattttgtacgtcatcactgggtgcacaggcgtcggcaggaggggaaatgtaagcagtgtggtaaggtaagagcccagccacctcatggcctcgcaggaggctccccaggcctctgcaagcaactgaggtagatgagtcctgtccccaaatccagtgttcactgcatcagttcctttctgaaagaccttacttgtccaggtctccttaagaggcattgtagttgttctagaactcactgcatgaggcaatggtgttaataaaaagaattagcacatttttaagatacctggatgcattcttacagtgaatttcattgatgatttttgaaaacatgactgttttgtgaaaatgccttcatgaagacaactggctcatcgtactttggccaatcgcagcaaatcaatgggtttgagcaacactacgtttgctaatataaaattgtgtttgggcggaactgtttaggacaacatggtcagaagctagaaatgtgttgctcccttgggacattatccagttcatggaagagatgccctttttatttgtggttatttatatctacctcctctgtcatcatggctggttataggtccctcaggatgcagtgccacttggaaaagtgagctggagcaaggggtgggggtgttgtgattgtatactattaaatgccatagattccatgtgtcattgaccccaacagatttgggttacagctttttccaatgtacaaagatctactttaaggatgacagggtcctctgggagggttaaactggtggcgaatatcactataagtatgtatagtgtggttcaccaccaatttaaatgacattaatagtaagctgatggtcatcagtaaagggaagttttgatttggcagacagcaagataatttggggggaatatcttcctaaataattaattattcctctgtttgtttattcatgtgactcctttgggtcaagcattggtgtgagctgcccagtgcagcatttttgacagtagagcaatgcaaggaaatattggctgcctgagatatggttgtggagggtgagggagggagacttggaaaaaattgcattaattttgctgttttgcccaatgcctgggaagaaaatatgctgtaaccattggttatgaaggtcttctctggaaggctacacaccttagcctccagggcataggcctccattgtaaccagtattttgttctccagttcaaccctgtggctctcagttggttctcttttatcctgtaaagaggatgaacaaaacagggtgaaagcagggtgaaataaaacaaagtaaacaaggccgaagggggaagtggaaagatttgtactgattcttattggccatcctacatgtcctggggaaaaggaggtcacacctctactctcacatgacctttctctcttgggtccatcaacctcttccaaggtgttgccttggggcttatggattttcttttacttcaagaatcatcgactgtaactttcccataagtgtgcatgtgtgtgtgtgtgcatgcatgtgagggtaacagtatgctgcagccgggcaggcatagccattttttgggtcagagatgtaaagagtagtaagaatctggatgaataggtccttcactttggaaaaatatcttcactggagcccagtagctggcaccacctcaataatgtaagccataatggagtgggagggattttattaaaagaaaatcaataaacattttatactttgagacaagtgttccctagtgccatattgcactctcttctggcctcttgttggcatggtcaactgaacaggaagaactgggcttcctccaccctgagttgctgtgtgtcctttcctgccagtgttctcagccagccatcatgccatgagcacagctcgctgcacgtccgtcgtcagtggggaagtcagtgatccagcttgtcacatcatgtttcaaaaatattgcactattatagtcatctcttgtgtttataatgcagcttctccatgaattcttcaagactcaaacaattatgggatgggtgggattgtctccttgccacataataaattacccttccttggattccagcttccaccctggacaggaaagctatggctctatttccatttacagattaagtaatgaaaattcactccaaacattggtgctatacataattttcatcagtagtgttgtaccttcttattcatattcatagacttttttttttttttttttttttttttgagacggagtctcgctgtgtctcccaggttggagtgcagtggcgcgatctccactcactgcaagctccgcctcccaggttcatgccattctcctgcctcagcctcccaagtagctgggactacaggcgcccgccaacacgcccggctaattttttgtatttttagtagaaacagggtttcaccgtgttagccaagatggtctcgatctcctgacctcgtgatccgcccgtctcggcctcccaaagtgctaggattataggcatgagccaccgcgcccggcccatattcatagacttttaaacctcactccatcccccatacacacacacacacacacacacacacacacacacacacacacacacactattccataatttactcattgggatggagtgaagaataattgcttcacttagcaaaacttttttttttttttccaactgatggcttgcaaactttacagattttttaggaagtgtttatggttaaagagtgtttgtggtttccatttctgcttttaaaataaacaataaaatgatgtttggactgattttctcttgccttaaatatgtgtttggctgagtgtgtgtggcatttaacagagatcagatgagataactcatgatttaattgctcagttcctttaacgttagccgaatgcctcaggctactaggtttataacccttctgtggtttttcattgtcattcatagtccttgattacataagagtcagggtcaaggcagaaaagagccaaaatgctcaagttcaaattatgtaatttgatgagagtttaatgaggagaatatttaaaatgtgtgaaaagcatgggggatggtgggtggaaccacaagaaaaaatggagaacactgtgactaatgtcagagagctgtggtcaagctaagcctgaagaggtgaggagatggagaggaccccttcccaggagctgcaactttcagtcacaagactcagccagcctgtggtgacctagagcctggagaaatagatacccagtagatacccagctccacatatcttcatgttctagtggccaaacccaacagaaaccatagcacaagggattgtttgatgcaatccataaaagccaactctttacaatgagtcattgagtagagaaggatggagagtaaaacttgagaggcagatggaattgatctagcacatattgtttaatgcaaacctgtagtcaatcaatggttggaggcagaatgcatacttttgctgtaaacatgtctctgatcttcactagatctacacattgccttcattcagtcaaaatttatgaaacactgagttgtctatagtgcttcaaaaaatctatattcaaaaaatatagtaatgattatggctattttgactcttcattttttgagggaagcaaacatccaaacctagcattatggtaattgtgaaaatatgtttgtaaatcacaacttaaaagcttatcttttatttcttcatatgtaaaagttataaaaataaacaagctaactttttgaaaatcaaaatttaaaaatttccaacatcaattcttgaagccagttttaaatgcagtatacacattgaatatcccttatctgaaatgccgggaaccagaagttttttggatttagatttttttcagattttggaacatttgcgtatacataagatatcttggggatgggacccaagtctaaatatgaaattcatttatgtttcatgctacacttaaacacaaagcctgaaggtaattttatacaatattttaaataatcttgtgcatgaaacaacgtttttactacgagctatcacatgaggtcaggtgtgaaattttccacttgtggcatcatgttggcactcaaaaggttttgggttttgaagcattttggatttttgattttcagattagggatgttcaacctgtaatacatagttaaactttgtctacattttttatactgttcagttcctgtattaggctgttttcgtgctgtttataaacacatacccgagactgggcaatttacaaaagaaaggggtttattggatttacagttccacgtggctggggaggcttcacaatcatggtggaaggcaaggaggagcaagtcacatcttatgtggatggtgacaggcaaagagagagcttgtgcagggaaactcccatttttaaaaccatcatagctcatgagactcattcactatcacaagaacagtgcaggaaagacccgcccccataattcaatcacctgccaccgggttcctcccatgacatgtaggaattgtgggagttacaattcaagatgagatttgggtggggacacagccaaaccatatcagttccctaaccaaacatgctacattaatatgaattatttgtccataaatagtatgtattttcatatattgtttaaatagcatgctgtgtttattaaatgggaaaacatcaaaactactctttatttttagtaaatattgttaaaaactaacttgagagtgaacttagggtacaatatgtaaattatacacaaaaatgccaaagtgtttaaaactagttcatgggagtgcagttgggatattacatgggtagtgaaagggattacagagtataaaaataatggaaaatactgacttgggcctttcaggaatgtccccttatcaacttaaagcaatgtactctactaatctgaaaatgtgtaccctgggagttaaggttaaggacaaggaagggacgtttaagggtgaggatccatgcactcattgggcaggtttggttatttgcctgtctgtgtgtttgtgcagctatagcaaaggaatcctctcccagtagcctcaggaggattacgagtaggtagagagagggcagtacaagggcaaggaatccaggatgctccataaagcccctgcccacatgactgctggaagcctggcccttctctccttggctgagtatcaagaagggggacaaggacaaccactgttctactctctgctcctatgagttttgactattttagatttctcatactagtggcatcatgtagtgtttgtccttctgtgtcttatttcacttcagtgtaatatcctatagattcgtcctgggagggggaaatggggaattattaggcaaagggcacaaagtttcagttatgcaagccgagtaaggcctagagatctactgtacaccatagtgcctgtaattaacaatactgtgttgaatacttcaaaatttcctgagagggttgtgctgttaagtcttcttaccaccaccaaaaaaaaaaaaacctaataataaataaacagggcaggaaaacatttttggagtaatggatatgcttttgtcatggattgtggtgattcatgggtgaatacttatctccaaactcatcaagttgtgtacatgaagtatgtacagttttttaatgtaaattatacccccaaagaattttttttaaaagaaaagaggatgggggctaaagggtccttgctgcagtccccagttttcatctgtagaaccattttactgctgtcactgctccctgggtctttggtgtggtcactatcctggtcatcgcagcaaatacagtgccctggtcaccctggggccctttgttctttcttcagtagttcccgcccacttgtctaccttcttctggctgctgctgttgggcctgctggtacttgtgaacccagatgacctgcacggggagcagaggcccaaacctcaggccagggtggcaatgaggacacttcctgtcatggtgttcaggtcccaggtacacaagcaaatgacccctttgctccctgatcatgatgggggacatggtcccaaaaagttccaggtacacaaggtcccaatcccaaaaggttccaggtacgcaagcaaatggcctctttgttccctgatcagatggtcctcagagacaaatggcttctgtccttcttcctcacttcctcagcagggctgattctgcttctacatatttaccctcctttttggagaatctggcccaagtcatgtgtctcatgataaatctccggttttgattccagtctttttaagggactgatctcattgcatatttcatatgtttttgctctctctgttgctgaatttgattgaagtataaactagatattagcaagtaaaaacattttatcaaaatgactatttcaaatatagtaatttaggtgtagatgaacaatcagaaaagcaaatctaaacatttttgaaatctttgtgttcttctcctatttagaattactgtcagatagatgagatcatatatgtaaagcagtgtatggtaaatgtgcacctcatatttggatgccaggtgaggagagctagtttcctcatgaaaagcaaatcaattatagactatgtacaaataataaaaaatttagtattttttaagagagaaattagaaatatacagcttctctgccttttaaattaataaggcatataaaactgagaaattataaaaatatatacatacaacataataaatatctctgtataaaatatataattaacatgttatagttatttacatatgtaatgtgtatatatgtatatctatgtgcgtacatatgtatctgtgtgtacatacgtgtgtatatatacatatgtgtgtatatacatacacatatatacacacatatatatgtgtgtgtgtatatatatacatatatgtatatatgtgtatatatacatatatgtgtgtatatatatacacacatatatatacatatatgtgtgtgtatatatatacacacatatatatacatatatatgtgtgtatatatatacacacatatatacacacatatatatgtgtgtgtgtatatatatatatatagttgttcttgccagataagagactgaaaattcataaaagggcaaaaatagaaaaaaaaagaagcattggggaaatgaagaaaataatgacatttaagataaaaattggaggaggaacatgaacaaaatgtatatggagaggaaagaagagacgaagaggtgaaaggtgagaagcaaagggacagaaaggtccagagagccaccagcaaatgagtaagagtatctggagaatgaaaaggaggagttgtgaagccaccaagctgatatttacaagctgagctgtgctcattcctgggacacactgggattccctagggcaggcaggcttggaaaggggtaagggaagcagttcccaaatcctcatttaccgtttgtctctttattaaaacctgaatctgacctgcctgagaacacttttgtgattctttgcgctgacctccctttccaaattgcctttcttcaatccgcttatgacggaaatcattcttttcagtctttgccccaggtgtaaaaccctagggatgtcaaacagacatgaaatattgatgtcagaaaaaaatctcctttaattaaaaaaacaatgaaatgaaatatgatttcaaggaagaaaaagaaatgatataaaattctctcttgttaaagaaaaagcatgttatgtattctttaaattgaccaccacagtgatgagcaaagccagtgcttagtttatttataatccaggcagagaaatatgagctgaatagttagctgagaagcaaaaatcaaggttctgctgattaataattggagctttcactccctatagggcaggattaatccaaaagtacatccacagttgattaaacaagtcaggtaagtctaaaagtaccttcaagttggtttagcagttggttaggaaagttttttattttgatgaaagtctagtaaacaggtgtaattcttctttattagtttcagctggttaaaagcaattttggtttaaacacagcattccattttgatatctactaggcaagtggtattgttgagaggacagttttccttttacatggaaaatgtttcctttttcatggtcttctccaataaaaagataggcatattattaccttttcagatccaaaccattattttagctcagggttcccaagaaacggactcggagttgagatttatgtgtatgaagtttattgagtgatctcagaagtgacaccggtaaggaagtaaaagcaccaggactgggtagagggaggtgttgaactgtggggcagtcacaacagaggccttagccaactccatggggaactggaagagcccttcagagttacccggacttgaccttggccttgacccacaactgggcgagggctgtccttggccgatgtcttcgttcattgcattgctataaagcaatacctgaggctgggtagtttataaagaagagaggattatttggctcacagttctgcaggctgtacaagaagcatggcaccagcatctggtgagggcttcaggaaacttctgctcgtggtgcagggggaaggaggagccctgagtgtagagatcacatggcaagagagaaagaaaaggggtgccagtgtcacccaacaatcagatgtcactggaactaatagagaattcactcattgctgtgaatgcagcaccaagccactcataggggatctgcctccatcacccaaacacctcctaacggttcccacttccaacactggggatcaaatttcagcaggagattctagaggggacagatatccaagctgcatcagctcaagtgactcttttaggctcagggcaattcctgaagatgggagggtgactcatttgaagaccttcagcttccaagactcttctcaactgagggaatgagatgagtggctcaggcctgaagcagagttatctgggtggaaagccacagtattcaatactgtccattcctggtgctactcagagtaccttgttttgtatcgtacatttttagagcagctctttcagggttctgattggtcacatttcctgggaaacatagaagaggaaggatatgggataaactatagcccccatggttgcagctggtcttacatctgctactgatattcatcatctctctcctcaaccacttatcctggattcacctcactctcaactagtgcctctggtctaggtgacctacctggtaggcggaccaagaccgttatctctctgcagtctgattccctggtcttggctgctgcagttgtctatttattattaaaattgttcatagcattacaaagcctgtcccagcggatttcctggttaccagatgtattcttccagcttctgttgtcaggtaacagctagatctgtgcctaatgatcaggatcaattactcctgtcaggatgctggctcctttctgtgcctgctagtctcttaacacaaaaattccaaagtaactgggtgcagcagtagcttaaagtttaagagcttcctgttaagtcccatgacgaagaaattcaccgtcatgggatttagaccctcaaagcccggagctctggggaccagaagcacaaactcccaaagtgggccacagtaggcatagccactgttactttctctcactggtttctgtatttctgtattttgtcatggagacacagcaccatgaaatgatcatagatttagtgagtaaacatactgagtctggtggatggtgctcataggatattttctcaaagctgaagccagtgttatattttcaaaagattattccatctctctgtcaggccttcatcttctggatggtgtaggccgtgatagtccagtggatctcatggtcacatggccgcttctgcacctctatgccataaaataatttccctggtctgacacaatgttgtgcaggatcctatgttcgtgggtcacacatttcgtaagcccttgcatagtggtgctgactgaggccctgaagaagggagaggtaagcccatatcctgaatatgcattgattccagtcaagatgagttgctgccccttctaaagcggaggggcttcagtgtaatcagtttgcctcaaagtagctggttgttctctctgagggatgatgcaatattggattctcagctttggtgtcttttgctggcaggttagaaattcagcagtggcaggagccagctcagttttggtgactggccacccatgctattggacccacatatagcatccatcactccaccaagggtactgcacttacaagcccattgcaccatccatcaatgggatggctcatgacacagtatggtacctgcgttgtgtctaagattttagttcttacaaagggaaagctctctggtaggaattaatgtgcaataatcttcactctttgtacttactttcatatgtccttccttatacctcttccctagacctcctgtttccctccagggccctggccaaccagccttgccatttatcactgcctgtgcatcattatatattctatgtcaagccacctatcttttcacataaatgggatgacaatttgcttcacctgaagttatgcccatgaggaggatttcttattattcctgtctctaggacccactcctgagtaggcttcagtgcagcagtagtttacttttggcctggacgtatataccaagttgatccatgcatgaaccaatctcagcattttcctcctctttgagctcgtcattcagtactcccatttttccagaggtgagttgaatgagagacctggtactgtaataatagtggataatgtgggtgatctgagccacctactcatgcatccctggtactgcttgttccagatctcagatggtcccacttactataacaatggattaaggctgggctcactcaaccttatgatgtagtgatctgacagaactcagctcatgacacctgatgattcatggacaggtatttctccaccagagtacagtaacctgccagaaaatatttttgaaaggtgtatagttccctcttgcagatagcacaaccttgtttcagaatcctagagtctgtgttgattttcctattggtgcttgttataagcatcacagggcatcttttctccttctctaaatttctaatcacatggagtgacagggattctttcattgcaggctggacctgctgcagcactgtttcatgctctgggccccattctaagctggcagcatttaatgtcatccaataaatggatcacattcctaaatgtagaatgtgctgcctccagaacccagaaaggccaaataaagtgctgtgtttcattcttagtggtttaaattatgaaatgcaataattttttctttagattggagaggatattctagcataccttggactactgacccctagaagcttcattgacatgggggacccctgactcttcatagggcttatgtcccacctttcttctcaccaggacctctgatgtaccttccacttcttgctcatctgctttaatgtgatgctgctgatatggtggaccaaatgatgttctacagaatgttcacacagttcgggttcctttgcattagatctggataacattcagaagagttgaaagccctggtacatgcctgtaaaaatgtactgttaaccctgaaagcacttgcaaatagttttgaattctcctttcagagagggatggaaaaaattcatttgccaaatgtcatgtacttaaggctgaaatattctaaatttggcacagtggctgcaaatagagtgtactgggttaaatttgtgatattcaggcaccattctccagtctttggttttatgggatctcagctggtgaattaaatggggatatgttggagtacaccacctctgcctcctgcttcctttagtctttaagggtggcacttagataattttggaaatgtaaacacaataccatcgtcagagctttcaaaattaagataaatttaatgcctattacttcttaagaatgtgacattgattttgatttagttatggctagaaggatggtttgaagctttcacttgggcttcctcttacacaacagaccaagaaaccagtcttggggttgtgccagtttccaagtctgttcactccacttacacaattgaggacaaaggaaattaatactgatggatttgtggaaccagtagactctctgaaaaccagccctggtctaggactcctgctttttttttttttttttttttgagaacgagtttcgctcttgttgcccaggctggagtgcaatggcgcaatctcagctcaccacaacctccgcctcctgggttcaagcaattctcctgcctcagtggcccaagtagctgggattatgggcatgcgtcaccacgcccgagtaattttgtatttttagtagcgacagggtttctccatgttggtcagtctggtcttgaacacccggcctcaggtgatctgcccacctcggcctcccaaagtgctgggattacaggcatgagccactgcccctggttagactcctgctttttttttgtttaactgggcctcacgtttgtttgtttgtttgtttgtttgtttatttatttgagacagagtcttgttttgtcacccaggctggagttcagtggcatgatctcggctcactacagcctctgctccctgggttcaagcaattctcctgcctcagcctcctgagtagctgggactacaggcgtgtgccaccacgcccagctaatttttttgtatttttagtggagacggggtttcaccatgttggccaggatggtcttgatctcctgacctcgtgatctgcccgccttggcctcccaaaatgctgggattacaggtgtgagccaccatgcccggcctgtatctttattttaataggggaccattagatacctggtgctgcttcatacccagggtatacatgtcaacttgtacagttgtccattagtctttagaatatttggacatttctctctctcctcagcatacaactacccaagttaatggatgtaggtccttttagttaaagaccagaaaagtgttaccatagactcttgctgtgttattgtaagattcttctcctggggacttaccctctccttcaatcaatggattctgtctttgaaaactagcttaggtcgagaaacagagcaaaagattatgactttttattgcaacatctgccctcatctctcttgatcatccattcttgatgtcttctgattctattaattgaggaatgtctcttttatccgataatccatctttcttgtagggatgtcatgctatgttaaccatttccatagctctctaggtcaagtccccttgcaacttcaatcttacagtaagtgcacccactttgttttgatggtttagtgctattattttagaattctatattccagttactgtcagagtgcccaatctgtaaggtgtttcctagcatcaggtctaacctacgagggagagccacctctgaacttcccaacaatgttggtgctcttctcaccagcacatttcttattgctttggtaaatggagtgtcctttgggcctctggcagatcatagtcagctgatgggcttttcagctgtacctaatatagcagctttagcctgcctagttctgagatttggtttgcttcttcctctgtcacagcaattcaggcatttttactttacttaacatggttcattttttttttgttcaaattttcaagaggcaccctggtgttatcatcttctagggttcttgataatgtgttaaatcctctagtatagattagtgctcccacaatgggaaattctcctttatccaactctaagttctgccctttttcatccttcaccctcaggatccagtcccccactctctcccattcctgctagtacatagtgattaggtcctgcagctagttcttttgagatgtagtttttttcactcttagcagcctcttcaccttccctgatcaggcacattgctctgcaaagattattagatcatttgagatactactgggaagagtagatgtagtaaaaccccaaagtgaagtcaaaactatttctagagagcagactcttttctccctctaaggcatatattacatgctaatgtcaccttgacataaattcatgaagcaaggaggggcacaatctgagtaattctgggaaattttaaagtctccttctcagttgtctgggaactagtatagcaaaatagtctatgtttacacaaaaaggaagtgtagataattctaccagcagaagagcattttctgcaatcaacgagctaaggctaaagagtaaagacaattatttcctgtaatgtcacaccatcggcaagattatatgttaggtggcttaactgatttgtcattggtaactctgttaacatcaatcctatctttcaaaaatatttaaactattttaactagtctttttttcaaaaaaaaccctgctttgtgaatattattagcattaaaatgataatttttattggtaagtttattatgagttaatcagaggtggaaattaattttcatggatcagcattgtcataatgatagctagttgccttactaaggtaatactttcataaaagaaaccttcctggtgttctaggacaaagatataaacccaacaggtaaaggttcatatatgattttggccttattgaatatagcactaactatctgaaaaaaatatttttgtcctaatatcaggatagtcatagcaatatgaaatataaatattatagctaaaaatagttaatgtaaattaaaatgtacatcagttgccattgttataggtgtctatctcaattccaaggtcttgggttaagttgtctgtttccacgaaggcatctgcttctgaaatgaagatatcgtggaagctatgccttagttgtttcatacagcatgacacatttgtggtaagagttgttaagttgtactgagaatcttgtgccttaaatttttgatgtttttccccagaagactgaatgatctatagcttgcagcaggagccttcagataaatgaatggaaaaagcaaaacctttctcaggatgatgggggtgattggctttgattaataatatattgtgattaccaacaatattagaatggaggaatttagaatacagaggggtaaaaaaatgtcaatctatggacataaatccttgattcctctggaacgggaaaatattatagacagtaagggcactgaaaaactttcagagtcttttattaatgccataaaagatattgtaattaaatccaagagacatgcatttagatttttcaaagatgattctaataaagtaactatctagattcagctaatttgcaacactgtcagaaattataaagatcttgtttactataatccaatatagatgaatatatatgtttacattttgaagatcttgaatatttataacaattttaagactagtaaaatttgtatagaaaatttaggaaatttagaaaacttaggttttctatgggtaaataaaccctagttttgcaaagtctagaatattatgctaccatttttacactgtgagaaaactatggaaaaggcatattatcaaaccagcctaattttcaaggtttcacattagtcacattaccaggcaagggtacacatatcagcagaaaactaggctgaataatttgttgaaggaaaaagccaataatttgtgtatgtattagggagttgggttatggtgggttttgctggttaaaaactgaaggctacactctggataagacagatatagtccgtaagtcagtagatagttggttaaaacaaatgccactttttatcactgaaaaaagttttcagttaggttggtgtgggtctgtacctgggtcacgtgaaggtctcagttgcttatctgcttccactggtggaatgcccaaacatcacagttgtttgtcaacttcggagggttggaagcaattatgttgaaacaccacaaccagtttgaggtcttcaagcaaagtgaaaatggaaaaattgtcttgacactagtgtgtaccaaatcactatgttattgctatcccatagaatacctttatatgtggtccaacagtttgattttaaaattttcatcttattttgctagaaacttaactttgccattaattaaatgtatgataaacattttagagatgaaatataaaatacataaaagtactttttttttttcaaaaatcataggaagtatttgtgtagaaatgtttggagttctgtgttttaagataaatattaacgaaagcaaattgagtcagtcttattttataattccatgggtttgtcctttgtaatactttgtgagccttggacacgctagtggatatggagaggtttattttgttgtttaaagttttggaggtaggaggaatatcaactcttgtgttggatcaaatcagatcaaatagggaatcagcctatggtcagaatattctctcaccccaaacaaagttaaatacagaaataatgaaataaattcagcttatcttaagtcaagccctttttttttctggtttcagccaaggctgtaaaactgagtgccctctggtacctgccctagatgacagaagaagtcagaaggcaacaaaactttagtactcagaataaatctggtttaaactttattccaaaggctcaatttgattgaaaaatcccaaagaacaaaaaaagaccttattcctcaatgttcttggtatttttaatcctgaagtcagttggatccaaagcatctggcctcccatccctattttcctctttgacggtactgaactaaacagctcttaaaaatcacagagtcggttgaacttcagtcagggcatctgtcagtaccatattagcagatttgggccaacatttaaaaatgagtaattgggaatctggttcattttggcatgctgagagcctggccagagtcttcctatagcaggtggtttaatgggaacttggtccatgaaggctctgatgtgctctatttatgtctctgtgttagatgataagcccgaagctatggttgctgtgagtctgccagacaagaatctaaaacaaagcacagagttgattaccaccaggctcattgccaagggccctgccacaatactgcataagtgtagtgcccagtgccccaattgtgattggccttattgtttgtttctagtatcggtctggctgttagtaccacagtgtattgtatctattctctcccaaaaaccagagggctaatacttagtagcgaggtggggctagatacactcaccctatatcattgagtagagcatcacttagtcacatattagacaccagaaagctttctcggcgagatggtggaagagattcttgttcatagatcttggcaataaaagcactccttagctttatataaacacacattaaatacataagtaggtaaagtgttataaagagttttaaatgcatggcctcatttgatgcttataaccacttagtgttataggagaggtttgtattattattcccattttctcatgaaagaggaagttagaagagttaagtgatttgcctaagatcactcagccaacaagaagatccaagaatggttctgagctttgccgtctctcctcagcttttgtttcatgcacagccatctgatatctaagtggagagaatggtggcctggtgattgcatttaagacttaataatgatacatttaaaactgtaacatttagcagacctctagttgtggctactactgctgtcttgccacaaattctactgtattgatttttatccatgccgcattttaatattgtggacttaaaaatgaacatcggaatcctaccatctttgcagtggctgtaggggttagtttttttgcctggaaggatgctgtgaggaaacattttcaggtggcttgggtaaggcttataatgtctggatagcgtgaagtttgtaattagatcatgacagaatagcagcaactttttgttcaattaatcagaaaatatcatggcatgcctatgatgttcaaagaactatgccagtttgctaagaactagacaaggactgactgccttcaaagaacttacagttccattgagagataatacatgtgcacacaaaataaccagccacatagggcagctatttataatggcaagggtaggtacgaggcaaggcaagcctgtacaaggagaggtcacagtgagttgaggttattttggaagactcttgtagattttttagtggaagcaaaatttagatactgtatatgaaatgggggtaggtttctagatggtatgttgggagtgaagaaacagccaaaaataaataaataaatagaactataaaagaataaaacatattgtggatatgagtagacctgtctcactgcggacaggaatttataatgcaaaggagtggaagatagatgtcagaaaattggtgggaagattatggatggccctgaatacctgcatgaagagcttgttctgttaatctgtaaggaaagaagtgtcattcaagtattttgaatgggaggcagaaacttagaaagcatcatttcaccgggtggcagtgcccaggatagagtgaggaataaagggagaaacagactatcagtggagggacaagttagaaaatggagcaaaaatccggatgggaggtgaccctcagcagagcgtgataccggactggacagaggcactcgggtctcaccccggcttctgctgctcttttccttcccacacagtagccacaaggtgtcgctgtagcctttttttgctccctgaaaaatggcttgggggatgatgaggagcttttcaaatggctgcaatgtgaagtcatttctgcagttttggtgccatcttatttcatattgaacagtttagcatcatcttggaaaatacctgcatacctcaccctttggcccactagactctgtgtcctcttgtaagctgttctgtttaggcggttgcaactctcaggtgttggggactgtgggggttgttgctggccctgtagtagtaaacacatggacatcaaaattcagcacttaagtccgtgtgtgtgtgtgtgtgtgtgtgtgtgtgtgtgtgtgtgtgtcagaagcactttttttcttcttgggaaaagatactgtcattgacagaggaagaaatagcaggagtccttatctgggaggagaggaacatatcaggggtcctcaagaccaccccaggttcagtgattcactaggaggacacacaggactcagtgtatagtgctaatatctatagtttattacaacacaaggatgcaaagtaaaatcaacaaagggaagggctcatggcacaaagtctggaggaggccaggcacaagcttccaagagtcctctcccaggagagtcacacaggatgtgcctaattcctccagcaaagtactgtgaaacacatgtggaaggaatactggactcagtgtccagggtttttattgaggccttttcacataagcacttttcacataatcacataagagttgcaactgcctaaacagaacagcttacaagaggacacagagtctagtgggccgaagggttaggtatgcaggtctctgcattgcacataataaaattccagacttccagaaggacaaaatgtacattggtgcaaaaagtttcttttctgtctttttttttttttttttaattttaatatagagataaggtcttactgtgttgcctaggctggtcacaaactccagggctcaagcaatctgcctacctcagcatcccaaagtcctggaattacaggcatgagccaccatgcccagtctgtgcaaacagtttaggcccaatgagactctcttaactgtgctgtcaattggagaaaccctcctgcaatccgagttcccagatgccaaccaagggccaaccttgcaagcagcctttctttatttttttttaaattttttattttattattttttttgagatggagtcttgctctatccctcaggctagggggcagtagcacgattttggctcactgccacttccgactcttggattcaagaaattctcctgactcagcctcccgagtagctgggattacaggcgcctgccaccaagcccagctgacttctctatttttagtacagacggggtttccccatgttggtcaggctgctcttgaactcctgacctcaggcaatctgcctgcctcagcctcccaaagtgctgggattacaggcgtgagccaccacacccagctgcaagcagcctttttaaggagtctgatttgctatgttaactcttttctgcacagggagtgaaaataccgcttaggtttttgagaaggaggtattgatggatacatttttcaaaacccaggagagtctgacgttaaggtcatgtctctggaagtggtagttcaggttggagcaaaagtagtgaaaccagtcctggttgtctgtccacatacagaagactggagaggtagaagagaactgggatggtgtgttaggaaatcaagagaggagagaaggccgggcgagatggctcacgcctataatcctagcactttgggaggccgaggtgagcagatcatgaggtcaggagattgagaccatcctggctaacacggtgaaaccctgtctctactaaaaaaatacaaaaaattagccaggcgtggtggcaggcgcctgtagtcccagctactcgggaggctcaggcaggagaatggtgtgaacccgggaggcggagcttgcagtgagacgagattgggtcactgcactccagcctgggctacagaccaagatcccgtctcaaaaaaaaaacaaaaacaaaaacgagagaggttcaaaaggaggaaatgctcggtagtatataaagtactgcagatgggcagggattatgggcgctgaaaaatgccattgggacataatttaataatgtggtaattgattttcaacttaaaattatctgtacacattaagccagacttacttagccagtgccttgaatagctttcctgcctatcacatctttctgttttcttttgatcaccttacaaaagctctgttttaacattttttattgtggctttgaattttttgtttgggtttagatttcacaggcagagggaaatggatgagctttgggaaggctaaaaaaattctttgtgcaatactacatacttctctctggccattatttagggacagcagcagccgaaaatcacctcttctgttctggatggaaaagtaattcagtttgttcctttaagaggattaggtttaccatttcattgatttcatcgttgcttcctggtaaagaataaaaattaaaagctgcttgttttgagtggagacatctcaaggggcttatgaaagtgtctgaatttactactacaccgttggacttctcccagacccggagttccagttattgtctctctgatatttcatttctttttttttttctgggttctcggatgctaaagttgtatagaccctctgagatgaatgattattgttagacaagaccatgtgaaccaataatggcttttcctttggttataataaaaacatatcagaacaacatttattttttcaaaaagctctttttgtgtggctgactttgagtagtaggtggtctaggaaataccagcacctcctctctctctcacttgaaatgcttcaggattagaaaatcattgcaggcagaaagtggagagtgtggtgctcaatgtggcctttgcaattctacttacctccagtggtgggtgacagtcctggccttctggccttattcacgtcattgcacttcaggagggcaaatgtgcgctgtaactgaggtggttttaaattatctgtctcttgttctaatatcccagggcttccagcaaaagttctccttccacagtaaagagattgtggctatcagctgttcctggtgcaagcaggcggtaagattgggatgaaataaagcaatgtgggctcatgttttgtcgaaatacacttgtgtcattatttgagtttctccctggaagtagaaggcattcctaatttaatgtattgcttttctcatataggatccttggaggaagaaagacagactgaaactatagaacaatagcatagatgagctgggatacactagagagataaattaacttctatattttatgtacattaaagcttggggtcaaagactagaaaatcctcccctaattctaacactgggtctagagttgaggacttctcacacctagaccacattttccctccagtacctctgtattgttgagaactcctctggtatgaaggtacaacattagaagcaaagcaacgtatgacctaagaggtccctccaacacaggtggacaggaatcctggctcttctggttttaatgtttaatgtgcatgactttttattttggggctaagtgtgaggataagaagagtggttcttgtatgcttttttaggtttggatgttgtctgtacactcattgaaatgtagctctttcttacatttgaacatatatatactcattaggatctgatggtaatgtccctatttatttttctttaatctaccttttttcccactttatttagagcgtaattcctcggtctgtaccagatgctacattttcttatttgtttgtacatgtgtacctgtgtacctgttctttcttttaccacataacatatagtctaacccaggtgttggcagactacagctcgtaggccaagtctggctgccatctatttttgtaaataaaatttcactggaatgcagccatgcccagttatttatatattgtctgtggctgttttttttcatttatgtattgtctatagacactttcatgctacaatggcaaggatgagtaattgcaacagaggtggatgatcccataagcctaaaatatttattccctgtgcctttatagaaaaagtttgctgatgcctgctgtaatttctcaatgtccctattcttttgaataagttggaatatataaccccttcattgcacaggggacctgcaaagaaaaggctgtggtgtcttggtgaggttaaaggtttgcagaaaactcctgccactacacacatcacgctaaactagccacacaggccatggggctggaacagatgcatttagttgaaacatatgaaatggacattttgtgggtcaaaaccatttatattttggcagttccatatagttcaacttaataatatctctagcctcctacatgtcagaagaacctgctgtcactagatagagactcggtggtctggaaagctcagtgtcgctgcatcacaatcctgtgacattttttattcctggcattttcatttactttcagttagttgttacacaaataatcatttcacttctgttcaagaatgtgtgcacaaatataaggccatcctagttattgaatgaaactctgtaccagcaaggcaatatctccatttgtggtcctggggtccccagtgctgctatctttgctcctggttcttctaatctggtgagaccccactggtggggcagccttctgggcagcggtgtgctcagatcggctgcatctgctcctgccctgtgcagctaccaggctgtggtgcgatggtctatccagattcaattaatttggaaactcaatcccactttacaatgaacatgtgtgctctctttctattaatctgtagtccaactgaatcactacaaaggacaactttcacctgaccattgtggtagagctttggtcagttccacttatctttgaatttcccagtttcccaccttgtagaaggtgatttttgtaaggataataggtacaaaagatttgaacacaaattacagcggttgatatgttttcacagtccaggtgaaccccttctaggatatttgatgtcagacaagcaaataaatatgtgaccctttatggtacaggagaaagaatatggggtttgggacctggatttccagggttggggttttgattccatcatttaaaaactgtgcaatcttggatgtacctctgagtctctagagtggagattacttaagtattcattgagagacttgacataggcagtctctgcgatccctaatgttttagaaatgcagtggtcatacatttgagggtttatttgaattgccaagaaaaaaaagcaatttttaaagaaggtattcaaatgttaataatatttatctggtatatttgtttgcagatcaccaataactggtggcaggcagaattattaattattttaccagtattttatatacaattgcttgattaatgattagccactggatcacagcagatcttgaagacatgtagaaatgaaaacaaaaacctctctaatgttatgtaatgtaattagggtggacatatttgccagtttttttggagacggtcctaatttgtgtttgtgttttcaacataattattatcagtgatactttttacttttaacattgttccagttaaaatgataaataatatagttacgtgaagtataatctaagaagaaactgaggttgaatttttaaaatcactgtgattaaaatttaaggcctataattattgcataatgttgattttagttttctttttcagaaaaataaatgttattacacatcactatcactttatagtcacacaaaagatggttgaaaacttgactggcctaaggtcaccagtctgagtgtcactgttggggtatacagttaagaccctaatactgtggtattgttatgatcgttagcctacatttacttcctttcaaaagcaaaaatcactttagacttgccaagagtaatagggtcattgaattttttttttagcagtccagacaaacccaacagaagcaatctctttgtactttgttacttctgggattttcaactctgtagaagagacatcatgcttcttttctgccttctctaaaccggaaagacaacctgggaggatttatatctatgataggaaaaggaaaggcaggtggtaggcattgcctttctgcctgttcatttccttcttaacgttatcttagatcaaccaagtccatggccagcacaggtcaagggaagtgtatgtgaacattttgtgcaaaatcaggattaatagaaccctccaagactctaaaacttttaagtaaatattccatgcaacgattagaaagttttagcaggcttcatcctgctagactgatttcttgttatcaatgttataagtttgtaaaccggaataaatctgaagtctggtctctaagctcctggggctggctgggtggtgatgaggaaagcatgtcctcagtcctcagtgtgtgcccatgtgtgcatgtgtgcatgcatatgtatttttgtgcatgtaatgagtgtgtgtgtgtgtgtgtgtgtgtgtgtgtgtgtgtgcgtgtgtacatatttatcccttcttgctgcagcattactctttgaccagaattgtttactggcttatttttctcttcagtttcacaataaggtgacctgcttcatgctgcatcacattgaagaaccctgctccctgggggctcatgctgctgttattgtcccgcccacttggatcattaaggtgaagaaacctcaggtaactgccaggactctggtgctgctgggccagtgcagagaaaaatgaactgctgcttcgtgcttttctccccagactagtctttgggttcctatgacctcagttcactcatccccaaggccctgtgcttagcttcctcagttcatcccattggcccatctctttcccactttgggctctctcatggaaccagcctccccatcctaatgaattcaaagttctagagcaggaatgttgcctcctcattcatgtgctaatgatattctctttgataggtgctcttccaagtttcattgagtactagtggtgggtatagctgatgcttatacaactctgttctcttccagcctgggcattcccagagggtcagtgtgagggcaaactgttcaggcttcatggtttggttaagattcctgccacttccaacctggaaggcagaccatgaatcatgaccttcctgaatacacaggcctgcttagagagtgacatttgtttttttcttaaggcaaagtagaatttattctcttaatatctaatctcattctgtgttctccccagtgcacttcctgtccttgtgagtatccacctcagtattcagggaaaccttagtggtttcttgacaaggtcgtaatctttgaaataaaatgtttctgcctttgtactatacatccttgacagttagcttcaagttatgggatggcagatttttaatgctatgggaagagagactatacctcccttagggtgcaggtactgtaggaagacttatcaaatgcaatacctttaaatgatatggtggtcctacttcctgtggtctccagactcatcatgtgattcattctcattgactcaggtttatttaaaaactggtggatcagggatactgttttgctttctgtgttttatataaagtttagactctgttgatgagtaatgtttacgaataaaattatagtctatggaagcccttgggatatttttttccagaggcaagtatagtgtctacatattaaaaaatgaggagcctagtgcttcattttatattttagaaccaaatgccaagatatgttaaatgagttacccaaggtgataaaacaaattatatatagtattactatttgaaattcaagtgtactgaattccagtttttatttttaaatctctttaacatttctactttaaaattttttttttctaaaatttggtaatctctccaaggctttacattaaacattcattcagttaaatccacatctttccattgaaaacctcgattgtatcaggaaggctaataggcattgcgataaaatacgtgatccttactcttaagagtcttgttatgaagtgggggggagggcttcatgaagaagatgggatttgttctgctttgtaaaaatgggtgagatttaggtctgtggagtagagagagagtagcaggcaggagaatggcacacaggcatgagtactgtgtccaaaattatatccgtggaactgtgagtctagtttgaccaaagtgcagggtttatgcagagggtgtgtgggagatgaacatacaattgctcaggcctgactgtggaggaattttttttttttttaataaccgtgaactttatcctgaagtagcagcagagttccttttaagcaaaggaatgatagagtaaaaaaaaaaaaatatatatatatatatatatatatagtattttagaaagaaacaagtagcaagagtgtgtaaaatagcctagtggtatgggaatttggaagtccgcagacacactagttaggaaaatcaggggataataccagtttgtagggaaattgcaaagtttactcttctaaaccttaagaaaccctttttgttatggaaattttcaagcaaatgaagaaaaaggttataatgaatcctctagccatcaacttttctgccattctttttcatgtgtctcctgctacttcatattttcattttatgaattacctttttcttttgagattcacatgcagctgtgagaagcaatacagagaaatcacttgcacccttccaaaatttcttctcatggtaacatcttgcggtattacagtacaaaatcacaaccaggatattgaccttgattcagtcaagatacagaacattccatccccaggagcatccctggtggtcccttgtcaggagtcatatccatttcctcctggcctcaccccatctaccccatcttcctggaagtggaatccccctactttttctttaactagagtattttaaaacaaacattagacagcataccacttagtctgtaaacacttcattatgcttctgtaaaagatagcattaaaaaaatccaaatgccattatctcagtcatgttaataatcccttaaaattttttcctgttgtctaaaatatatctttttttactgtttttcaagtcaggatccaaagttcacaactgccttttgttgacgtagttcttaagcttcccttagtatagaacaataccccctgttatttgtcaggccacttacccgttgatgaaattgggtcactttacccataggatttcccatattttgattttggctgattcttaccatgtttccaaattatttctcttattgcccatatttcttgtaaactaatatttagacacagagactcaattatatttaggtttaatttttttttttttttttttttttttttttggtaaaagggatacactggcagtacattgccatcacaggaagaggatatcagccatttcactctcagtgatgctaagatcaatcagtgggttcaggaactgtcatcctaatctgtctatcataaagttcaccatcagcttgtcatctattgttatctatcaaagagttttgccaaagtctattattgcattaggggttgccaaggagtcgttttccaattttcactctttttagctatgatttttagaaaagagacctttccttcatcccaacaaatacatgacaaacgtttgagtatttgcctttatttgtaagttttcagaataataagctgatgccttagcaacccttataggatgtagtagtggttgtttttttggagagtatcattacgaaattacttaattatgtttttatgtattatgtgtttttccaatacgttgtcatcattcttcttcctatgtttatattgtttcatctccaaccattggaacctcttccacatggtgtctgtcttcacatttgttatgagccatgaggttttgagagcttccttggttttaggaacaataccatgtcccaggatcatttaatgcatttcctgtccatacctggaatcagagtcttggttctttctctagagtcttggttacttttaatgggatatgggatttatagctcatagtctggatgcacagtccaaattcattattcaacatgtgcctttttattaccgtctatgattcaggacaatgtagtaataataatagtaagaagagctaacatttatatgtgttaggaaagttttcagtattttacattcagtatcttattttatcatcatagtatcctatgagcaggtatcctgttattcttactctatatctgaggattgtgaggcacagagaagtcaaataaattacccagggtcatatagttattaaatagtttgagatgggacttggacccaggaattttgattccaaaaaacaagctcttattggtatgccacactgcctcactatctttctgtagccagccttgctgaatcagatgttttaaaaattttagtagtcttttctttagtgggcttcaaagccatcaagtaagttaaccaatgaaccatagtctatttaaaagctgaggtatggtgagcttgtggggacaatgcagcagtggttaagagctttctgacttttgagccaataccacctgggcccgtaataaccttgctgtagccacgtaactaatttgtgtaataccgaacaattaaactcttctattgaaactcttcgacaccaatgttaaattctatagacataaaaaaaccacgaggaagaaaacaaggagaaaagtcattgtgtctctgatctgttcatagatgacagtaaaaactatagtttgtagtgtgtggatcatgggtggcaagttttagccatgatttggaggtcaatatattagagaattcatttaagacattgggaagtgactaacggaaaatttggaacataggtggagaatagcagagtaaaatgtttttccaaatttgaggatacacacacacacacacacacacacacacacacacacacatacatacatatacacatatatgtatatgtatctatattctatcatactgcttcaaaataaataatagagaagatgttcttaattgaattcagttcatgttaatttaactacattcagagatgctattgtatacagtaggaggtccaaagatgaatccaccgtgatccatttccacaaagagtatactcaatagtggggaatatagctagaactatctaagtcactgggcagagtgtttgtggattttgaaaaattcagctgtgtgtaaatccttaataaaagagtgcctcctactatctcggaaggtttgctttttggtcagtatgcatctttgggagaaacacacaaaggatggtgagaggaaggggccagacaggttggttgaatcagccatggtcagcatccaaggtggcctatctatccaaggtggagagtggtcagtgctacctaagatgtataaacacagtgtgaatatgaagcagtacggagcattttcggtcatggggatcagggtaagctaaatagaaaatatgccatttgtggtaggccttaaaggatgtaggcagtgtcagtgaaacacgggttgagaaggacagtaaaagttgatagaactaactgagaacagttaagatggatctttaaataaagtcagctttatttgggatatttgtgtctaaacaagtgactctagagaggaggagtaaaggaaatctatttgagggtatcatggtcaggagacatggtttataaagagttggaattaaaccgcatatttcatttttactccacgagcaactgtggaattggcagctctgtgaaaccttgatgctaaagggagtgagggctgcttgggtaatttgctaggtttcatcacctcattatttagagagatgaagaagttattttgtagaaataaaaaggtaatggaagatagatgattttaaataactcaaatgaaaaccccaaatttaagaatcaagcctggatctgttgatatatttgaagtccaagttatatttaaagttacaaatgtcagtgtttctctttcggactgaaaatattactagacaatattttgattggacaggcaagttaaagatggtcaaataccagtgcatatacttggagctgagggattgagacttacgtgaattttctgtggggtcaagttgtagaagaccacagttgggaaagcttttacaaaacttatgtatcatgagatgacatcatttgaaaaaatattttgtacttggtcccctaaattttccaaactgtcacttttttgtaactttctcatgaatctcactgggctgctcctatcttctaaaaagaatataaaatggatcctccattctctttccttaatacagcctgttgtgacttcatagtactgagtgggaacaagctggtttctttgaaagaatgatagtgctcaatcttttattgtttcgtttgtagtaacatgagtaatatataaatatgctccctgtaaaaattaaacatctcagataagagagtctcctttcaccagcatttaaaatgataagcatctccgctgtctcttcctatgatatatgcagagtttttactgtgcgtttacatgcatggaaatgcacccacagaagaaatacagaaccacttcgagtgtaagggtgtgtgtttttaataaataattcttcacataatgctttaaaacttgcctttcttagtaaaaaaagattcttggggaaaagtctgttattatatgtagacttaactcattttttaaattgctgtatgtatcccatgctgtggatatatcctagtttattgatccatctgcctactggtggatatttatattgtttctaatgttctacttataaacaatgctgcattcatttcttcatagccctgtatgagctttcttcataatagtccccctttttttggtttatctcttctggttagataatcttcttaaaatactgggaacccatgaaatgtaatagctaattttgtgcaacgaccaataatatcctgtaaattagcctcaaaattgcctgaaccatttcctttggtgaattctaaagcttcattagtacttgtgatttagtcaaataggcctggttggagctgttgggaccctgtctgtaacttttggaataagttttctttatccttctgccttcccatcctcagagcagcctttgttccctggcacaatgggagcccagcagagtaagaatgcgctttaatagactaagtccattactctctctcctactgtctaccagagttttgtccagtatatgatgggggggagactttatttgggatgacaaagaagagcgaacagatctcttctcttgggatctgttattataaccagtcatttgtgatcttataacctggaaaaatccctgaagattaataagaggtagttaagtttcagtcacagttgagtgatttacccgtaactatttcttaatagcccagcaaggagtcataagcatgatcaggattttattgataggattatttctgtggcaaggtacaattatcctggtatgaagtacaggaaaacaaaaagcctttttatttaggtctttaacaaaagagcaggcacagaatgtctagggggcgactgctgttggaatcagaagaatgcaaaaatccaagtgagggtacatacagcatttcactgtgtttttagtgttgatcttgcaaagcgaatgcttttatcaccgagttagctgcccttgatataatagagatgatttgttttggaacatagcacaagtgttacaggtttcttgcatatatcaccaacaaattctacacagtaacttcttgacataattttaacattctcgaaaagcgtgctcttttgtttaactctctcaacaacactgacccaggcaggataagcgatcctgtagattatcaagagtaggtgatttatttcatcatggtcaaaacatatacaaaatctgccttcaaacccatctgttcctagaggtagagatagatacatatttatacaaaatagagatatgtatttatacaaaaatagaagggagccatgggattttgaggtatgctgtgaaattcctactatttatcttttgtgtttgactatccgtagggctgtaagcttactcagagctcacatagatgcgtccaggtactgtaagtcaacgactgtgcttggtctctgccctgttcttgttctgtgaagtgaagaaggcctcagatgcatttggtttggtgaggctagaagcacttgtatttgctacctctgtgttacaaaaaaaaaaaaaaaaaaaaagcccgttttgtgtgtctgttccctataagaattgagttctttgcctgctctgttttcagacatcaagccttactttaatgtgtttttctaactctgtgctccccatacgtgcttgatcatcaaaatcacctgaaatactgtgagttctacgatcagacaagtttaggaaacaatcttagcctgatgcgttagatctgtctcatggagtttaattgctgacatcctgtcaaggacctaggtccatagcatgttcctgcaagcacttggtgtctggcattgctcttggcagtaaatgaattaaaactacaaaaaagttaggaggcaagcattcacttcccaaggatcctttcccaaatcaggagaggctcagtaaatgctgtgaattataggaatatttgttcattatttcaacaatgattcgagtgtacactatgtgccaggaatttgtgctcggtgttggggacacacagctgagaatgaggcattatttagaatgagctaacatttactgaagtgctcatggtgggatgaatacccagctaactgcttcatgtacctttgctggttataacttcataactgtcccatgaggtgggtagtgtcaccatcattttaaaattaagaaactgttatttcagaagtttgactgacttggccaaggtcactgatctcacaacagggagattcagagtccataccagacgtatattcctgtctctgttcatcttctgcttaacacaatctatgtgtctcctcactttcctctttctactgccatcactctgtgatagagttgcctggtaaacttttaaaaagtatccttgcctgggctttaccccaaacagatgaaagaatagttgatggggcccgggcacgagcatttttcaaaactctctgggtgatgccaatgtgtagagatggttgagaagcatttagagcattgttaattgacaccaaatacatactgttcctgccagcctcgtggtttctagcattcttcttagatcatttggctgattaaatgattaatgattccaaatcacttttcttcccttttaaacaaacagaaatctatcaaaatataacaaatactttcataatgcgaaatattcctcagtgagggacatgataaaagacccatttaactgagaatttagaaactcgaagatctattttcagggggaagtagagtcaacagtgagtgatgaggaatgacctggggtctagagcacccatgagctcctcgatctctcttttcctggtgtgactctgagatcctgagatcttttaatctgatgggaaagaaaaccttgggacagatggtagttcttgaaaatttccctcatccccggtgaacacaggtcatgtatcaacttattttttttcccaaatccaagtcaaagtaaaataaaagctaaataggagcttactaatttggatgacttagtatatgtactttatactaaagattattttgaatgctcaaagaaaaaagaatacattaaaaagtagaatagacatttgcatttcttgaggctgtttgacaactttactcaaacaatgcatgcatatatacttatataaacttttaatttaagaattctgtgtttcttgctgccaacactttgttaaacatctattatatggtcagtaatatcttgccttttaaagatagcagtctaattaatcattgactctccactaattaaatctgtttttatcttgtcttcaatcagtgggttgtgactgatccctatgacaggttcttctcaaaacatctgtatcaaatattaagagaaaatggttagttgaagtaatcacaatattgtggtctataaagtttctagaaagagaaagacaaggaaagtaaatttgggggtcactgtatttcaacaagtttgaggcacttttataagaagaaaaaaatcaaggctaccaggggagggaaaactttttaaaccattaggtctttagacagagaaagaaagaacaatgacttccatcccactctcatagtgatttaaggtgagtattatctttgcattttacatgtcagacaactgataggacagttggatcataaatttcgagtagggtcaagagtcactttatgactattactagaaaagatcattaccaaaagagtaaactaagaaaaaaaaaacaaaaaagaaaaataaaaacatgaaaaatggcctccttttttacatttccacataggtgatctccatacgaggagatgaacttgaacttggttgggcgggagacgaacctggttgggcgggagactggagcccctcagagaatttgggattcttccatttttactgggagggttggcaggtataacatgtgttgttatgtgagtccatgagagcctctggggttcttactccctgcctctccgtgtggtggagagtcagtcgcttactctgaagcactcgactgatttctgtctgtggcttatccatgaacagtggcttggaagtgtgaaagcatgagaagcatgcagtggaacagcatgcgctgccgtcatcttctacttggttctgcatgggaaagctcctgggctggctgcctctgagctcaggcatttctctctctccctacagaactccctgaaggcttcaaatcggaagaagaagagaacaagctttaaaagaaaagccagtaaaagagggatggaagtaagtgtttcagagttttattctgaggaatttccactttctttccatagtctactctgtcctatgagatctggtccaagttgatttttctgatctatcttctactactgctttctcctcactacactctaaccacaataggattctttctgttcttttaaaaaaacaaacactcaaaactaacctctgcgcttgcctggaaatgttatccccaagatgatgatgatgaagatccaagctaatatttctggaatatttggagtttacagagtaaaataaaaagcctggcttaattctctggagcaaatgataacttgagatactttcttccaagccttacatggaagtcgtgttaagagtcagccctgggaaacaaaatgtattattgggtggttttccacctcccttgccttggggttgcctttcaagccatggatgtgtatcctaacagtgctgattgcttctttcagcaggaaaacaaaggtcgtccttttgtgataaaacccatctcttctcctctcatgaaacccttgcttgtatttgtgaatcccaagagtggaggcaaccaggtgagtaatttttcatgattttcaacttagaagttttgataatttcttgacgacacaactctcactgccaattaaaatagtaccactaggatcccaagctttggaagacaccggtttctcaggaacaaggttattgtttctctgatagctttacacattacagggctgggcaaaacctagatgttctataatttatctgtctgcttccatataagactataacaaaggcacttaagaaacctaactactgactttttccttacagattttcaagaaaggatattctagaatttctcttagttcgtatgtttcaggattcctcaattcttatagttaggaggcccttcatcaacttctttttatttctttctattgcaatttagatacaaccactttcatccctatcctcagagaagaaaaaaggatgattcatgagccatgataatccctaccaaataccaccaacattatagaaaatatcaacttcttaaggtttcacttggtcctagcccaaatccaatagtacagatacttatctcatttgagaataaagaaattgacttagaaaagttaagtctaaaggcatgcctaaagtgacactggtctataaaggacagaatttgttcttgaatcctggtctttgtctcttcatccgattatcttcccactctctgaggcttcttatcaatactcttctatgggctttaattttctgttattttcttctgagtttggatgagaaaatattttctttatccacgaagtatatattttacattttgagacaagattccttcaagttttacaataaacaactggagatttgaaaccctttagtcatcccatataaggaaggtaagttgtataaataggattgacccactggtccaagatgatgttcttattactaaagacaatgggcattgtccagaatgtattaattacaataaaacttctcttatgggagcttatgatttaaatgaaatattattcttcctttcatctctgccttcaaaattctcaaaaacttgatatggtaaaaatgtgtattaacattttggagaacaaggaaaagaaatttgtgtaagcaaagaaaccatttgttttcaagtcctgcatttttgagttgctgagagatctttatggagtaatgatggcaattctaagacatcattagaggaggacctagacatgggtttccttgaaatgaggtttaattttccctgaacaatacccactctcttgggctagtatccctatgttctatcaaaggttagagatgcagttgggaaccctgaaacatggaaatgtaattagttccatgattttggccacctgagcaccacatatcaattagtttcaaatatattttgtcatgacagtccacatataagatgcatttattaaatcattataagctctctttcctagggcgcacagaggctagtaagttatctatttctttaaggagctgatgatccagttaagacatagcctgttcctattccagtctatgtgtaaattattaatgacggggacttcagagattatctaatattgcttcctatttcactaaatagaaaagggaggtcaaggaagcttaaaatgaattttctaaagacatcttgtaaatgacacaaaaggaacaaatggaaaataatttaagcaacattaactgcatgtgacttctaaattgagtggctcagactgcagtgctatgatatttcagaggtaagcagtgacttgggagtgataaggaaatggtgtcatggacatggctgaaatcaaagatgggtactacttagttatgcagaggagagaagactggaaggtctgtccttttcctgctctttactgtggcagattcctgttcagcaaattcttgttcatccttcgaggctcagtggtgcctttctgaaccatttctcgagatcaatcatcctgtccactatgccccgatagcccttggtacacacttgcatgatatgaacagtaacataactgctctatgtgcgtcttcactgttggggtacaggtccaccattgaatctgtgatttctagaacacggcacatagttaaataattgtataataggattagaagaacagatgtcatgatgccgattattcattttgaggacaatatgatgagtggtgcatgcatattaagttattggaaatgtgattaaagattagaatgatcctatggaatcacgtcttcaagaaacaggatacttcaggttgaagactttggatttatgcaatggaaactagtttttttgctgtttaaaatattttagtttaaaaaatcttttggcttttgaacagaggaataatatggtggaatttaatgtgcgtatgattcagatgggaattgtgctaaaatgcagattctgcttcagtaagtcggggtgggccctaagatgctgcattcgtaataagctcgcaggtgctgagactgctgctcagagaaccatactatggttagcaggggcttactgtgataaatagaaaaatagatactttttgttaaatcttgagttttgccttttaataatttacttattccactcacctgcttttagatataaaggattcctatctccttctgtctttgaaacttaggctttagactttttttttctttttttttaaaaaatttttaacttgcttagtcttctaagtaaattactggacaatattgccacctactggcaagaaaaatagctttttctctttatataatattttacttgtgtaagaaaaacattttgaaggaatgtattgggatgaaccgtgtaaggactgcttctatgtctctcttttaagaaatcccatattttaaaactctttaattttttttctaaattgatacattctttttgtacatacttatggagtacatatgctattttgatacatttatggcatgtataatgagcaagttagtgtatttagcacatctatcacctcaaacatttatcatttctttgtgtttgaaatatgtcaaatcttctagctattttgaaatgtgcaatatactgttgttaagtatagtcaccccactgtgcaaacactagaacctatttcttctatgtaattgtatgtttttactcactgtccaacgtctggtcatcccccacacccaccacacccttcccagtctttggtaactatcattctactctctacctctgtcagatccactttcttagctctactacatatgagtgagaacatgtcaatttttgtctttctgtgccaggtttatttcacttaacataatgacctccagttctatctttgttgctgcaaatgacaggatttcattcttttttatggtcaaatagtattttattatgtatatataccacagtttctttatccattcttccactgatgaacacctaggttgttaaatctcttcttttaaacttagcagtaattgtctctttgtttttccaacactcttaaggtagcgatgacactgggtgttttgcaaagctgtagagcttggtagcactgctgctattattttattgggatttgacttatttgaggaatcagggaccaaaatttcaactttttttattttattttatttattttattttattttattttattttattttattttattttattttatatttttgagacggagtcttgctctgtcacccaggctggagtgcagtgacacgatctcagctcactgcaacctccacctcccaggttcaagcaattctcttggctcagcctcccaagtagctgggattacaggcatgtgtcaccacaccaggctaatttctgtatttttagtagagacggggtttcactatgttggccaggctggtctggaatgcctgacctcaggtgatctgcccgccttggcctcccaaagtgctgggattatagcactgtgcccagccaaaaatttcaactttgaatacctccttcggtggaaagagatagtaagtgtaacataaagtttactccagtgcaatcccctcctatgtgtggaaactttcgagtactagagaaatacgtcccctcccttacacttctgtttgccttaatgtcaaaacttagatttttctttgaggtcctggactcattagcatctttctgagttttatagaatcctgtgatatctctcagtgtttcctgctttcacactgtctctccctcacgttctctcatgactttctcttccagtgacctagactttaacttcagggtaaagcaatgttctgacctctaggatgattctatctgatcatccctgagagccaagggatccagaccctggctttgcacactgttcgatgtggaatcctggggtagaagtatggcaggagttggatccttggattacaggtcccagggtctttatcagtagggtgatcgaggaagaggtgtccagtctgtggacagacacatggcagctgagtttacaccaccatctgggaatcggctttctcagactagggccacccctcctaagtcaggggccagtcacatcaaggtggggagaaggggaagacagaaagagtaaataacttcagatgagaaatttgagtcccaaaactgtttctaaataattggacaagcaactttaatgaagtagttacttttttgcagtactggaaacttctcaacctagtgataattcaaggatcattatgtttagataaaagtgcaggctccctaaggtttagagtaggcagggaagagggcagagggaagtcagtagacgaggacacttgtcaaaatgcagcctcaacatcttcttgtccagctagcctcaacagatggaattaaaacaaccaaatgatgaacctatggaaagtcctatttctgaaatcatagtattggtgggaggattgggcagctaagacccaaactagctcctgtgataggtctggttccttagtctgtagccagagcgatgcataaaaaatgtcagtctgggagaaaaaaaagctggtctgaatctcttaatgaagacttttcagtgactccttgttttctataaattaaagcctaagcctctcagcatacattatttaaaccacagctcacttcagctgtctcctctctcgcaactccctgtctcatggttcagaaaagtgaacagaatgtagctttttcatgggatgtcttgctgtttcacaccttttgtgcctttaccctgaaggttcttcatctattcgaggtggaaagaaatagttaagtctactcatttttcaagacacatttcagatattttacttacaacgccttctaatctctcaacttgggcttaagagtgtttcctctgggcactcatcctccttagcagacgtctgtatcagagaagttcccatctttggtgaattaatttattttgtattgctctccttccagtaagttctgagatcccgacggtacacatggacagagtaggggcctaatacgtatttatcaaataaatgaggcattctatttggattgtttgaagcagtttgaaataataatttcttaagcccttcctctcattaatgtatttttctcaggcctttcttattgtctgggcagttgttctttctataatctagataatgcctgcatgatataaaccaagacttagtaacatagcagagtttcaacctacactagagttatggtgctttgatgaagattgatgagctatttgaaccgacccgttcttgattgcttctccacacccccaacaattgtcattatgttttcctttatgaataatgcatggaacttccttctgagaacaagatcatctctgtcttgttcatctctgtattctcctacctaaaactgtgcctgtcacatagtaggtgaatgaatgaatcttgttcaatccagtcactttttgggaatttgtattctcctgttgcactccctccctagtacttgctgcttggaagaataatgttcttttactccttaggaatacccattcttataatatctaaaaaagttctgtggccagtgaggtatatctacagtagcatgcatggattgggattggcatataagctgtttttttttttcatttagagaaaattagactcttgcacaaaagttgcagtttttatgtttggcattatagcatgtgataactatgagagtgctggagagttgttagtaagtgacagatgtctaaatgagcagatttaatcctactattgaggaagaaatgaattacccttctcctggtgaattaatatttgtcaaaccattcagttacatttaataaattatctctattaaagctttaaagttacttaacccagaggtaacagcagagttaatagaattcatttaagtgtgtgagttagatctttgtttctccacacactaggtggagcattttttcaacgctttcttttagatacttacatttttggtaataaataccatattttgaaaagaagattactttttaaaagatgtaatcatatcatgcctgaatgtcaatttcaacagggtagccatgcctggctatgcaagttatctttacacaattgcaggcatgttattccaatagactgcaatagaaatgtcacctctgtggccactcggaccttttagagaaattcaagtttaaggaaaacaacctctcaatgctttttatttttattttttggaagatgttagttacctattaatatttgcataatggagaggctgaagctgagctgtgcactctactatagcacaggtggaaaggagtaattaacatcaacaattcaaactactctaggaatctaaaactgaacaaagaactttctagcaagtcagttggaaatgttttataaattagttggtcattaaaataactcctgtgttacctattaaacataaaagattattcgagataatcccaaacacacttcatagcaaggctcagcgtgagaagagggaaaatgatctagtatttagtgtgtatacagatctaagtctatgtttgaatttgataggaagcacaatatgtcatttggtgaaactcaaggattcgttgtaattattagatagaacgtgattcctaaaattatagcaagcacatgataaggcagaacttttaaattataggtttggctggtacatgcaacaaaagacctgcattggcctatgtaacaacaggagtaacaatgtgataattataagctatactttagagctcacattctcaagtgtaatttaatgagtagattaactggctgcaaaaaagaaaaggattaacggtaacaaaggtctgttttgtgccgcatactgtgctagatacgtgactgttagtgattcacttaattctcatactcaccctggaaggtggacatcctttctattttatatactgcatttctgcaaggttataaatgctcatgattactcagaacactgaagttagtttgacctcaaatctcatactatgtccagtatactgggatgactcttaaatgcagcttattagatatacaaacctaggcatattttaagaaagagcaattacgatatctactaaaacaacaatattatgagcaacaaactcggctcaactggtcaaatattatttgctatgggtgataaaatggggcatcctactgatttttaaagctcttttggtattgcttgataaaaagatccttcttgcatttctttttcttttttttttttgagacagagtctcgctctttcacccaggccgaagtgtagtggcgctatttcggctcactgcaagctccgcctcctgggttcatgcccttctcctgcctcagcctcccgagtagctgggactacaggtgcccgccaccgtgcccggctaattttttgtgtttttagtagagacggggtttcactgtgttcgccaggatggtctcaatctcctgaccttgtgatctgcccgcctcggcctcccaaggtgctgggattacaggcatgagccaccgtgcccggccccttcttgcatttcttgtttgctcaatccaatttaaaaatgatctctaaagtgaccttatgtctgctgtaatgatgatctctataaatgtcacagttacttaaaatgccccaaaaatgttcacgtgacagagaagtgtttggcttaaacaaaccagtataggcatggagattgaaaatgtcaaagtaagctgtgatcttactaaggaagttttatatatgtataaaataactgggagcctgggatacttttgcttcagttagaaaaaactatttctataaaattatattaatacttagctaatactgcccatattttatattatacagacaataatctgtacaataaagtgaaaattaatgtcaaattacataggctgactaataacttttctatatggattttcatacattaatgatagtaaaataaatattattcattaagggcttactgcattttaaacactgtgatgtacttctcaaaaattatggcttttaatccttgcaacaagtctgcaaactgggtattcttgtctctgtgttaaagaaaaggagggctgagctaaatgaaatgaagaaacttgcccagagttacacaggttagataaacatctaaactgacattcaacctatggctatccatgaccaaagcccgtgattttaactactcttctatactgcttataattagatattattttatttatttattcatcattcattcactcacttattattttttgagacagggtttcactcctgtcactcaggctggagtgcaatggtgtgatctcggctcactgcacactccgcctcctcagctgggactaaagacatgtgtcaccacacctggctgatgtttgtattttttgtagagacgggattttgtcatgttgcctaggctggtctcaaactcctgggctcaagtgatccacctgcgtcagccttccaaggtgctgggattacaggcgtgtgccaccgtgccctgtgtattattttaaataaaagtatttattttttaaatgagcagttattcttgggaaatttcttcctattattgcctttttgtgtatttattttttacagggaaccaaagtcctgcagatgttcatgtggtacctgaatccacggcaagtctttgatctttctcaggaagggccaaaagatgcgtaagtctggaaatattctccatggtccatatgtattttaggcaagtgagaattttctgcttcattatctgattaccttgtgaggtatatcctgaccatctgtcatctaccttctcacctgtactctccttcctttaaaacttcatccaaagttctctcctactctttattggcttagttcccttcgaaacatatcttctcagctattaactcaggatacgtctagtgtgtttgttacttacgtatgtgtaactgtaggttattctctgcaaatctgtgaattgagaaaggactcattgtttttctatttcttcatgtacaactttggagatgcacattaatggaatgtaaatgtatgtctgtggagggtggagccatgtttgtttatgaatatttgaactgaaaagagagagtgtgtgtgtgtgtgtgcgcgcgcttgtgtgtgagagagagagaatcaattgattatacctgaggactctgcacaaatgtggggaagacatattaattcctgctcaatcccgtttctgagcttctcagaaatctcattctctgcttttgttagaagtgtttaaaataaagtctagattgtaggtgacccatatcctgcttctctcctttggtggagaggcacacagtggaaaagaccaaggacacttctgctgttctctggttctccgttttaaattcatgtactaggatagttcagatgttatctgataaatgttagaacacaagggtaccacttattttttaataagtaacaatatcagaggaaaaggtgatttctagagaaatagtattcttgtataaaatggataaattacttattttaagcatgcagattaggaaatatgaaaattaatttgttattttcttaacgtatgaatttcttcaccagttgagtttgctgcaagattcttcctctctctgtcccataatacatatatatatatttatttatttttattttctgtacttgattatgctaaggcaaatctgctatcctgggatgtgccattttaggagcttatttttcttaagattttatcactttagttagaccctagagagacacttcagaggtcaccgtaaagaacatggtaggacaggaaatattttcagaaaaaaaccatattttgtgatttaaataggtgatattttctagattacagcctctagcaacttcacctaagcaaaagatttagcaggggcagtgtcaatgcattttcctgagatccaagaggaaagacaaaattatcttatttcaagcagagaagtttgaaataaataaaaatcagtcaatcttcccactttgggttggaggtgtaagtggtgtgtaactgagctgagagaaagactagatggaattgtagatgtgatacctgtgttcacatctgagagtgcggaagcctccccgtctcgctgaaaaagatttcttaggattaagagtagaaagtataagttagaagaagtaaatacatccagggaaaactaataaatataaagaggggatatataaggactactgattatcaattaatgatgattttcttggggaaaggggaagaggaaatgatgggaaaagaaaaagaaggaagtcaaaactaacgaggaaaataatgttgacatataatagaagttatgggaaataaaactaggacatcctaaaatcccttaaattccaacgttgaattattcattcaaaaataatgtctgatgcctacacctgttccactggtgggagtcattcttcctgtggttacttgggacctatgatagcattgtcatcctcatgattacacattttctccagcggacaccacccctacctacccatgttgtcctctgctttctctctgctctagccagtgaaatgttcttttgtttactttttcttctatttcctctacaggcttgaattgtataggaaagtaccaaatctgcgaattctggcctgtggtggggatggaacggtaggtccctgagagagaatccagttctctgccaattctatctttcttattgttttcttgtggcacttctttttattcgttgctcagtctttctaatcccctaacacatgtatatctctcatgtgaatcatagcccctaagagtaacaagggactttgttattgtccttatgaatacatacttgatccttctaatgtgtgcttcactccttcaactatgctgtattcttttgtgtgccatgaagtagggatgtggtcaaatccttaaaatgaagattatagatagataaattccttttaaaatataagctgaactgtttccatttattcttaataatttggccacagtagggagaaatacgtggacacaattgaattattatgtttttttttttactagtgggaataaaactcagaatattgagtgttgttttgccttaaagattattaattggtcctatttatgttcttttttgttgacatactttacctgtatatggggtatgtgtgatattttgttatatgcatagaatgtataatgatcaagtcaaggtttggaggtatccattacctaggctatcatttctatgtgttgggaacatttcaagttctcttttctagctactttgaaatatataatacattgttgctaactgtactcaccctactctgccattgaacattagaacttattccttctgactgtatgtttgtattcatttatgaaaaaaaggtggaattgggctgaaggttaatatcatggatatattttctcctgtttattatgcctcatcggttttctccatttggcctctacttatggtgatatatttaacaaagtaaagaattgagaatcatgacatttagattgtgttgtctggttctttttcttccggatttggaatctgatctcataggatctacgaatgtattatgaactatctttagcttttctctaatttccctaattagaatgttttattctcaaaggtagcaacaaaatcttcgaatactatctctcttagcacataagcacttaatgtagggttggatacacattatataccaataaatgcaatgagaatgaaatagaactgtgatttttattggtctctcagatactgtgtggagagtaaaaacaatgttcagttgggaaaaatagtctttatctttcttcaaggttcatattacacattattagtttataaaattcattataatgtcttacagcaaagaagccaaacctatttaacttttttaaacccaacgtttttcaaaattatttggccatggaatttttttcccccacacaataccaatttcaattgattttagtgttctagggagatcaatttaagggatatggtagggcaaaatttcccaactttctttagtaagaattacatccaaatgaaccctctgaggatggatatactgtgttcttcctaactcaagcatcccccagcttagttatctttaatgaaagggtaaactcactgtgactctttaccatacccatagttatcttccttattttagcatctacttgccttctcatatgacttcagcatctcactcacatcttttctccttttctaaacctcagtgacaaaaacagataagttgaggatgtcgtccttcctctttcttaactcaaatccacataagctatgcataacatccccagatcttggacttctttgttgccttgggtgctccacctcccaggcctccctttctccatggaaactcccattccacctctccctccctcattctctctcctttcttcttccttttcttttctttctttcttttttttttttttttttttttttttttttttgagacggagtctcactctgttgcccaggctggagtgcagtggcacaatctcagctcactgcaacctctgcctcccaggttcaagtgattctcttgcctcagcctcccgagtagttgggactacaggcacgtgccaccacagcgggctaatttttgtatttttagtagagacgatgtttcaccgtgttagccaggatggtctcgatctcctgacctcgtgatccacctgcctcggcctcccaaagtgctgggattacaggtgtgaaccaccctgcctgcccgttttccttctttactcagcagatatgtggaggaagcactgtgctaggtcatgtagtattgagatattctctgcaattagatgaatatttgaaagtatgggattccaatgaataaaagataaagaggaaagagagccaagtccacacacttgtgaaatgtataattatgggtccggagccaaagtccaaaaggaaaataaatgaaaaaatagaagaataggacagccaccagtctgttctgtcaagtaaacaaaccaaaaaaggagtttcaagaaagaggcagtagttacatttttaaggagagactgaaaagttaccattgaatatggaatttcaagaaagcagtttcaatagagtatgtggggcaaaacccagaatgatgagtaagtgaaagttggtacaatcttaataaattcctaatggccagatccgattacagtttcgaatgtctgtgatctctctgatgccattgtcagcctcctgacatgtagactacctacttctcctatttttcatatccagtcttttcaagcaactcttcattaatgatagcataactatgagtattccataagggtaactaatttttttaatgtggtaggtaccttttcctcttagggacattatctatattttaacatctgtttttacctcctctgatgtaattcacaaatgtactagtcatttacacttgggtgccccatggccacttgcattcagcatgcctaaaataaaagtagtacgtttaccctagagttggcacatttaaactaattatttttgtcagtggtaacatctgtagttaaaatacttagaatcaaaactttgcttatcttgtaccttatgtaaacccaagttttatttaatttaccttgttaggataagatgttttgtgaaaaacatggggtatatgaaatgtttgtcatggtatgtgattgattttttttgttttgttagtttagaaaatgaaacttttaattgtgggcggaggcagagtttatatagaggaaacagcctgaggaattcatgaagaaaactgctggctttaggcaagtggagtataattctgaattcaggtatatatttgacacaaggtattcagcctttcgttagtgagcacatctgtcactgtagaagctggcagaatgctgccagtaaagtgacaaagcttagggagaaatcagaaattgaatatttttcactgactgggatgaggctatattaccccataaccgtattagtttaaattaagagtattatttaaggtatagaaagtattatttaaggtatagaaagtttgcattactttggaaaaaagttcttaggcttcaatattagctactttaattgtatattatttaaaaaatacatgaaaggccaggtgtggtggctcacgcctataatcccagcactttgggaggccgaggtgagcacatcacttgaggtcaggagtttgagatcagcttggccaatctgatgaaacaccatctctattaaaaatataaaaattagtcgggcatggtggtgcacacctgtaatcccagctacttgggaggttgaggcaggagaatcacttgaacccagaaggtggaggtggcagtgagctgagattgtgctactgcactccagcctgggtgacacagtgagactctgtctcaagaaagaaaaaaatatgagaaagcagagggaaacattccccaataatgcacttggaagtggaggtgaaagaggtggttctgctctcatttctgtgacctttggcaggttccttaacctcttttgagaccttctgaatctacaaagaaatgcattcagatctctaaggttcttatagctgtagcattataataatataggctattgttcaagggaactttaatgcaagccacatttgtacaattttgaattttctagaaggtacttttaaaaaggtaaaaagcaggtgaaattagtttataatatattttatttatctaaaatagtatcatttcaatatgtgttaatttataaacattgttaagatattttatgttctatttgtacagtcttcaaaatctagcatatattttatacttacagcacatccaatttggattagctatattcgagtgctggatcaccacatgtggccaatggctgctgcgttggacagtgcaggtgtagtctctttgttactggcttgcacagttcagaggctgtcacatagttacagctgtcagatggtctgatcccattttcagatctcttggctgcaataaattcagctcactcaagaatgatctcaaaccttcatgtttataaatgagaaatagcctgtctttggtcatgtgataaatttgtattttctcacttccttggccacgttgacacctattcaactcctaatggctgtcaccctgctgaaatattgacgagcacatgaactgatctcctgaggctcacgtactctcattatggttccttaaggtgtgtgacccatggtccctatctatctggctcctgactttggtgaacttggctggatctgcaagtccacctttaaccattttaattatttccaaaaggcctgacattaaattgactccagccatccacttcatgcttatttcttgttctattggcttttctagatgaaaaagcatcccaaatggtagacatccccatgccctgactcaccacagccaatgcaaagaaggaagtattattttcctttaattgatagggacaatccctcatcctaagcccctttcctcattcatcctcagcctagttatatttcatcctctctcactgagtaagcacacagtgtaccttcagtgtggattctatattgtttcaagaaaaggtcatattctgatttttatcttgatttcttttgggctaattttaagcacatttcttttaacacatgttggctttattaagtgcaaacatacattaaaatatcaaaaggaagaattattgtgcacatattcaaaagggtcccccagtcatccaatactgtgtggtcattttctttcagagctcagcaaaactcttgttttcctttgatttccaaacgtgagtgtccttcgctttttggcctgcatgtactacaaggcagcgcaacgtgcatctgttctcttggaagaaaatatcagtttgctgtcatctccacccttcagccaccccttatgttagtatactgcagaatgaaaatattgctcaaaatgcacttggtaaacattcagtgacaactaatgctaaaaacggacagatggtggcagcattgaccagctgctgctgtgcatggctgctcagggacaaagcggaggacctggtgttctcaatctgtcagccctgcttttcctaggaaggaaggaaagaactttgcaagctggaaaatcattaggcccaatcaggataactttcttcagttctggtggaaaatataccaagtgcaataagttgcagttaattaaataatttaattgaaagggtgctaggtgagctggtggagatgatttgggaaaatacgaaagccgtggcagagttcctgcccatagaacctttcaatgtgcagtctggacttcaggtggaaacgggttccggattactgtaaagacagagcttccagtaacagctttaagatcttttgtaaagtttttctctaaggacaaagacacagattgtttcccaagatttttaatgtctcctgctattgtaagtgtgtatttgtttccattttgttttttatagccccttttttactgcagggaacctctgcttttactgttctttacagtctgcaaaagaaacgctttctgatttgatggcagctgaaggtggggctgatttgcaaactcagggctcaactttaagtggagaaatgggaagagggcatttttcttctaggaaactgggcctttattgaggaaggttggaaagaggtagcaaaatctagctgagtcatagtagctaatgttagtttagcatttcctgtttgtcaggcactagctaagcaatgtctacacatgagttgatgaaacaactctaaaagtcaggcattattattactcttgctgtacagatgtgaggggagcttagagagattaaatgacttgcctaaactcacccagccaatttgtggtggagctgagctccctgccgctcagctcggtgccccacacttctgcgctgtgctgtcttccgggaatgctggctgttggggaatgctgatagagctgctggctgaaaaaaactattcaggagctgtggaggggcgatatagacccacctcagccagagaactattagcctaatattggttgtctgtgggagaatttcaagacaaaacaaaatctgtgctgtgaaaggcaggaggcctttgatgactccaagggtgatggaatgatgaaatgcaagattttctgcttatattcaggagacaatgacatatttgatcatttggctacagaaaaaaggagaaagaatctatttatccggttcataaagcaaattgattgatgagaggcgaagcacctttacattcacacactgtgtacttgtccttttctgcatagaccaagggtaaaaggagaagagatggtgagaaatccaggcaccctgtgggctctgcctttgtgaggaatcgtagctcagtatcacgagaactcctgacaaccttctctgagaaaacaattaggaacacagcctagaagatttgaatgagggctgttagaagacgcagcatcagctggatgcagtggctcatgcctgtaatcccagcactttggcgggcggatcactttgagctcaggagtttgggggcagcctgggcaatacggcaaaagccgcccccatctctacaaaaaatgcaaaaattagcctggtgtggtgacttgcacctgtggtcccagctgctcgcgtggcggaggctggagaatcgcttgagcccacgaggtagacgcttcagtgagctgagattgcaccactccagactggacaacagagtgaaactctgtctcaaaaaagacaaaaaaaacaacaacacagcatcgattcatagaagttgtgggatacgtcacgtacttcagagtcatttggaaattgtttgtgttccatgggcagtgaattaaccccctaacgttccatctgttttagtattagcattcctcctgcactgtggaattgtttcttctttgcaagctcatcttcacaggaagttgttttatttaatttttacttttctatctctgaatccctttggtttctagtaatattgaattgttttcaggactttcagatgagagctgggtttttctatagattcctatggctccaccctggggagatggcaggggtatgtcactgggcttttgggaagtcgggttgagcacttaccagagtgaggctttctgggcttctttcagccatagtacgtcccacctttctgtgggccatgacctcagactggttttcacattccttcctcctctcttcctccctgctatgaaagagccgtgctccaggacagcttgctgtcagtagggcacacacttttatttctccattatcaggcaagccaaaatcccagcttcctctgctatttgcaagaccaggagccaagctgatccaagcctttaccccagctctgccactttgtattttttttctggcccattgaagctgcgtcttttttttttttctttctttttttcttttctatcattgttgtgtctgagtgaaatgggatattgaaagtgtaaactcatagcattttctttacccagaaaagagagacatatttcaagtgagcataagaaaaatgtctaatttaaatctgcctgaaagaaaacgggctgacttgggagcacaaatcataaaggagaggttgaatgattgtctcttagagaagttttaaggagaatgccttcttccttctttggaaggggtggtgaattagatttctactgagttctctggtgggtctgtgagtctggctctattcagggctgttgtttctgcagttggtgatcccagatgggtgggctttttctgagtatttatgtcctttttatggcctttaagaccccttcttgcagtttattagaactatctacttttactgtgtttaatctgtgcttttagcagtgcagaaacaatgtcaagcacaaacatcagaactaatttagcatcaggcatttttatttggacttcagtagccagctttgttggtattgcacgtaaaagaagagactaaagaagctctgggtcagaatctaaggatctgtctgggagtaagttccccagtttagggaagtggacagactttttgacatttataggtctggatttttagttaccacattgggtgaaccatgtggtctgcctttttagaagatgaacacaattttagacataattggtagacgagcaagttttacatcctggtaagtcacctttgtggaggagaaagaattttagttggaagtcaggagaaccaacgttaccatgactctgacacttctaatcatttggtcttgagaaaattccatggtttttttgcacctcagtttatcaatctgcaagttcactgaatttgattaagcaatgtttaaggtttcttcatctccacaggttccaaaaatcacatgccactgcttccaggagggtctggccatatccagaagggggttgagttctttatttaagggttccctataccttagcagttaaggggttggccactggcattaggcattcctatttttgaatgccatctatatcgtgtaaactgtgtgatactaaggaggtcacttacctttccaattctctgtttccttatctataagatggaaatgaaaattacattaatatctgtcttacagataatgttttaaagtttaatacaataattcattaaaggactttgctcaggcatggcacatagaaaggcatcggtatgggcctggcacggtggctcacgcctgtaatcccagcactttgggaggccgaggtgggcagatcacaaggtcaggagattgagaccatcctggctaacacggtgaaaccccgtctctactaaaaatacaaaaaattcgcccggcgtggtggcatacgcctgtagtcccggctacttgggaggctgaggcaggagaatggcgtgaacccaggaggtggagcttgcagtgagcggagatcttgccgctgcactccagcctggacgaccgattgagactccatctcaaaaaaaaaaaaaaaaaaagcatcggtatgtccatctttgtgttactgtgaactcctggagagcaatctttctaccttatctgtcacagcctagctcatttatctctttattttgattgcttagttctgggttttatatgaagtagtgttcaataaacaaatgatctagtatttttgagaaacatgactcgtacaaatatagaatgaatacatgtcaaaaaatttgcttagctctttaatgagggagcctgcaagatagtaaagctgatttatcagaactagagaaaaagaattatgtacttcgtatcaaaataatttttctaaatttgatgcaaaactgatcaacgtcctatgagagaataaaactataaactttaaagcaatcatctcttcttgacatttgtgtctctataggacagaaatctatgttaacctacagttacacaattcttaggcctgcgaaacactattttagtatgacattataaggacattcaaactcctttttgccatttcaaattttggtcaatttttctaattagttataagactaaacccaaagtattatttatcttagaaaaagattaaacagggatatgattctagtatataagtatcaatttcctgcctaaacttataataggtactaggtctgtccataattatgttttcataatgtttcattaaggaaaatagagggatattcaggaaaacactatcaatttccaagatgatactatagagggcaaccatttaataagtacttatatgggccatgtaccatgttaagtgctttatgtacattttagtttaattagtaaacaatcgtgtgaggtacgtattattatccccattttgaaaatcaagtaaatgagtctcagtgaggttaaataatttagtcaaggttatgcagccagcatgagtcagaattgaaattcagtcttattctgagttttatattccctcctatgccctgttatactaccaaagtcttaaactctgagaaatttacaagggtgtttctagttaaacgcacgcatgaatgggtttagttttgcttgtgtgatagaacatgtgcaaaatggtcctttttcctttaaccattttgtaactgcctgtgataagcgacctttctgttccctactcactgaatgaaaacatacatgttttaaagaaaaataaaaccattctgtttagctcttggaagcctctgtttctcaaactgttttctttgtaacttatttatctttcttatatctcttctggcccccgatacgcctgtaggtgggctggatcctttccatcctggatgaactgcagctgagccctcagcctcctgtgggggtccttcctctggggactgggaatgacctggctcgaactctcaactggggaggggtaagaactgctctcggggactgcccatatcatcaaacaacaaaccggattccagatccactgatgttctaatggaagaggggggtactgctgctgctgtcccaggcataagttagagttgagaatcaaagtgcccttgagcccttatttgatctggtagcttcttcagtttaaacttaaaatcagctagaagggaaaggaaagcttggtatgagagaaatatagtggttagtacacaggcctgcggctttttgaggtatccactaaaagacagtgggtgagtttggcctcaagtctgcgtgcaaaaggatcatacagacttcagttaatccagactctcagccccagctaggatagcacatctggttcaactttacacaccttacttgggagagttatgactttttttttttagcattttattttgttttgttttgattagtgtcatcagagctttggctgtataggtacttacctgtcctttccacaatgaagccaacttcaggcaagcttgggggaaatcgttctgcagtcactaaacagccatttatttacttacgtatgttatagtactaagatagtaagaaggcgcaatatatatacacacactgtgtatatatacatatgcatacacatatacagccccaccaactttttttttttcttttttgagatgcagtcttgttgtgtcgccaggctaaagtgcagtggtacgatctcagctcagtgcaacctctgcctcccaggttcaagcaattctcctgcctcaaccttctgagtagctgggattacaggtgcccgccaccctgtgcagctaattttttttgtatgtttattagagacagggtttcgccatgttggccaggctggtctcaaactcctgacctcgtgatccaccagcctcagcctcccaaagtgctgggattacaggcttgagttactgcacctggtccccaccaactttttatctgctcatatgagagcattacatgggctgggctctgtgaaaattatattcagatatttagtagatgctagttgacctttgggcaaattaaccttccacaggtctttttttaaagtaggcagtgtagaaataaaaaacgtatttacatggggcaactaaggttatcatcagtgttaacttctcccttccaaatcagagccttgcatatcctattgaggacagtctatcgtgctgtcagtaatggatcttcaaggattaagtagctccctaacagggccattcctcagtgagacttgcttcaggtcacgggaagaatggtgtcttccaaggaggtcagggagaggtgattgagagggagtgttaatagataagcattgtcaatccaatccctccttgattctttccctgcctctccaaacacatttgttttgtgtttcccccaaattcctccagtgagagccatggggagtcctgttttttactctgataacaaagtagccatccagcctccagtatgacccttaatgtgtaccggtgactattggttcttgctgctgacaaaaaatattcctcagctcaaaccagccagaactagtgtttctatgtatcttacttatagtattgtctcaaattctaagtacctcaaggtaaaaaatttgctcttcaaaccttgctaattataaaataaacaatataacggcttggctcttccttgcgtaaaatagcattggcttcactgttctccactctggacagcaatggatatgttctctgattcctcagggctacactgatgaacctgtttctaagatcctgtgtcaagtggaagatgggacagttgtacagctagatcgctggaacctccatgtggaaagaaaccccgacttgcctccagaagaacttgaagatggcgtatgtaaggttagagagttttttgttctgcagaaaggagccctggagcatctgcctgagctacaggaaaaaaaatcctggctggagagtcatgtgctgatgaattcctatgagataatgtgataatatttgagttgatggctactggggctatgtgtataatattaccacctaatgattctgccccatagacctctaaatacctagattccgtacctgcttccaaagctcagggagctcttctctgtcttcaacttctgcactagaaaggcatgtattttgtcttaatcattcatgttaatagcaaataacctatgagaagatgaaaaaatatgtatatttgtaagcattgggcacttgttctttcagtagaaatataacctcctgagatttctggcctgatataaaatatatcttacgttgaagaggtattaactatgccagtgttaccacttgggtgggacttgaagatacctcaataaatgttttgacttcatgttatttaaaaaaaaattgacttttattttagattcaaactgcatatgtgcaagtttgtttcatggatatattatatgatgctgaggtttggggtatgattgatcccatcacccagatagtgagcatgttaaccaacaggttttcaatccttgcccctctccttccctctctactctagtggtccccagtatctattgttgtcatctttatgtccagactttatgttttcttttagtgattgagcttttatttcaaccgaaaagcaaaccaagggatatatgaatagttgtaattagtactgtgagccttcagttggtcctttggttctaaattatggcctcaatttcagataaatttggtaggtttctgagtagccacttccctcatattactttccattttccttctatgattgaatttttaaactctgtatgtgtaagaatctccaggtgtgtttgttaaaatgcagattacaaggcccagtcaccagagattctgattaagtaaatgcaagttaaggcccagacatctgtactttaaatggtatcccaattatagtgaaccatgccatttattgaggctaagattttgtgggtatttccatcttataatagattaagccccatatcattttagatttagatcaaaccaacacccatttattagcatcgtgatcctgatcaatttaattacatatattataatttaatagattttcaagtttctaacttggctaaattagattaaaacatgttttactctgtctttatggttttttcacctaaaccatgatcctgaaattctagtagatttctagtagatatcatgattgctcagctgaattcaagtttataatgtcacaatgttgtttaaacaacaagtgtcatcttgagatacgaagcttttttttaatgtgtttgacttatagaaattggatagaaaacagctaaagtataaagaagagtaccatatggatattgtaagtttcttttcctactaaacttggaatagttagacgtgcaatagaaatccatatttaattctctttccaacagcttaagaaatggaaagacttcttggtgtagccagggaacaccaatccagataattaaagggtttatttaaaatgggtttttaaagagatgtatgggaaactggggcaagttttcctggaaaatataaataacttaaaaacagactaaattgggatatgatttaggtgatggtgaccagatgttctccttagctatcagtagatgttaagacatgggttagaattgtggccaaaagaacataaatggtagaggaggtgaacatgtctgtgcttttggcaggatcaccaacccatgctgtcattactaagaactggtattttgtttaagtgcaggaactggatattctcaaataagaaggctgaagagtaagacatgattttggcattgttctatgtgtttagtttctctctcggtccttcatttagtggagaccatttctaaggctcacttggactctgaatcattacataggctttgaatcaagagcttccatgtggggtcattccttactttcattagagaccaagccaatccaattttcttttttctgcatttatatctgtcttgttccctctcttatttcacttttttcttaatgaaagaaagttctccttctagtgaaacagaaaatcttgctaatcaaggggcatatgaagcactgtaaaaaacatacttttgaaatcttgagggttaaaacacttatctctcagagaagacaggtacagttcaatttgggacacaaaccggataattagctggaaacatttctcgtctttatttactttaatatttaccttccacttgagtcgcagaaggaaaagcgggagaaccagccattcccactctcacattttccgcatgctttcttaattgttctaacatttaactgaagcttaaaatcacattagttttgcagttttaatgcaggatttgaggctgcagagttctcttcattcagcttgcagtggtaacagccagagacccaaaggactctaggaaggaaagttaaagcttccatgtgtatctgtgtggctgtgttttcagatttcatggtcataataaagatataagggttgatagattaaatgagaacttgaataatagtaataggtagttttgttgttgtttttctctctaggccagcaataaccaatgggtcacattgccctattttttatatgacttttgtaaaaaagattgtgtgtgtgtgtgtatatatatatatatatagagagagagagagagagagaaaatgggtgatggataaacaagttaaatattcattttacattacagtattggtttgctgaatataaattcttgaaaaacgcacatccactgattaagttggttagacattatctttacaactggatttactttctaggtttgcttagtgaattcttctctgtaactattgcaaatatatatccttcagcataacaagttcctattattacagcatctataaaaatgattctcatttaataatttgtatttgtgacacatttcttatactatttataattcttgagaaaattacttgattttagctttcactcatgaattaatccaataatttcctgttctttctacataagcaccctccactttgagttgtggctgatctgtctcctagggacttcttcagagataggggtccagctttaggttttattcttctctttctgcctggccacacaaaattttgcctctgtctttgtttatcattgcagctccctctgaatgttttcaataactacttcagccttggatttgatgcccatgtcacactggagttccatgaatccagaggtgaggacaacgtcccatttccatctcccagggaggaagtttctagcaggtgttttgcatgttcccttttgtttgtatatcacttacgcgtttacagtgtgcttcagtgttgtttcattttaaccttcaggatgactctgggagctagacaggacaggaacttcttataaatgggaccctgagacctagttgttcagacaaatgggaccctgagacctagttgtccagggtcttaaagacagtaaagggcaggactagatgtgtgttccaggtcttgggattgttaatctttatgttctactggaagatttgaagtgagtaaaatactaagaagtgatagagactattactgaagtcactaggatattctttagcttcacaaaacactattaaagtgcaatactacacaaccacagccattgaaatatggtagcaaaaacaaaaatgtcccctctgtttgtataaaagaaacaacaggcatcttagaacaatagaggagctataggtagtttaggttgaaagcataggatgtaatggtgatgggattaattaggaaggtactagggatccccactggatgatacagaggtgtgaatgagaccatgtagtgatttcaggtactaaaagagatggagtcaagattaggggaacagaatttttgaaagagaagatgaaataatgatatgctattaaatatttcatcaacattttctcatgccatttagaactgataaagtttatgggtttgacttatgttttgtagtcccgattgatctctctctctctctctttctgtctcattctgtctcttaaactctgttcttattaatatagctatactatatatccatgtctatgcctgtatctatatctgtacctagtgccttctgaatatatataaccagaaccatgctaggatgtagattgttaagagacttgtgagataaagtcataaatgagaagtactttacttttttccctccaggttatgtaagaaaggaagtggtgtttagaatttttgcatactttggaatttgaaataacagagcactaaaagctagaattcagattttcagattctggtaataacatgaaaattctgatcatgcacttatgcactagaagtcaagagtgatgctacaggattaaaaaccactagagtataaaatacaagtaaggaacagatctttaaagtctcttactggatccagcaatgttagcagactttgaccttcctggtttcccaaggttttgagaggacaggctctgtaaaggtcaaattctgtgccaagcaggaatgatgctgtttgaagagaaagccatagtttggtattcctctctgattggccagaaaaatcacagctagaaggcatgattgataacagaacctcaaatatcctgagtcagaaacactaccactttccgcctccctgccttagacagttcttggatattaggtattcagagggacttaccttggggccaacatttatgacctgttacccttcttatatttaaggagagttaatttgggaagtacatgggggattttattcttcatttcttaccccattttttatctcatattctttagcaggatccagatcctgggcttcttaataaaataccccaaacttcttaataatacttgtaaagtaacacaattatcacaaatacatggatttccaaaaataggcatgaaaagaggtctaaatgaataagtggccaacaatgagctcattcaatgagctcaatgagctcaagtgagtctcatatttagtctaacttatccggaagtttttctaatgattcacttccttgaactatgatgaagtttctatgcatcagagtgagaagggagcagggagagacccttacatgggaagaccaggcttagaagaaaattcttttggggaaagtgatttttctcttttattttaagctgtaggactattttagagtggaatatgcaaattgttgagtgtatgaacatgtacatttatatgtatgtgattataaaacaattagttaaagatgtcaagcattaatctttgtatagtttattgctaaggcttattgtgttttgatgcagtatgaaatggaattgtaaacatttcccctgcatgtaaatcagagcctttgaggaaaatcagccactgaagggctgttaagggagaatttatgttaattggaaataataggtaaatattcatgcaggtgggatagaggtggtaaaaaaattaaataactataagatattggaaccagattttgctgatacacttagaccagaggtatggacttttcagtagctgttattctgctttttttaaatagtaaattaaaaaattatttgtctatgaaatatataattaagcaaatagcctttttttctttctttttttttttttttactgtttctgttcatttgtattttccccctatttttaactagttagtcaagaaatcttaagctaagctatagaagaaaaaacaggataagcaagaccagatttttaattgtggcaagcttacttattttgtcagtagatagtgagtggctgttctcaaaccaagaaaactcatagtgagactttaaactgttttccaacacaggcactgtctgcggcttcatggatcacttgccataaaatacctaaagggtaacacaaaggctcatgaaagccattgtgaaaaaaataagcttggatagtagaatctatgaggtattagtcaagaaaatgtaatacttttaagttgagaattatgccaatacatctacataaaaataggcaattaatataaatctcattaaaggagaatttttaaaaatttaactatggaaagaatttttagcacagatgtaaatatagcccatcaaatggacacttctcagcataactacatatattgtatttcttttagaaggaataattaaactggcattaattcccaattttatatctactttattccaaacacaaatcaaactcaaaaacatgtttaattacatttggaagctgcatacatagcttacggaagtcatgccctatgaaagtcaaagtaaataatcgcttctccaccttcttccaccttttcctgttatctcagcccgatatccctggaaaccctccaatttttacaaagcatctagagtgcctccatctttaatgtgcttgagaatcacctggagagctcccctccacagatgtatagactccacactcaagtcattctaattcagtagatctggctagggcctaatcatttgcaattctaacaagctctcagctaatgtcagtgatgccggtttggaactacacatttatagtcctggattactgtccctgtagcactgggctactgtactaactggcctggaactgggggaaagatgataaccaaaccatgggatctattggatctgtaggataggagggagctggggaggaagtaggagtgctaatctaagtcgctacctttagtgaggtctccataacaaaactacttttcctctttcacagaagcaaatccagagaaattcaacagtcgttttcgaaataaaatgttctatgcaggggtaggtatacattttatttcataattactacatattacttattgccaattcactgtgtatcataaagttgcaaactacatgagaaataatcacatatacatctcatttatatatgtctatctatggttactgtttcatggctgggcttaagaatgaaagtgaggtgtatttcttaagttagctgtcagaaagagagttggtgttcctcatctctgagcttttaagcaagccccgaggcttcatgttgaacaagagaagatgctattcaaaaagggatgtgagaaacaaacatcaaagccagtgtaagaaatggaggaattgtgtagactgaggatgtctgaagaattttaggtaagaacgtagttttcaccagggtgcgcacattgacgtttggattagaaactggcagaatatggggtgtttttcatggacgcatacgtgaggttaaagggagtgccttctttttccttcttttgtttctcaggcacgttcatagtagtaaatagagaatgaaaaaaaggcatccaaaatatcagtacagtttaaatttatgccaatcgataggaggagtttaaataaaaggcgtttgggagctgcatacgtagtttatggaagtcaaaccctgtgaaactcagagcaaataaggaaatcttagtggaaagactgtatcagcacttaatggacaaggcaagtgttcagaaaaggttgtcaaaataaaccttccaatgaccctcagaattgtctatttttcactctcattctgtgttcttaaatttatagtgaaactgtaaattatagtttggaaacaaagagaaaaatttcaacttgacaactactgcactgctttactttggattctgcagaaagagaacatgtttagaatttttgcatactttggaatccttggaatctaggatatggaagcaaggatttggtatcaccatgtaattacgaatttcttcttctttatttccctgtggtataggcagctttttctgacttcctacagagaagttctagagatctatccaaacatgttaaagttgttgtaagtattgaatatgttgatttatttcatttgaatatgatatgactgccacaaaaaactcccaaatacttagtttatatattgaatcactggactgcatagaactttggagatcattttgtgtagttcattcaacctacacttattatgtgtcaggcactgtcttagttgctggggatgaagataaatgaaaagactagtttcgctcctgaagaaactcacagttcagttttgaagaaggtcacataagtcacttcagaacaataaaactgttattcaaccgtgtgtataatatggttgtggcacaaagggagaagtgataactctgactatggtggggtcaggaagacctttataaaaaaaaatgatgttagctgggtcttgaagcataaatcggtactctccaaacaagtatctttattccaggataatctgaggaggatatttattccaggataatctccattttagaacgaagtgttgatttcattattttgtggtgactcactctcccacctggtcaaggttcctcaccactagatggattttttgtgtatgtgctgtttcttcctgggtctctatatcaggttgcggaaatatactgcttgggggcaagggagagagaaatttatctttctcaaggtgacacattcaaaaatagaataaaattaggtattaagaaaaacattaatgtttccttatagtaaacaagttaaaagaaggaaggaacatgactttgttgcacatagtcgtataagtaaatgacagaatgagaaagagaaaaaagatatatagatggaaaagaagtgatgagaatatagcaatgtttgaatttatcaatgcttgaatttatcttattctaaagaataagaataattttgatgggccaggcgcggtggctcatgcctgtaatcctagctctttgggaggccgaggcagctggattgcctgagctcaggagttcgagagcagcctgggcaaaatggtgaaatcccatctctatcaaaatacaaaaaattaggcaggcgtggtggcatgtgcctgtagtcccagctactcgggaggctgaggcaggagattgcttgaacctgggaggcagaggttgcagtgagccgagaccgcaccactgcactccagcctgggcgacagagcaacactccgtctaaaaaaaaaaaaaagaaaaagaaaaagattaattttgacaagagagaacagaacaaaatatatacatgaaaatagagaaaaatatatgatcttaagctaatgagatatgaagaaatataaggagcatgaaaatataaaaattaaaatgtgtaatcaccagtaaagcatgtataagacatgaatctcctaaatcagttgaaacaagagacaaaggcctttaccgctgctattagcaacacttggcatccctttcagatgtttcagttctcatacaataaaaatataaagcaagtatcttttagtggtggagacgcttgagactgaaatattgccttcttaaagctagatacaagaacacagggcccattgaactatgaggattattatttcaataaaatcgtggctattaaatttaagtagcagcaaccttacattaaacttcccctgtttcttcagctgcctgcagcctagcaaaaattaaactttactgccctttccagtgtgttttgcatttacaggcgcatccacagtacctgccaggagacccagtgcatgctgggtggtggccatatagaatggcagtgtactgtgcaagtcaccggattgatatcaaactctgtaacttcctaactgctagagagttttctctctcatatctcagtccccttgatgatacatgtctcatgcatgggtgactttatagtagagtctaaaagatgcttgcagagaggccaaaatggcagcaaataactaggaaagatgtgatatcagcctatatatgtaatattaaaggtggaatgtttatataaattatatcttatgaggaggaaaaaaatcattataactaggtgtaaacatttgggatttagttaggtctacctttgctaggtatatgactttggggaaatcatttaacctttcagaggagtttgctttcttcatctgtcaaataggtgtaacaagacatgtctttgatgcaatggtttttgaccattgtgctgtgacatagagagacacaaggatacttttgcaatgacatcattctatgttttcctgagtgtgagatgaaaaggatggaaggttagtgagagtgattagatgtctccccaacaacagagcatcttttctttgtcagagggtgaagtcagtgtttctaatgcaatagctagtaatgtctcatagagatataaaatatgtatttgaatattagactgagaaaatacaaaatgacagtaaaaacctacatatagccattatttgttccactttccatattttcttcttgttatttatcagtatatgagcttatacaaaggaacatattttggatgcaaatatgtccctttgtgtgtatttgaagttgggaaaaagttgaaaactgctattctaaaggaattgcacagtttattgcaataatatataaaaaaatctctgtaaagcagtatacagtgtaaggcccacattttcgtatgatttgatgagttcccagaatcactaacatgtttcccagaaggaaaaagtagaaagttaaaaaatgaattctgttctaaatacaataatatttattataatctttctgcaatgcaaccataatgctttatacactattaatatatcacatcctaggttttaagttttagttgcttataacatgcaattttgacatttacaatgtctacttttttattcattggcatagtcatttataactcatttcaagttcttaagtaagttggaagatgtttgcttagtagttgagagtactagaaaaacatctttaatgtctagaattttattactaagttatatttgaaaataatttgtttatttaaaattgtaagatttcttggaaacaattctttgagaatactcatgaaaattaggctgtatggagatcgactgggaaaaaaaatgcaggtgctggagacaacctgaccactagcaaaatcattatacttagattgaaactgatcctaaagaactctttcagaatttgcagggagcttggggatgctttgctcctctctccaaatgagaaggtaatggggaaatcctgtgataagggtataaggaaagcaaatacgagagcaggctttacgcctttgacatcggaaagtctatagtcatgactagagttattctcttttgacttttgtcaccagtgggaaatgagaaaggaacatgaaagacttttccttgatttatcaaaggatgatacccttgcagaaagcgctagcagatcagggaagccatccatgttcgagggttgttgaggccaagctaggctgagacccttgattcccaggtctaaattccaggaagacagtgaatcttagaagtctaaagtctgaatggccaggcgcagtggctcacgcctataatcccagcactttgtgaggccaaggcgggtggatgacctgaggtcaggagttcaagaccagtctggccaacatggtgaaaccccgtctctactaaaaatacaaaaattagctgggcgtggtggcgggcacctgtaatcccagctacttgggaggctgaggcaggagaatcgcttgaacctggcaggctgaggttgcagtgagctgagatcacgccattgcacttcggcctgggtgagtctgtacaagattaagtttctaagaacaaaccacgaatgaagataatactactgtatgatagatatcttttcaaaagtttgcggtacatagactttttaaaaagtcttcaaaatatttgacatttgcaaaataaaaattgtctcaaaaaacgaagaaaataaatcattatatttgtgacttgtttgaatcagataatgatggtggtgaatactactgctttaacttgaggcttttttcttttcattcttttaagtgttcataaatcttttaatgttgacaccatcagtctagataactaataatcatccattgttaagaatgataatatttcctttgattgtgagaccagagaagaaatcattttaatcaaatggaggttttgttcttaccttaagtgcgaacaaaaccaacctctgtaccctgggtccagtaaagctataaccagaatatatttttaatcactgtgaccggcattcacttaagcagagatagggcaaggagaaagagaccatggtgtgtactattgtcaaactagttatctttcataggtttttagacttgtgactacttcaaaaccccttttctgttttcattgtttcagtgtgatggaacagatctcaccccaaagattcaggaactgaagttccagtgtatagtatttttaaatatacccaggtaggctctgtttgtattgtttccttggtttgacgtgaactctgacttgaggttatctgttttcataacagaaaagtttcagatgtaaacaatgaagatcagttatctaaatgggtaattaaagatttctaggtctgataattcattctccgatttggtttatttagtgttctttgtggttggtggttttgtgcgtcatgtggcatgcattgtctgtacttacccatctttaagaaacccaggcacccctcttgactggaacatcttaatttatttctaaattactgttcttcccctcttcctccccatctaagaatgagagaattgaaacactttttttgttctcagtttcctaaaaactgttgaaaaaccatccagtctgattcaagtgcggaattcattcaaaattgttgccagatgatttctttgaaaaataggatgagttagagtattgttttctagccaggatgtcaactctccatggtgctattacgcacttcaggagaaagggatatttaagataactagactcaaaataaacatattatctcagtggcataaattatgttctaggccctgaagccaagattttggaagggatggatctataaccatttatttgcctgccaaacaactcagacacaaaatctgcaaatacattgtatttagactgaatttaattgaaatgagagttgtatgtaaatctgtggctaggaaaacacatcatagtctcctgattattcttggcagtgctcaatatagtcagttacaattttattccagaaatatttacagcttaattgaagtagaaggccttgattctcagaaagcattgtttattactttgctttattattctttctcttgtccttcctctcttgtccttcttcctctcttgtccttcttctgtcttttcttgcttctccctctttccatctgtattcttcttcctctatttctccaatttcttctgtttcccattctctttctaatctcttatctatatttcatctcttcttcactctgtcttccatagttacctttcccttctcctgtgagtacctcttattttgcttatgtattaatggcaaatgcttcccacttcatttccctgtctcttttctactggcatgcatacatcttcctttaagaccaaattctgaaaccacctatagataattcatgatatatcatagaaaacagacatacatgaatcatagtgagaaatatagataacgaacgaggagaaagttggataccacaggatacttttgttgcaaaattatggcccgttttcacagcttggtattttgtagatgataagaagtgcatttccttttctaatggaaggtgtgtaccaagaatggaaaactgtttttatgtttgataaacattgggtctaactacaaactaacacctcatgatagtcatgagaaggatgggacatatttacttctgtctttaatcttctcttgcagatattgtgctggcacaatgccctggggaaacccaggtgatcaccatgatttcgaacctcagcgtcatgatgatggttatattgaagtcattggatttaccatggcctctttggtgagcaatataactgttttattaaaatgaaatgtattttagtcacagagtttattcaattcacaggactttagttaactttttctcctgctttatcaagttacacattttatgaattatagagttgcttaggaaaaacaagaaaaaaaatcatcatttatgtcactaagaaaactgatgcacatttgtttgaacctcaagaataaatgagtatcacttcttacttttcctgattaattttctaacagaatgaaaagtttttatgctaattaaaaacattacactgggctgggtgcagtggctcatgcctgtaatcccagcactttgggaggccgaggtgggtggatcaactgaggtcaggagttccagaagagcctgaccaacatggtgaaacctgcctctactaaaactacaaaaattagctgggtatgatgtgctgcctgtaattccagctacttgggaggctgatgcaggataattgcttgaacacaggaggcaaaggttgcagtgagctgaaattgtgccactgcactccagcctgggtgacgagtgaaactgcatctcaaaaaaaaaaaaaaaaattacactatagaaacatcccagcattggcacagaagccatagcattttatacttttttggttcactgaggagttttgtgtttaggtaaaaaagagacagtagcaacttgtggatatccgtcttacttatgagtaaaatgatcatctccattatcacaaaatatctgaatatacaaagacatcattattgtgatattagtgcatactcagttgccacaatattgagatcaccttgtattttaattttgtttgcttgcattaaggaaggaaatttatagtgtaagtatattttcaaacaggttttagccatgcattcctgcttattattaaatgatgtgcggaccagttaaaattatgcttatcatttcttgtgtaaatcaggccacactgagtttgtaatgcaaataaaaacaaagcttctgcttgtcacctttggttggcacatgatttgtgctgtaccttatgcataaaagaaagaaggttgtatttctcattctaaacaaatcaaaataggtctctcttttactcatcttatgaattccaaataactctacctcaaattagtgaagtttaacagaaaaatctattgtgcttatggcaagaatcttcatcacctgattttgtgatggcccttgttaactcatctctagaataaaatagttgtcatggtagaaaagattggactggggttgacttactttccagcgttgtaacacaatatagctccttatctccagagctttttatgtttattgcaaatgaagatacaagccaagagcaaataggattaagtttaggaaggatatatgcagggaagaattctttttttttttttttttttttttttttttgagacagagtctcactctgttgcccaggctggagtgcagtggagcaatttcggctcactgcaagctctacctcctgggttcacgccattctcctgcctcagcctcccgagtagctgggactacaggcgcccgccaccacgcccggctaatttttttgtatttttagtagagacgagatttcaccatgtttgccaggatggtctcgatctcctgacctcgtggtccacccacctcagcctcccaaagtgctgggattacaggcgtgagccaccgcacccggccagggaagaattcttggaggtgacaaaatcatgcccgtatatgatggaaaaaactctctaaactgtccatacgtgggttacttattctttattcactgatcgagtgaacatttattgagtggttatcatgtgctagagcctcctagttctgactgtggtagaaggctctcagggattgtctgcaagatgacaatcccttacctaggcctggaagtccaaggggaatattcagtatttccccattgctcttaggatcaaaatctctgtccttatttggcctgtaaagttgaggttctgtctggttctctagccttccctgctctcatctttgctttctagctcaagcagctgacaagtgaagcacagcatcggctctcccttgcttcttttgtaccaccaagccattgcacgtgtgctctctctctctgaaatgtacttcaactgtttcttctatgccttctcagactatatctgtgtcttgttcttgttctttttgtagtcttttctggtatgggtgttttttttttctaacaattgtataattagtataatttttattatactaattcgtatatttagtatgataattagaatattacactaattatataggagcaatactgaaactgggtaattagtggagagttgaatggagggctctttcacaaatagtgcactaggtttatgagaaaccaattcttgagctgaagataaaaaggaaaagaagataaaaaggaaaaacagtaccagaaaaagaactacttggaaagggttacgtgataggagtgatatttgcaaagaggaagcaagcaacctgtgctcacctggcagagagcaagccagggacataaatacagcgactgcccacttcaccttgacctctagatcttctgctggtgggtctatctggagaagtctgattggaagccagaagacatgggagccactgatgcagtccaaatagctcagcctcacagagcagaaaagagggcagggaaggctggagaggcagctggggcagcaaatggtgaatatccatcactccactgtgggtggccagtccacaacagggagcctgtggcatgcagttggcaatgcgtgacgtgactgactgaattttaccaggagaagaagaatggaacttggcattctggaaaaaggaaaatttacaaacatttggaagtaggaggaattgtagtgctttgtgggaactataagtagtttcatgtagtttaaatgtaggtgaaaagagagagtgatcacaggtggtgctaaagatgtgggtaagggccagatcatagagtgcatcacagcactgatctaggagcatttactttattcagcattcttgaggagttagtaaaatttttttaaagataaatatttatatgggaaggtttcagtgtaaaaatagacaaaataatacaacaaactcccaagtatcatcactcagcttttataattttcaattcatggacaatcttatatttgtcccacctacaacctcttccattatattattctggagcaaatcctagacattacgtatatacaatatatgtcatatatacatcatatgcatagcatatatatcattttatccatcaataattcgaaatggacttttaaaagatactttcttttataaacacaaccacaataacagtatattatttaaaaaaatgaaaataatagtacctgaatatcactaaatatttactcagagtttgaatttccagttgtctcacaaatatcatttattttcttatgcagtttctttgagtcggaatccagataaaacttacacattgtggttggttgatatgaccttaaactctccgtagtttccccttcaactcttcctcatttatttattgaagaaactggtcatttgtcctgtcaagtttctgagtctgaattttgcagataggatccctgaggcatttattaaaatgtgcttctttcttttttctgtacttgatagctggatctacatacactacatatattttcccccaaatctactttgtaagcagtgttttctttttctaaaaaagaatatataatgtctggctttctttctccttttttaatgttggcagatattgatggtcaatgtctggatgtaggaaacattaagggttgcaaaatagtgatattctaattctcttttttttttttttgagatggagttttgctcttgttgcccaggctggagtgcaatggtgcaatctcggctcactgtaacctctgcctcccgagttcaagcgattctcctgccttagccccccaagtagctgggattacaggcacccgccaccacacctggctaattttgtatttttagtagagatggggtttcaccatgttggtcaggctggtcttgaactcctgacctcaagtgatccacccgcctcggcctctcaaaatgcttgggttacaggcatgagccaccatgcctggcctgatattctaattctatccttcttcatttactacttgaaatatttctatgaagagaaatttcacttcacttactatttgattacttagtcatatagtttgtataggaaaggctcaataagtgattctttttctttctttatacattttcaaaatactgagttagttctctagcatcctccaatggtgactctggttttaaatggccttcagtttttgaacaataatcccatcaaagattggaatttagcttcccctagtatttggttgggcccatgactacttggatgagttgaatacagtgaagtaacactgtgcaccttcctagtctgggtcataagaagtcctttcagcatatgggaaatttgagtgctagtgatgatgtctaattaataggattttttaaaaattcaaggtaatacttagttcaactgtctctctgctttcattcctttagtatcaatcatactcatttattgaatactcactgagtctacaaattctgcatccctaagtgggatactgctagataaaactgttaagaagtgaacccaaagaaaagccctgtcctcagtgtgttcatagctcggtgttatcagggggacaaaggagtaaacaagcaatcataatctgaggcagcaaattctaggagaaaggctggggtgagagtggaaagaattgaaatccaaacagtgtttgtaaaatgaggttgtcagcaataatttcttagaggaggaaggagtccctgggagtggaattgccaagtgaacatgaccatcagggaattagcctaagagaccaccatatcctaggagagggttccagtggtggctcctagtaatgacacagtcaatgaagccgtggatgtggagaaagggcagagatagagttctttaaactgtcaatggggaggctaaaagagatggagtaaaacagggtcagacttgtgctttaaaaagattatgcggatgacattgtaggagacaaccagaatttacaactggaggcaggtagagaagtcagaatgctggcatgtgagtccaggtgcagaaatgagaaggtctggccaggtgctgtggctcccgcctgtaatcccagcactttgggaggccgaggtgggcagattacttgaggtcaggagtttgagaccagcctggccaacgtggtgaaaccccatctctactaaaaatacaaaaaattagccaggcattgtggtggtcacttgtaatcccagattggtgggaggctgaggtaggagaatcacttgaacccgggatgtggaggttgcagtgagccaagatcatgccattgaactctagcctgggcaacaagagtgaaattccgtctcaaaaaaaaaaaaaaaaaaaaaaaaaaaaaaaaaaaagaaatgagaaagcattcaagcctgaagaaagaaagtgccaatgaagacagaggggctggtgagttcaagagagttgtttggacatagtgacgtattgtgaagggtacaaagggaatagtatacccaaattccaggaggctagcatagatagctaggtaaaggataaatgcattaaatgagatagaaaacataaaagagagaatatctcaaaagaaatacactgtgttttatctattttaaattcaaaatctctgtaagacatctaaggaaatatagaaatggacaatttaaaatatatgtttagagttcaggagatcttttcaggagagattgttttggagagggaggggttctgccagatcctttttattcttctcctatcatttgtaggaaaaagagaaataatcgcagatggtagttggcaaaaaaggaaatggaatactaaaattaggtccattatttttttctcttttcatcatgtgaataaggtaatccatatacatcatcagctagcatcaaatgcatgattgaatctcagattccagtgactctaattgcttccaagaaagagaatgctatctaagaaaagcaaaattaaatggagtttaaactgtatggttttgaacattctatgacctctaaatgtatactggcatatatttctctctttttagacacattttatcttactacttgctactcatatagcagtaaagcattgtatttttttttcattcaggatgaaataatctaatttgcagtcttcaatttcacatttcttgaactactatattgcttatatttctaaggaagtaaattatttgaaaactcaaacatttgtttaagatgattatgtaaacagacaaatatagttatttgggtatatgtgtatatatttttgcatatttaatatagctgctatataattaaaaacataaccagtaggtcaagctttttagaaacaaactatttttcttagaaatttatatgtgtgtagtaattaaaggctataaacttaaaatcatggaatacactaataaatatatttgtacattgcttatgatttcagtgaaatccaaaaaattgaaaattcagaatggcacttttattataagagagctttgaaatagaattactggaatgagaaaaaagactgtttcttttagactctttatcttgtaattgcaaatttcaaagtagaagtcttcaattcattttactggttgaaatgcattcctgctaattaagatgattcttcattgggtgctgggtaatctgattacctttttggagtttacacagaccataatcagacattgtaatttgtatttatttctgccacaattttctgccattattgtttctaaggtcctttcatgttgagtttgtttctaagtaatttaaacttctcaagacgttcaaagcattattcagtcagaggaattgggaacctaatttgccattcagtatgaaatccaaagatttcagtctcgtaaactttaaagaaggcacgtccagctttctttttgttaattgaaataaaactgtgtaagtttctttatagttatgaattaggaaagcaagaggttatccagtgagtaaaaaggacatggagaaattctcagggttgaagttttacacttaccatatatctttgttttaagaaaaaggtaatattaaatgtatgcttattttgataatatacataagaattaaagtaaattatcagttataattttatgactcataaataaataactatatttgatgtgtttctaattgctttatttttacatttttaaaaatacatgaaaccatattataaggaaaacccatactacaaatggctacctacttttttattgtataaatatagcctaatttatgtaataattattttatgcaaagtttcctttatgaagcttttaggtttttgatgttttatattgcagataatcctgtaattaacataattgtttgtaaacctctcttcacatttcaaattattttcttatggcaaatcctaaggaaattacaatgacataagcattttgaagcctcttactaaaaattatagaattattttttagaaatgtcatactgtttacttgcccaagagcggcatatagagttcctggatgagaagtgatttagtagacagagttcctggggccggccgcgactgtggcggtgggggcggtaggagccccgcaaggcgttgggggtcgctgaaggccagccagctgcattccaggtggcacgagggaccgcccttgtgctcagagaagtgatttaaatatccaacagatgttgaaaatgtgttaatggatacagacataaatgatgtttaaatattatacttgatgaaacagggaagagaataaacttccatccctggaaggaagtaaaggaattatatatgttttatacagataaaattctggaacagacaattatgtccttacaaacaacaacatttgagagtaaggataagtttatttttattgttaccattttgttttttttaaaagaagtcaaatgtgtttttttgcatattttaatgggctgtttatcatttattgttgaaatagaagagatatattctggatacaagtcttctgacagatttatttattaaaaataaattctttttgtttatacttttcctttttgtgtttttagtgtttgttttgatgagcatgttttaaacatccaattttatgaaaaaggcttaatttgtattagagctttttgtgtgcttcctaagaaatctttgattactcccagaaagattgggaggccattctcctatattttcttcttgaagatttataattttggcttttatatgtaagtatatgattcagctcaaattaatttttgtgtattgtgtaagatacatattcattcataaaaaatgcatttatccagctttttccagcactatttgttgaataaactttccttttctgtaaaattgctttggtgcttttgcttggtgtctagattctattctgttccattgatttgtttatcctcattgccaataccacactgtcttaattagctgtatggtaacccttgaatctggtaatatgaatcactttattgttctaacagtgttttccttgttctagatctttgggcatttgcatataaatattagaatctgttattatctgcaaaaaattaggattttaattggaattgcatttaagttttagataatttggggaggaattggaatattaacaatatgaatgttccaatccatgaacatggtatatttctccatttatttaggtatttaatatccatcaacaatgttttgtagcttcagtgcaattttcaggtttttgcacaccttttgttaaatttatttctaagtatttttaatgctatcttaaacagtaatttaaattttacatttaattattgctaatatatagaaataactatatgtgtgtctatacatatacaaatacatatttgtttattgaccttgtctcataactttgctaaattgacttattagatccagtagcttgttttttttaatagattccttaggtttttctgcaaccacaattatattgtttgaaatagagttttactgtttccttacatgcctttccatttttattttttatttaaaaaatttttatgccactctagaaaattctttaaaatttctttttcttggatgttcactaagatgttgaataaaaatgataagaatgcacatgtttgtattgttcctgattacatggggaagcattccatatttttcataaaatatgcttaattgtagtttttttttattagtgtcctttatatgatgaaggaatttccatttcattcctactttcctgagagcttttgatcacaaatgagtggtgtattttatcaaaggttttttgtatctgtgaaattgacatacaattttcccctttcttttgtttatatcactaatttcattaatttttaaaaatcttatactgatcttgcatttctaggataagcccctcttaggcttgatttattatcatttttatattgctagatacagtttactaatattttgttaagcatttttgtgattatgattatgagggagagcgataaataaatttcttttcttgcataatttgattgggttttgatataaaggttctactggccttggaatctgagacaagaaatgacattctcttctatttcctgaaagaatttgtgaagactggtactatgatttttttccttatatatttcataaaatttcctaatatactatttggctttgagatttctttaaggcaagtatagatatagaattattcatattatctatttcttcttgagtcaactttattaagttaaatatttcatgaaacttgttcattattttgtctaaattgttgagtttatgtttacaatgctattaatattttactgtttgtaggatcccccctccattctggatacaagtaattttatcaatttacctatctttttctcataatccttcttctctttcttaccttatgctcttttttattttttgatatggagttttgctcttgttgcccagactggagtgcagtggcatgatcttggccactgcaacctctgtctcctaggttcaggtgattctcctgcctcagcctcctgaatagctgggattataggtgcccgccacaagggccggctaatttttgtatttttagtagaggcgaggtttcaccatgttggccaggctggtctcgaactcctgacctctggtgatctgcccaccttggcctcccaaagtgttgggattacaggcgtgagccactgtgcccagcattaccttatactcttacttccatacatctttcacattccatatgagctccacaaatcagcattaatgtatttgctttgaacaattgttacttttaaagaaattaagagatgaaagacaaatagaaagtcctttgttacccacctgtctccctttccagtgctattcactccttcctgttgatccaagtttccatctggcgtcatttttctttaatttcaatgatttcctctaacatttcttatagtgaagttctgttggcaacaaatagttttaaattttatttttctgaaaatgtctttattttatcctcattctttgaattatgtttttgtagatatagaattctgaattctggactgacaggtttgtttttgttcgtcttgctttagctctttaaatagttgttttgttttcttctggcctccatattttataatgaaaagtcagctgtcatttgcatcattatttccttgtatatagtgtgtctttttttctctgttcttgagattttctctttatttgttgtttttttaaaaatcaaaattttaatttatgagtagtaattgtgcatattgatggaatacataatgatgcttcaacacatataatgtacagtgatcaaatcaggataattagcatatcgatcatctcaaacatttgtcatttctttgtgttgggaacatttaatatcctcctcctagttttttgaaactagatattactgtcaactatagtcatcctacagtggtatagaacactaaaatttatttcttctatcttgttttaattttgtatcctttaacaagttttttcctgtccctccctttccttcaccctttctagcctctagtatcctctgttctactttttacttctgtgagatcaacttttcctagcttccacaaattaacgagaatgtgtggtggttaacgttctcttcctatcttattttatttagcataatgttctccagtttcatccatgttgccacaagatttcattctttttaatggctgaataatattccattgtgtatacatactacatttttttttttattttttgttgttggacacctaggcagtttccatatcttggctattggagcagtgctgcaataaacatgggggttacagatgtctcttcaatatactggtttcctttctattggataaatgcccagtagtgcaattgctggatcatatgatacttccatttgttgttttttgaggaacctccatattcctctccatggtgattgtactagtttatctttagttttaaacctctttgtagctgtattactttcttattgctgctgagaacaaatgaccacaacagtggcttaagacaacatacatttattattttaaattcatggagatcagaagtctaaaatgggtttgtaggcctgtgttccctctggagattctatggaagaattagtttccttgtctttttcagctactggaggctgcccacattctttggcttacagtcctgtgccactccagcctgtttctattcttgcattgtcctctctgactttcattctctagaccctaatttttctttataaggaccattgagactacattgggtccactaagacaatccagaataatcttcctatctcaacaaccttagtttacttacacctgaaaaggcccttttgctccatgaggtttgtgtggttcctgggagttagaacatgggcatcatttttggtggttgtagtggtgagcactgttctgcccaccacagtggttttctttgcatttatgctgttttaggtccactggtctccttggacctaaaggtttatttttttccccaacgaactaggaatatttttattcatgtattttatgctcaattctccctttctctgcttctgggatttaattaaatgtattttagattgcttgttattgtctcataggccatgaaatagaataaaacatttctgtctctgtttttcagatacggtaatttctattcatctgtttttatcttcactggcctctttttttctgcagctttcaatttgctcttaagttcactcagcaataattttgtttttttcattttattatggatgatgttttcttgcttctttgcctgtgttgtcctagtggatgatacatcgtatgtgggtctggattgtgtttcgttgtgacttagtgtgtactgtcttagcattacattctacttagttctccacttcctgcttcacaagataaaaaatcagtcttatataagggacgaattctactggaccagtattaaaagatggatagggtatatttcttttgttccagaattatacaaatctattttattccattgctccattatattttattgattctgtcactatactgccagaatattgcagattttagaggaatgattgtccatatagctacctttaaagcatacaaatgatttttttctcaaaccgcatcatgaatacgagtctaaatctcactaacagctatgaaactggacaggtccacaagagtggctttttttttttcctgcttctcataaactcactttggtagtgactagaatctactttcattaaacaaaagtgaaaaaagacacatgtatacaagtaatcccaatgagagttttgagatttttacaagactttttcatagaaaaatttttgacttatagtaagtatgcaataattgctactattttttttaatttgcagaagggaggtttttcaaatgcagttctttctttttcactctctagcagtttagagtggctggacaatatcacatcacttatatagtcaaggaaagaaacagggctctagatgggaggaggtggaatttgagaacatgattatagaattgtaggtacaaggccaggcgcggtggctcacgcctgtaatcccagcactttgggaggccgaggcgggcagatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaagaattgtaggtacaacctagaatcataaaacgctagttctgaaagtgattgtagcagcatactgtaatcactttacatatgaggaaactgaatttatcgaattatttttgctataaatatttattagtgtggacaataattaataccaccactactaatagcatttaggttccctacagcatgttttaccatggagctttaaaacacaccagtgggctgggcgcagtggctcacacctataatcccagcactttgggaggccaaggtgggtggatcacctgaggtcaggagtttgagaccagcctggccaacatggcgaaaccctgtctctactaaaaatacaaaacgaaattagctgcacatggtggcgtgcacctgtagtcccagctactcaggaggctgaggcaggagaattgctttggaggcagaggttgcagtcagccgagatcgtgccactgcactccagcctgggcaacagagtgagactccatctcaaacataaataaataaataaaataataaaaaaaacccagtgcctagaaatgttaattcttgataaaatgaaaaaaatcttaatgatagatgttcctgacagtaaaatagcttgtaaaatgttgtgtcaaaaactatgaattagctgatattggtgccactgcaaattatgtaagtaaaatttctcattttggtgactagctgagtatatcaaagaggaaaataattcaataggagatagatccattgaggctatttagtacaggaggctagttatgggatgctagaagaactgaaaagaggtcaacccatagattagcaattcataaatcgacaactgcaggaagtctctgtcacctctagggctagagggacagcgagagaagatggtgttattagcatcaaggagctcaggctataaaacagagctggaacctgggagaagtggccacctgagaggcctgttgatgggcatggtgggagggtcatacggcagaactagaactctggagaagggaatcgctccaggagagttggagcctcagtgagggctgcctgtctgagttggagccacagggacaggttcgcctggagagagtgcttctcagtaggaaatggaagctcaaaggaattactagctattgccagacactgattgagaaaaagagatgggaagaaatacttactctctcctccctttcagcccactaatatttatatttgtatttttatttcttgttcctttgtgtatgacgtgaggtagaatactgattttatttttctctatatagtgggaaatattcccagcctctttggctaaattatccatcatttctccaataatttataatgccacatcaccgtagttcatgtactcgtatctttgagtctattctgttctgttattcatttccactggctttcactattttaatgactgcatctttaagtattatatatttcggattctaacaggggcagtctgctatccattgcccctgttctttccaactatccttagtaatttgtggatctttatccttcaaaattaattattgaatcatttttataagtatattagtcaagattctccaaagaaacagaacaaaagggagtgtgtgagtgggggagagagattgagatttattttattctcacgtgaattgtgaattggaggctggcaagtcccaatttgcaccaatttgcagggtaggctgacaggctagagacccagggagcagttgatgtttaagctcaagtccaaaggcaggctgaggtcaaattcttcctgttctgggaaggttcttcttttttctttttagagtcttcagcaagttggatgaggcccactcatgtttgctttactcaaagtctactgagttaaatgttaatctcattaaaaaaatactttcatagaagcatctagaatgtttgaccaaatatctggttactgtggcttaggtaagttgacatgaaattaacatgacaacaagattccttaaaatagtatttctattattttaatttgaattacattgaattggtacattaattttggaaaattaacattattagagtattgaattattctgttcatgaatataacatgcctctccatttacttaagtcttcccttacatctttcaataaagttttaaagttttctgcataaaagtctgcatgtactgtttttgttgatattgtaaatggcattttatatcctattgtatttgtttatttaatgctagagtagtagaatactattggttttttaattcaacagtgtatcagccatctttcttatgagttttaacacttggcctgtgaattttcttggaatttttgtgtgtgggatgatatcagtagaaatattagtaagtttgcattttttcttttaattctttttttttctaattttatttctttgtctcattgtgttggtcagtacttccaatattatgttgaaaactttcgttgctgatggataactttgtttcttgaaaggaatgcttctaaatttttttttattgtgaataatatttttttctaggtatcttggtgggtgatctttatcagttacaaaagctactttctgttcttagttttctatgaaattcatttttatcataaaaggcattgaacatctttttttgcttaatcttttgagatgataatgtggtttttctcatttaaataattaatgtactgaaattacaatgatgtattttctgatgttgagtaattcttaatttcttgattcttaacaataaaccataataactttaacttctataaaagagaccactggcagcaattagatgtttttaaatgattttggcattatgatcatgaatataatttaggataaaattttttgttttcttgtactgcttttatctagttttgttaccttaaaagctatagcatcatattttctaaagcatcttgtactaaatagacactgtctttccttaacatttaggtaggacggacttataaaacatctagcctctttgacatttttggggagggggtagtggggcaggtaaaatgaggaacattttttgataactctttcaatttttaaaatagccctaatctatttaatttctgtatttattacaccaaacttcgtaagttatatttttccacgaaatttctttcttatctaggtttttcgatttattgttttcctaaaattcctgcatgattttcagaactctgtattatctctttagctagctccttattttatttatttaattttattttttagatacagggtcttgctctattgccaggctggagtgcagtggcgtgatcatagctcactgcggccttgacctcctgggctcagaagctcctcctccctaagcctcccaactagctgggactacaggcatgcaccaccgtcctcagctgatttttaaattttttgtagagatggagtctgactatgttgccctagctggtcttgaacttctgacctcatgccatcctcccactttggcctcccaaagtgctgggatacagatgtgagacactgcacctggccatttcttatttttaataaagaaaataattttggccaggcacagtggctcacacctgtaatcccagcactttgggaggccgaggcgggaggatcacgaagtcagaagattgagaccatcctggccaacacggtgaaacctgtccctactaaaatacaaaaaattagccgggtgtggtggcacatgcctgtagtcccagctactcagggggctgaggcaggggaatcacttgaacccgggaggtggaggttgcagtgagctgagattgcaccactgcattccagcctggcaacagagtgagactccatctcaaaaaaaaaaaaaaaaaaaaagaaaatagttttatgttttctattcttttttgtttagtcttacaagaggtttgtttaccttgttagtctttaaaacacaagcagatgatctcttgcgcttgatctccatgtcacagattttttccttcgggtactttgttccaggaatgaggctggggctgatagtggcggtgaggaaggaaaggagagtaaggtttgctcttgcttcacccctcccccaacccaggattgcctgttctttccatctgacagcaagtagaatgacttaggcagtaaggaggaggatatgctttgagaggggttgagggaaaatattccagggaagagtgtagtgtgaaaagatagaaaatctcaagacatagctgcagtgcaaaggagagctatggtcttgggtcaataaatggcaatgaatgcattaggtcagggactgtctcagttttcctctcaagtcacagaaaagcaatatctgacgttctcagaagactaacacatgctaggttaaatagacagcgactgtcacgaataaatcaaagtattactaatagtaaatgattcattctagaaagtcttggggctttctattagggctcttagagactatgtcttataagatgctaagcctagaccaatctgagacatgaaaagtatgtatttctaataagttttaaaaaattacttatactctaatttgttccaaaaataatttaatgtgaccgtgctaacaataatggaaatgtctctaccctgaaaagctaattacagtacttcctcttgtctctgtgcaaccatcttggattgattgtgaaatgccggtaggggcggcattgacagttattaactctacctgcttgtaatatttgctgttgttttatttttgagtctgagaagatggcttaaaagtggtctagactactgtgtatgacttcaaataccaagaggttggaaggtgttcaagccattttcagtccggttagactcagcagaataccttcttaccaggcaggttttacattttatctgtcatgaggcctactcaagactacaaaataaaaagagtaaaatcatatcagataataaggcaaaaagaattttagtaacttctcacatcattctcctctgctttcttgctcaccagtcagttggcgggaggtgtgtaatagactaggaaggggcacgtaggaaccttctgggtgttatacattttccaaactttggtctcgatggaggttcacatgtgtatataaaatatttattaaactgtataataaaatttgtgtgctctatgtatgttatacaacaaaaatgtatgatttttcttttatttcctagaaggataaataatactaaatacattttttttttactaagtcagaagaggttatacaaatgtgttgctccttaatgacagacttttaatattgtcttgaaactccattctgtggctaccatgatgaactgagttctgtctttcattttgatccttaaagctgctttgctttccagagtgttttaaattaagtaattgatgttattttgcattttgttgatcttatacaggttagagatagcttgtggaagtttagataaaaagcaaacacctatttaaacttgaaaagtaacaatgtgctgcatattaaagtattggataaatacaatttagaggttaataaactacctgctttatattcttcatattggttttgttctactttcattggttatttaatgagaatagataacacaaagaaaaagctttgtattaaactaacatgcttaaatttagatttgaaacatataagagcaaaaagtgatagttaataggaatttatggtaaagctcgtcaaaattgtgaatatttggtttatttgcattaatggtttatccaggtttcctactatggtggtggttaattttactaattttagtatgtttatcagagactccttggttatgtacaatggacttgggggtttccagctttcttttccttttttttctttgagatggagtctcgctctattgcccatgctggagtgcagcggcttgacctcggctcactgcaacctctgcctcccaggttcaagcgattatcttgcctcagcctcctaagtagctgggactacaggtgcctgccaccatgcccagcttttttttttttttgtatttttagtagagaccgggtctcgccatgttggccaggctgctctggaactcctgaccaccggtgatccacctgccttggtctcccaaagtgctgggattacaggcatgagccacagcgcctggcctccagctttcttaaataataactaactccttgctcccctttgactcttgtttttataggcagccctgcaagttgggggccatggagagaggctacaccagtgtcgagaagtcatgcttctaacttacaaatccatccccatgcaagtggatggggagccctgtaggttggccccagctatgattcggatctccctgaggaatcaggccaacatggtacagaagagcaagaggagaacatccatgcctttactcaatgagtgagtctgctcatggcctaccttgcttaacatgaagaccttggagaggagagtgcagagcatgtgcatggtctggggacctcactgtgttgggaagaggaaaaaagtccaggagactcagtagttccttggtttctctcataggaacacatagagtttttttctccttgtttattatacagttccatgcccttcttttagtagttattactgtacatgagatagatgattcttcttcactgaccacttgagaatatatttactgggactagcagaaaatcattgagagggattctaggatggtaaaccgtgttcaggtaaatgcgtttttgtttgttttgttttagggaagcacatagttagcctgctctttacccaggtcgcttggagagtgttggtttctccagtcacgggtggttggcagagctggtcagtggcttgcctctatccacattgcatctctttctgcctgccagtgaattgttcccttcctgatgttcccattttggggtcctccatactctggggcttcaactcagtgttggctttctgggcagcatcctattgtccagacatagcctgacccactctttctacccctgaacacatggtatcccacctggagttttcctttcttaggcattttaataaactgacttgaggtaaggtaatattggctagatatttagaattcatattcatcttatagtgtgtctcactccaactagtgattaagtgtctgtggggttggagaaggggacggaaaatgaacataatttttggcatcttttgagtatttcctctatatcatgctatgtgcttaaggccatttcaggacttagccttttgtcattctctatcacagtgagggactctcaaaggtgctcctcccgtttgtggcctgtaatgcatggttacctatttgcactgagtggctggcttccttgtggtgcctgtaaagcaagggcgtgctttgccatgcatttattgagtcaatataacggtatgcagaagtccttacaatagccagcaacacaggtgccctcattcactaccaacacttactgctctctctctgtggtggcacatgttggttgaggaacaggattagacagtgctctcagagtgttccagcttttggcatctgggtctcagtttgaagctggggtaaaaaatcctgtctgtcctctccttccttctctcccagaatctggacttcccccagaatttttcctagatcattttccagaggtgttttttagttacatgtctttctttgtttacattttgcatttagtgaaactcctcgctcattcctcctgtcctccgtgcctgctgccctccctgcctttaccttctatcaggttaaatacacaattgctgaggttatatgttaaaaaatgtggcatgccagtggttgtatatggttcatccaattccccctagaaatgttagagttaaatggaccaagggtttgctggaaatctatgaactactaagtgaaaaaccatctctgaaactgtgctatagcctatgttgttgggtcacttgtagatagttaagaagatatgcagaatctaaaagtttttactatatataggcagagaactcacagtcttagacctgctgcttctgtatttaataaccttatcagacatgaaatggttttcaggtatttagttttaaacagcttttacctttgtgttgagaattcgtatttgctcagcaaccatattgttaagagttcatttgactttctgcatctatagaagcacataaaaagaatttttttctttttgtactcaaggcacacatgatatatgatggcattttttgtagcacttagctttgcaggtgttcaagaagcagcctcaacttaaaaatactgttactggctgggtacggtggctcacacctgtaatcccagcactttgggaggccaagatggccagatcacttgagaccaggagttcaagaccagcctggtcaacacggcaaaaccccttctctgctataaatacaaaaattagacaggtgtggtggcatgcgcctgtaatcccagctactcaggaggctgtaatcccagctactcataagaatctctaggaccacaaggcagaggtttcatggagccgagatcacaccactgcactccagcctgggcaacagagcgagactctgtctgaaaaaaaaaaaaaaaactcaaacaacaacaacaacacaccccaaaactgttacttactttctaccagaggcagtgatgcctgcatccaagccaccccatgccctctgaaagacttatgagaaatgggaataatagtataattttcattttattaatgaatatttataagacttaaagataacaaaaatctttattagtacttgtgaaaaattatcattcaacactatattttgagaaaatcaatacggatagcacattttcaaaagaaagcaaaaaaacctagtcatcatgtaatgtttgcttactaaaccttaattgctctcattctgatcttatttaccttctaacctatgattaaatatttctttcaattttaccagaaaaccttgttttgaaatctaaggtcttccactagatttccaagtggagtttcaagttcaaggtcagcctttccttcaagactgttctataagtgttcttccaccttctgagtccttcaagcctttgtctgctttgaccatcaattgtgtgaagtgcaccatttgaaacaatgaagaaagagaaacttgaaagacattttctttatttcctgccttcctgtctttgcctgtcttcttttttcctttacttgaggagaactagtcgaaaatatctttagcatttttagcttaaaaacctctgtgtgtgtgtgtgtgttcccagtaagaagaaggtggttgtttaattcatctttaaaaattaggcttctttcacacagcatgttaattggatattcgagacgtaagtgctgtggctcccgtaacaacagttccctttccacttagatgccagtgctccttgtggttctgccctttctctgggagactgtatctctgatctgtgtcttcagcccagaattttcttctaaaaattgaagactcatacccaaatatcttagttgacatttttaccttaatgtctcatagtaacctcaaactacatgctagaaactggactcattaactttatttccttgacttttctaccccaccatccagtgagcctattcccttcacagctgtacacatgaaactaccatccattcatttgtcctgttcctggcctctggggttccctcagtcgcttctacttctatacacctgtgttagtccatttttgcattgctgtaaagaaatacctgaggctggataatttatttatttatatttatttgtttatttattgagacagaggctcactttcttgtccaggctggagtgccatggtgccctcttggctcactgcaacctccgcctcccgggttcaagtgattctcctgcctcagcttcacgagtagctgggacaacaggtgtgcgctaccatgcccagatgtatttttggtagagacagggtttccccatgttgctcaggctggtctcgaagtcctgggctcaagtgatctgcccgcctcagcctcccaaagtgctgggattacaggcgtgagtcactgtgcccagctaaggctggataatttataaagaaaagagttttatttggctcacagttctgtagcctgtacaagcataggaccagcatctgcttcgcttctggtgaggcttcaggaagtttacagtcagggcagaaggtgaatggggagctggcatatcatatggtgggagagagagcaagagagacgggggaggcaccatactcatttaaacaactaattctcacatgaactcagagtgagaactcactcactacctcaaggagggcaccaggtatttatgagggatctgcccccatgacccaaacacctctgaccaggccccacatacaacatcggggattccatttcaacatgagatttggatgggacacacatccaaaccatatcagcatccatcagggtagctactacattctttgaactctatcttctgtttatttcccaagtctttgactctcatctcctctatcttctctaccagtaaagcagccagagttcaaaagtcacgtgagctacctctcagcagcattactaaaatatgcttctgactattttctgttcctgcccttgctgccttcacataatctgtctcttctgatatacccgttagattgatataagaatcccaagcctgtgttccttagctttgcagacctttttgatcactcccttcttcattctctttgctctttgttccagggaagattgctgttcctggaacagtagcctgtctcctacatcatcctggttttgctctctggtcctcttcttgcagtgccctctgcacctctttatcttctgctaactcctcgctcacagcttaggaccccattgaaatgctactattcctaataagccttttctgtctacttctagctgttagatgtacctttacgtgtttcagtggtgctcttggttatttccattacaccacttactaaaaatagtgtaatcattgattcactcctcccttctctgctctgtggggaggccctaggattttcctcttaggatcctcagtgtctgtcatagctcctgagacagtcacatcttgcatcagcgactcacacatgaatccattctataatgctgtctctgctgtgtttctcagaaattgctttctaagataacataaatctaaaattttgtgaatataaaactaatatcaaatgtgttttggtcacattgtcttataagtgaaagatacatatttaataatttcaagctatggtccacatggacagaaggaatttccatgagaaatagttaactaatagggcttcatgatgccactagatcttcatttatgcaaaaggaaaaattaatgttttctaaaaaatatttcttggcttataatcccatttgctattattatacacaaactaaaaagctaggtcccactgtgttcagaagctccttatatatatgggagcatatgtcatttatcatagcataggaatctacacagagtatgaactacagtaaataccttccccacaaaaagtaataagcagatttatctaggttcatattcatatgctagttacctgatagccaatatgctggattatgttctttatttgaaatgtgccattgaaggagaatagaaacaaaattacccaggtgttttgggagatcttcagtgaactattaataaatagataatattatccttagttcactagtaattaaggctacattattaaagatgatcgtttcatccaatgaccaggtttctagtcagcaaactttgaattgagcaatcgaattccatcatcctaggctgctgagaactattattgtttggaaacgatagtacttggaggataacacagacagagagagtcttgggctggagttacctcatgggtgactttgcatgagaagttatgtatgctgcagaacagagagatccgtggaactaggtctaatgtagttataatgaaactctttaaataagagagtggagagaataattatgtaaagtcaacaaaacattttgggtttagtttcttaaattctacattttgtcttttctagcagctgctgtagactccaatataaaagaagggagaaaagggagaaatctgtggtttcatttttctacccagaatgtgggtggaatgatagcaatacagtgatacaattagactttcttggtattacctttggagtttttaaaaagcctttgttgtttaactgaaggaagttgaagttttggttgagacactctttttaagatgattgtcttttggtgagtgttcctataaagcctggggaaacctgatggctgtgtgatgaaagggttaaattgaccttgaatcttttcaaagatgagtttaccatgccagcctaccactcaatatgtaagtgtgtgccttctctccttgggtgtcctgatgggcctgagcaagggaggccatggtcatccccctacaccccccgacctgccgtccagcatcgatcccagcctggccccgctccggtctgtgacttgcctagaaccagcgccttccgtgtgtcctgttggcttcgttgctatcaccggctttttttggattatttccgtggctggcttggttttccttttcctttccttcgctgttcggtgatgcgctcatttaatttctgtttaaattttgtgtgtctctctttctctcccctggcttgttccttgtctgtccacgctgtcgctgactctgtcttcgctgctcattccctgctgcctctagtattcatcaggtgcaaactgcggacctgcggcgagtgtctgctccccccggctccttcaccatgtgagtacagtgccattctgtttctacattttctccccagcctcgtctcctcagggttggactacctgtgtcccttgccttcacaggtctgttcgtcagataaggaagccacctcaccagaattgctttctgttgccctctttgatttgaaatggagctgtgaagtttttcatgttctatgtgcttccatcctctaagttaacagttcaatttttggatgagatactttagggtccatggttgcctggggttgtatagaattccatgctaagcattggtttttatgggaagtgcataataccgttagactatgtcattacttacggctcagagataagctcgaggaagtgcctgcagccctcaatttctggatgaaaccttaagattatgcgtggagttttgagtgtgtgtgtgtgtttctgttttggaagatccatagttacagtaaaagttcaatgaccccaaactgtcactgagttagcaaaatgcatttttatgtatatttaggagtttttgcttaatgtagtccagggtattatttttttctagtgagaacaaaaaaatatgttttttagcatttcagctcagaattattttgtgctgtgtactctgctttgtcctttgttttctccatatcacatatgcttacctagcatttattatgtttcagggactgttacagatactttacatattaattaatttgctctcccaacaacctttggccatatgtggtataattatctcccttctatgcatgaggaatctgatagacagagaggttaagtaacttgcccaaggtcacacagttaataaatcatagagtgggattcagactcaggcagtctggcttcaaagttcatgtttttaacaattcatagtctgctgcctttcgtctgtcaggatcctgtatatttctcaaggcccacttgaatgattacctttccaaagaattcttctttgattcttgctgtcagagttaattacaccctcactggagtttatcattcatgtatctgttgcagttctcaaggtttaatttggtgttaattacattaactctgtgtctgtgtattttacacagtagacttaggctatttgagatgattggcaatatcttaatatgaatcttgtgttcccagccatgttcacagattttaatatgaagtattctgaagccaaacaatgattgattggttttcttggtggaatgagtgaataaaagaatacatgtctaaatagaattgcacaatatctaacatctggtgatatgtatgacaaagcaattcctaaagttcagttatataatctactttcaactctcatcttatggatactaatttacttattatttaaaatatgtatttattcaaaaacctttattttgcacttgctctgtgccagacagtattttatgctctgtgtctagtggtaagcatgacagagcactaccttcctgaagcttacacttgagcagtcaaagaatcaataggaaaatgacattcaattgccaaactgaatgttgtggctggagtaaaattctatattctatataggccagttcaataaatttgagtttaaggagtggctgcatgtgatcattatttttagtggctccgttgattgtgatcaaagaattgagaatgttaacagcagaaatgcatatgatagtcatcttgtttctattatgggttaagttggttgtatttacactttagttgtgtatcttaaattggactgtttatctcttattccatgagtgtgcgtgctacatacagtaaagtaaattgtccatacttgtttctgtagggtgcagcaggctctaagttgtggttaccttaaaacttgaatgttaatttgaaaatattttatatctacatatgatatatattgaatattacatgtcatagattttctacctatagataaaacatttacataataaacattaaatcaggatattattttaaaaatcagttaataaaactatatggaatacagcaaggaatgtggagaaaagtttaagcacaacatgtgcattttgtctttttatgttatggcagtgcggatagccttgatttactcacacactagtgtttgctaatttcagcaatgttgaaaaaaccatggtaacattgctttggtcctgtagaagttaggagccccagtatcgttaagtgagattttatatatttttggcggggaggggaagggggttgctatctaatcagccactctctgctcagaacaactcttttttacagatggtcttttctttgggtgaaccctctctttatgctgctcttgaagcaattgttgcttccttcaagaagcttgaagtgatctttttttttctctctagctttcagaagactttttctccaggaatggagtacatggtggtaacaatgcaatgtatgaattattaggaattgcaacatactactaatgtctgtgtatgtgcaaaatttccagtttattcaaagaaaaatcatgaaattttatgttttgaccatatatgacaacatatgaattgatgaattttaatcaatggtatttactggtctcatccaataggacaaaacaaagcaaatagaatatttctccataaatcttgtatagtgcaagttaatgaattaataaattctttataattgattggcttcataatgaagtaaagtcctcattggaagacacatgtacacactacatttcataaatcatgactagtcatggtaaatgctgtaattgccaactcctattcagctaatgccaaaaaagtataaaactgcaaaatgtgtctttctagaactctcttagcctttagtagctacctctcattaggttctgtttccctcctgctcttcccccatcaaaatgaaataatgtgttccatttacacctaatttattcattgctttcatctttaaacaaacattattgagtgtttacttcagttactcaatgctctgtgggatattggagaagcagagacaagaacattaaggtttcagttgtgttgcctatgacagaattacgaagccatgtgacaagcatccaagtagaggttctggttgttcttccatatgaacgactttgtattgaatgtttattatatttgcttttatttttaatatttaaagttaacatactgtaaaacggacttttctggtgtacagttccataaagtttaagacatatagagattcatataaccaccaccatagtcaggatatagatcagtcagtcaccccaaaagagctgcctcatgatgtattccactgtagtcaaaccctcccatctcccaacctctggcaaccactaatcattatagttttgtgttttcaggaatgctatataaatggaagtatacaatgtgtagtccattgtagatggcttctttgactgaacactacacctttaagatttatccaagttgctgcatgtatcatttatttgttcctttttattgcccagctgtatttcattgtatggatgttttagcttgtttacccactcccccattgaaggatatctgggttattcttccagtttggggcaataatgagtagagttcctataaacattgatgaacaggttttatgtaataagctttatgtctctaggttaaacatgtaggaatgggattgctgggtcatatggtaagtgtatgttcaccttcgtaagaaactgacaaactgttttccagaatggtcgcaccattttgcatttctaccagcaatatatgatcattccagttgctccacacccctatcagcacttggtactgttagcatttgggaagcatatgtccaagtcttttgatcattttttaattgggctgtttgttttcttcctgtgaactttgagagttcatcatgtattctgcacccaaggcctttgtgtgctttgcagacattctctcccagtatatatcctgtcttttcattctcttggtgatatcttttgtagagtgaaaccttttgacagaatccagatgatttttttttttctttatagagttgtggttttggtattacgttaaagtactctttgtctaattccaggtgaatattttctcctttgctttctccctaaagttttataggttttctattttgcatttagttctgtgatctattttgagttcttttctatgagatgtgccatttagcttgaggttaatgtttttgcatatggatgtccaatgcatttggcaccatttatgaaaaaattatcttttcctattgaattgcctttacaactctaccaaaaatcaattggatatacaaaaagtcatcccttagtatccataggggattttttccagagtcccttttcttagattctagatgctcaactccctcatataaaacgggtatttgcatataacctatgtacatactttcatgtattttaaatcatctctagattgcttataacatccaatacagtacaaatgctatgtaaatagttgttaaatgcattgtttggggaattgtgatgagataaatagtctgtacatgttcggtatagacaaaaccattctatttttctgaatattttcaacctgtggttggttgaatctgcagatgtagaacccacagaaatggagaactgattatacacacacacgcacatgcacacacgtatacgcacacacagacacacagatccagtgtagactctattctgtgccattgacctatggcttatgcctttgccagtgccatattctttctattattgtacctttatagtaactcttaaaatctggttgcattattcttccaaatttattcttcattgtcaacactgttgtggctatttgagttcctttgtctttccatacacatttttagaatcagcttgcctatgtctccaaaaattctactagaaattggatgactggaattatattgagtctatagatcaacttggggaatgttgatatctttactgtgttgagactctcagttcataaattctctgtgtctcttcatttattttatttgtccatcatttcttggtagttttttgcataaagattttatacctattttgttagatttgtgcctaagtagttcatgtttttggagccattgtaaatgttttttttttttttttttttttttttggtgtgtttttaaaatgtttgtttccaattgctcattgttagtatatagaaatactatggattttttttttcttttgatacagggtctcactctgtcacccaggctggagtgcagtggtgcgatttcagctcactgcaacctctgcctcctgggttcaagtgatcttcccacctcagcctcctgagtagctggggactacaggcacatggtaccatgcctagctaacttttgaagtagtgtggagttttatatgttgaccttgtatcctattggccttactaaattcattttttagttctaggagtttggtagcatcctcaggattttctacatagtccagcatgtctgtgaataaggatacttttattcctttctctctcatccttatgccttttctttcttttgcattgttgtcctggctaggatttagagtacaatgttgaataagagtgatgagagtttcccttcttgctttctttctgatattagggagaaatcattctgtctttcaccattagattgattattagttgtagaatttttgttgaagtgttttgtcagcatatctggaaaagattagggtattatttgttctttatatgtttgttagaatttaccaatgaaactctcagagccacaagattttttcctctttcttaagctataaattcaatctctttaggagttgtaggactactcaggttatctatttcaccgtgaatgagttttagttgtcttatagttgctcgaagtatttgaggaattggtccatttcatctaaaatgttaactaatgtatgtagagttgttgtatttctttctctctttcatgtctgtgaggtctgcagtacaagtcctcttttattcctgatattagtaacctgtatctttttcttctttgtcaatcttggtagagatctatccattttattggcttttttgaagaattggcttttgttttactaactttcttggttgtttttcaatttgcaattttattgattcctgccctttattatttccttccttctgcttgatttgggtttattttgctctttttttcccatttttttctaaagtggaatcttttatttatttgcttcagtatgcaattgactcaagttcaggccacaagttttgactaatcttctaagggttgtggttacaacgttagttttattaccaaagtctttgcattgctattcttatctgtctggcttatgcatgactaagttgccagtatgggatctgggtggagttctaccctgtagttcagttcccaaagtctatggtctggtgtttagggctagattcatgtatttacagcctagagataaacacccaagagttcatgaacatctttatggagttgttttctgagttccttcctttctgctgtcatccctggtactttctggtctcttggggcttcctttgtttggtccttgtgccagaaagctaagggtttagttacctcactctgctgcatactgcctgtaactgtgttcatgtccagggccaaccaatgataacagaaagaaaaagaagcaatgatagtttctgccactctcttggcgtcacagctcttgtgattagagaggaagcccctcttccctcctaattttaggtgccagaaggctttgtcattgcggctgccagaaatagtgaaaaggcctgagtagtgtagtgggagaaaatggaggggggaaaaaagaaagggagatccttttccatttctttcggcattcagagtcccttcttttcttagagctggagcacaagcattttgccagagctctttctctctgctcctggtgtccccttttgggctttatgctgcctggagtccaggctggggcttattggagagagagggattggggagtttactaccaatttgatagtatcttaaaatctgatgttcttcaccaatctactgctatcgtttacttttcaaagttctcaaatagctgctttatgaaacctgtccacattgtatagccgcatgcagtggggaagaaataatgctgtgtgctgacccaccttcaccaggataagatctcccctgttttttgaagcagagaactatcggactgcatttcttcttgcccactgcagtgactcagcgagtgtcatagctaaattcagcaaaacaactctgcagagacaccagtgtattttgaattacaactaacatatgttaagtgtaatataccatcttgcacagcagttgcaatttaaacataaacaggatatatcccactgctaaattgtgtgggtctgcttattaccttgggaaaagcaaagttagaaaccgatccatgaagaaagtatgaattgtcatatttgaccactgaatatgactcagcattccaaaattccttgtgataaatgaagacttcttggtaaggatgaaagtaaattgatttttgttccaggaagaaagggaattttattaaaagcaagggaaatattttcgatatattaaaattttttatggttctgttttaggttgagtttaagaattttatttttataaaactaccaagacagagcaaagaacctttgatcttcacaattgaagaaaacataaattagccatagatggctaaatgtttgcatgcctctggccagagaagtaaactagaagatcttttgaaaagctttctaaaattctgtaattctattctacaactagtcacatcaaaacttttgttctaacatttacttgagtttgtataattatattatgaaaggtctctttattctgtttacttagttgtggtcctacaattagaaaataagacttgatttgtgttattcagaaccctctttcctttcctttcctctctttataaactctgccacaccttaactctttaaggaagtaacaaaaatgataccaaagtggaaatttacatgcatgcctttgtaaactataaggcttacctctaaagcagctgagatgatccatcagatatggtttgcctcaatgaattaagctgctggtggctaatacacaaccttcctgagagtctgagaatgaatcgcactcatgggccagtggagcctccagaaatgtgcttcatgtctggggcagaaatctgtccagattctgattcgtggattataatttttgaatcatacctcctggacccaaaaaccaatttcgagggtaccaaaacagcctaagtacttcaacttgtgtgattaggtttgttggtcatgcttttgttattattattattgtatttctaggtgattatctctgaattgtaggattatcgataatttttttttatttctgtattttctgatggatttccatgaatggggagtacttctaaaaagggaaaaaaagcagaacatttcatatttttggaagaacaggagagaattgctacattcgtagaatttaaaggcatgctatttgctgaatcttaaggtcggatagtgaagtgtaagagttagcttcaggctacctggaaagcaaagctatttgctctctaaacttctgagcaaaggaagatgctaaactttgcccatcgtctcttcttccttcctctctctcccttggctcctgaatttcttgggtactcttactagtaatttcacttcagactgtgcacagtttcttgactttcagtcataccatcatgtcatcccttctttcctcttgttatgccactcttccctgctagttccataaaacagacatctgcaatggacaattccaaagaaaagaaataatggttacttggacttcagctcatgccagtttccacactttatctctcagtttccatgagagcccaggctgcaactcggttaatgttgttttttttttaatttgttttgaattttttaaatgaatttctcccatgagttccctcactctgcctgggcttccattccactctgagaggtctagtgacacaaagaaaaggggcagtggaagcagtccacgggtctgtagccagagcgtcttcctccttattctgcaacccctctttccttatggtaacatccttctgatttgagtatctgggggaaccctgcatttgtctgtgtaacatcagccatgtattaaccttttgcatttcagtttttcagatatttaaaaactgcagttggtccttcgaattcctatcagctttgaagttctgttatggtagaattcaaagcatgatcttagaatcataagaaaatctgccctccaaaaatctgtaacatgaggtggatgagacttgctatgggacaagacagcgttgtccttggttctgagtactgggcaggggggccgggccctgttcttcattggtaagcatagttcatgtctcaccttcctgttagcaagaaccaaagtggatttttacatttagtcagagacataatatgtacctaagcaccttgctctgtgatcaaatttaacaccctactaacttctaaggtcacagttgctactagtctcattccctagatgagaagacagagaacaagaaatggtaggaaacttgcctatgattgcatgctatacattgataaagttgacatcgtagcatttaaggcatttatctctgctgtcaatatcacttctggtcattttcttgtgtgtgcatatatgtatgtatatttatctctattatttatatattttaatccaatcatattatataaacttttaaaagaaacttgattatgaagaataacagttcaattctgagtgttgcaaatgtgtgaatctttggtgtcataggtttatagttcaagtgttgttataataaaatttcagaatgacaaatttcaggtaaaaatagcaccactaagtaatttgaagtcttttagaatcgtaaggagtggcatttgaactgagaaacaggcttatcaggaaatgtcatgctgacatccacagtggaggaatcgttcctgtgttcttatattagtaacagtccacccagagctcggcaatcagtccacttatgtaaaggcgcaatacacttagggccccttccacatttaacattctatcttattgctttcaaatttatttttagaggtgaattatttatgtcctcataggtgtagaaatagtcttaccactcagcacttttcatacagtaaaaggttacttcaaaagtgcagcggatatttactgcgggttttgttgccttgagtgtgcagggaataagggagctcttgcagaagtcagacttgggggtaaaggagaaagtttgcaggaaggtttgggggtagtacatgtgccaggtatgtttggcagggaaaaggagggggaaacatttatgaaatttttaaaaaataaaaataaatttcacaaatagaaatctgactttagagatacaattagtccaacagatacaacacttgttttttagatttttctatgtttttaatagataagtgaaaattagggtctgaatagccagggcggggatatcaaattggcagagattcccaagccagattgaaatttttgaaaattaaaaattagatttctctcattcttccattatatatctttttataaacactagttgtaggattagaacaaaaggagttagttctttttgtgcatctttttagtagatacctgtatgagtttactaggactgccataacaaagtaccacagagtgggtggctaaaacaacagaaatttatttcgttacagttctggaggctgaaagtctgaatgaaggtgtcagcagggttggtttcttctgaagcctgtctccttgtcttgtagatgctgtcttctcatgtcttcatatggtcttccctctttgtctgtgtccaaattccctctttatataaaagacactagtcatgttggattaggctccactctaacaacttcatttaaacttaattacttctgtaaagaccctgtttccaaatacagtcacattctgaagagctatgggttagaacttcaacttaccaatttgggggacagataacttagtacataacagcatcatactggataaatttgattgaattttagttatatttctgtgtcaccctctgaagactaaactttgtgtatattatttatataaatattttagttgtttaaaatatttttttattaaagggtataaagagagctgaagaacattaccctattattcataacagattttccatattaattatatagatacaataaggtgattgacatctctggacccaaattcactttctgtaaaataaagtggttgaacaatatgtactttaaatttttgttcaaatctgaattcctaaagcatgattatagtaaaaacaatctgcagaaatacatgcagactataaacgggaaggaaaaggaatacttttgttagtctttgtgagtaaaatatttatttaaaaatggactccccacccagaaaacaaagcaaaacaaaaaacctaaatatttttggaccgaccattataactgcaatgttattaatggatttactgcattcaggaaggaaaaagagacatttcaacttttactccagtactagaataagaactgacattatcctctgacatatcaacaaagaaacctagatgttcgttttgagcgttccaaacaaataatccaaataatccaattattttggattactttgctgaagtggtaatgaagtgtgaggtgcgtttcatttgtaggagggcttcaatttaattataccaattccactgagttttgctggtctctcataacaccctgaaacacttccatgaaatgaaaagagtacattttaaaaggcataaaaagaaagtactcgttgatgctacatttaattaatccctagaacacatcacattttgtgtcagaaaatgaagttctatacatgattcaccaagttccaaagttatagctcaggtatttgactgaaatagaaatacttttcatcttgggccattataaaaattaagaaaaaagataaataaaataaaatgaaagtaccattggaagaatcacaaatggaaggaaaaggccaaagcctttcagtcttataatatattataaagacctatagttgtatttattttgaaaaagtaatcacttagaccttactgctcttaagaaaggtggctatgtcctctaattgggacgtgattatgtcatttggcttgatgttattttgttgtccaggaaaagtaaaacaagtatgttttcttgagtaaaagctcttgtcttataaatacattggtttgctgcctttaatagagacttgatttactttaatgtggtaagtgaaaggagagaaagaaatggaacaagcaaaggcactccaaattattttcacattctattatgatattatcaataaaaccattattttctttctttttcattgttttctttttagtatttgtagcatcaaaatatctaactattttgtgtttgtttctccttcatccaagtaatttattttatatatttactttcatttttttctgagacagggtctcactctgtggctaggctgaagtgtagtggcactattatagttgattgcaatcttgaactcctgagttcaagtgatcctcccgcctcagcctcctgagtagctaggacaacagttgcatgccaccgtgcttatttatttatttaaaaaaaagtttttagagatgatctcactatgttttcagggtagtctcaaactcctgaattcaagtgatcctcccaaaatgctgaaattacaggtgccactgcacctggccccaactgacccattagtccacccattaaagtatattctagggaactctttttctcaaccttgctatcaaattttgtaaaagttatttttgttgatgaataattgttatattgatataattattgtgtgattcttttaagttctgttctagaaatgtctttattctgtcatttttacaaagacaagaagaatgtttccaagaaataagagcagtttataaaatccctcagtcattggatcaggaattagagaagggaaatgaaaggtttcctcccagttggctaaatgggctgaattgggaaagcgggagggtcaggtttagaggactctcaattattccttcttggatttccgacaagaaaccttgggctggtgggaacacatctgagctactaataggagctgaagttcccaccaactgtagattgatgaacagaaatatggggccatctatatctctttccagagccaaatgtagctccccactgaggattgaggaccttggcaagcaattgtcaacctgtccaggtaaaatattaattacctactaatgaagaaaaacaaacaattctgcaataattttttctctgatactcagattttaggagagtatatacattgtttcataaaatgttttatgtgaagggctaaaaccatttaagaaaatgccttttatgtaatgccgcttattgtcaggtcaatccttactttttatttccattataaaaacaaaacatgctcttcccttgactgagcctgtttcctagaaatgcagatctactaccacacaatctgtagagtagcttttcagtagtaatgcgtcctgtagctcatacattccattctttctatacataattgggttatgtgatttccccattttaagatagcaatatctgttttcacttcatcattgcttcatgaattttggctactgttttttttgatatttttatttataacacattctgaatctttgattttttttttctattggtttgtagatgaaatgtgttcaatatttaaagattatgtgtagtctattttggttaaaatgctgttttaaagttacacatagacactcaaatatcactaattaattcgttaaagtgcttagagttactagagggttagcaactataccagtagttagaagcctagtttcagtgttcttcatggttggtatgaaagaccacaagtgttttcttctgtgaaatgacatttttaaaatacgcaaatcataacacttcatccacacccttttttagcaacgaaagtgaatttatcggttgcaaataagaacaggaaaatacaactgtttgtgattgcaaatcctggggaagatttttagcattttaaataacaattaagtttaagagatccctctgatacatagaaactgaaagctgaagcagaaaatgtctgtcttcctgaacacatgagatctaaatccattttgatggcttaagagtatcattgtcctcttatgtctcattggttcaagcccaactgctccttgctccactaagtatagtgatgaatggtcctccctccaactgacagtaaaagaattctccatgctgtgagaattccatttagtaccattgattgcaggctatggtattaaaagtaactcatgttagtgttttgtgatagaatctttaatcatttttaataacaaggaaaccttcattacatggatttacttcttaaagtggaaatgattttggcctgatgtgatgaaagacagggcttgagtttttacttgttcccattccaacagttcttaatttttcttcatctcaacagttggaatttgcagaattcttctatgagaatgcatgttacctctatgtctaatttccatttgtttctatttcctgtggtacttacttctcctttgccttttattaggatatttgtccaagttttatactccttaagcatgaaagaatgtacaaagagtgtatgtgggaacttaaagtctaaaattcctaccttaaaatacttttttaaaggttgtcatctctagttgccagttcaccaatatcagggcagaagacggcatcttcgtaagacttaaatttgcaataatatctagtaatgagtagaaattcttctcttttgtattaagcaggggcaagccagaggctcaactcgatacctgaaggtggtacagcaataatgtaatgcataatcagtgattttatttcttgtttgttgcttttagttatgggagtaggtttttcctttgaaccaaattcttttgagtggtcccattcaggccaatgattctggcctaatcacacatgattaggtgtgatgaagaatgtagtcagatgtcagaaaaaagatgtttttctcatcgcaaatttaggaagtccatatggggatcagtaatttaacacatattgaaaacctcatattaaacatatgtagtgggagatttaaagataactatagttgggcatcctgtccttgaagagctcatgatttaatggggagagcaacattgtcatatcatgattacatttatgttttaaacagtgtgcagtgtgatgaaatttttggatgcatggggcccaattagcctaggtgcaagatgatattagcttggtctaaaggggttttagtggaaggagcaaagaagcatacgtatttgaaagatttagaggaggataaactgcagcagagagaaagaaggagcttctggtaacttagttggcaaaccagaagagtgttttgaactgaattccaaaagtaaagagcttcaggcagcagggagttaaccacagtgtggaaggctactgaaaagtgaagtcaggtgaatttaatatgcatggataaaggaaaaagagaaagtaacaatattgtatagtcttatggagagggaactttgagtttctggggcaatgagttgttcagtggcttaaaaaataaatctgtgactctggtaataaaaagttataacatggccgggtgcagtgactcacacctgtaatcccagcactttgggaggccaaggtgggtggatcacccgaggaggtcaggagtttgagaccagccttatcaacatggtgaaaccccatctctagttaaaatacaaaattaactgggtgtattggcacactcctgtaatccaagctactcaggaggctgaggcaggacaattgcttgaacccaggaggcagaggttgcagagagccgagatcgtgccattgcactccagcctgggtgggcgacaagagcaaaaagtcataacacatgtatgtagggatggatccatgtaaaattccagaattggatcaacgagccagtaacagtgatggcattcactgccacaaaaggaaacaggtggccagaagaatttgaaatatcattcaaggttgttagtatgtctattttcctttaaaacaaaaatgatgaaactgctatacttgttaacctgctctgcaatgccactgagggaagccactgcttgcttgttctatacctttgcttccctttaaataccatgaacacgacactgaacagaaaacacactctagaataaccatgtggtaaattagttatgggagtaagtttttcctttgaacagaattcttttgagtggtccctattctggccaatgattctggcctaatcacacatgaaaaatctatgctcaaaagcatagattttttttattttaaaaagttttgtaagtctgtggagtacaagtgtaattttgttacatgcgtagattacatagtggtgaatcaggccttttagggtatctatcaccaaaatagcatatgttgtacccattaagtaatttctcatcattcacgctcccctaagcacagaaatttattacaaatttccatggaggctttaaaattttaattacaatgtgactttgaagatctccagaaaatttaaaaaataatttctgtttcagccaatgtcataaaaatttattgacatttgatgcttatagtctgtttgcaatatgttagccatcaaggcagcaaatatttctttgatatgcatctagctttggtggttaatgtttgcactcttttgacattagtccatgtgactgattatttttgtaacttaaaagccaattccctaaaaatggtggtagatgggctaataaatagagactgcagagaggaaaatttagactgcagggagaatttgcaaatgattaaggtagcctgaacaaagactaagccacttccattagcatcttactgcttggtgaggatcaagcagagacttagaatagccacttgaagatgcagtcataggggcgtatagaattagatggaatagcaaatactgaattagatgagatcgaagattgcttttgactctataatgcttccatgatgatcttataagaagggctggaagaatagctgcctcaaataatttgtaagctgtaacatatcctattacctcctcacaaatggatgtcttagagactgagaacttactcaacttccatcaaaaaagaattaataacctctgaaggtactttctccaggaaaacatgttgggcagtgggagtgcatgactgattgctgctaatgtgattttggtttatgcttggtttaagaatcaaaaacttctgtacaatgtgtttcagatttccgaggcattatttaattgaagaacaggtagttcagaaaaggtttacttacttttttgatggggacatctaccatttgtaggttcttctgtctttttatttgtgtagattctactggagataaaaagtgggaacataattcaacatggatttatttcctgatccagaggtcaaagaacagaaatggatgaccaaatcagttatgactttttcacaaagggaaaagctgctagaaagcagctcagaaatgctccaatgccaagctgtgctatagcatcagaaccatgtacagttgcagaggaatttgatttccttgcattcatttactcatttgttcaaaaacatttattgtaagcaacatggaccaggcattgttctagctgctggagctgcaaagaggaggaagagattcatagtgtgaattcatagcctttcacactgtgaattcacactataaattcatattttaataaaactctatttataaaacgagccagttcaaatgaattctattagattagttagaaacaaattttattatatctagattatgatcaggtagaattgcttgaaagaagttaaggcaattcattattactattaaatcagggctaaagggtgaaaggcagacagagttatgcttttctgtctcataaaagaaaaacaactctatatgagtagcaaatgcctggttgaattacaattatttataaaaatcaatgtttctacatagtgcgtgttacaaggggcaagccttacactgaactaagaaatgttaatgaaaacaggatatttataaggtacaaaatgtagaatgattacataactttaaggatcttgtctcaacatgagttaagatttatattcataatatctttaaaaagtaaaaaaaaacttgcaaacattcaccatccctacttgcattattgtccaaaagactgtggatagcgacattccactgaatcttgtatccctactgatgttgacggatgcccattctgctaaggtttcctgtctactaagtgctaattagagctgcaactctggcttcagctatgatattattatctaggactgaataaacaatataaggcttatggaaattgcagaagcgctagggcgataataatagtaacaacaactattattatttttgaccacttattatttgccaggaaggtgctaactgccttatatatgtctcatttagtgctcactacatttctattatcagtcccattttcagatcacaaaatggtttaaagaaggtaactttagcgttctgaccatttagattggaactaaattttttgaccatacgtcttgctttatccacttgctatcatgtcttaatattaacggatatcactcctatataattcatgtttccagtgacagaatgagttaatggagtccgtggtttaaaagtgaccctggagaaccaaaacgctcagcccatccactttatccataaagagattaggcctgggtgggagattggatgagaggcgtctcttatcagtccgagaggaatagtgtatactaaagaaattgatcaaaaggaggaagacgtttgagggcactagggaggaatacgactctgatggattgaaattctacatgggaacaattgaaaaagaagctattggcaacatctacaggagagcagagaatagcaagattaagtgtaaattgaatagcagtgagtgttcagggagttgtcttaatggaaagtcagtctacctcccttccaacatctcagggtaaaaggtgtgtataacatggataagggaagctgtggcatggaggttactggaaacccatctgagtgattcaacaagtgctcttattatggttcttgagaaagtgttcatgggagacatttgggaattaagtccagagccacgaacttccattctgcataaggatctcaatcacagtgttgcagagaattggggtagtgacctaaacctgtcggcttagtgagaaggcgacaggtttaggtcactaccccaataggaaagggaattcacagactgctaaatcccttctagggagtttgagatgttccatggaagccgggtttagaacccctgatccagagcctaatcagtatggcagtatcttgtggcagatgttggcaggaaggcaaatttatttttacccaggatgtttgtctcttctttgctctactaacttcccagacaaaatttaaatttagcaaactaatggcagtgctattccccagactccaaagaacagctttgtcatcctctaccttcagtcagccattaatgggacactaatatattttgacataaaggtatgaaattgaattacttggctttcatttaatctctatgcacttcccccgactcccccatgttctagctgtctgttttcatgtttttagttggccttttaaaatactaggtgggagagcacccagaagtgtaaaatgtcatgccaccagccaagctagacaatctccccccagaggtagcccagcaccttgtcagaaatgtttagggaggttccttcatgtgctctaaacattttccaatatctggcagaagcagcaaatgctgttgattattaggtagaaccttatctaggagaacgattttcagaataattattataatgataatagctaaaatctattgagcactgacaatgtgccaggcatttttctaagcatatcacatgtattggctcatttaattctcttaatatgcctatgaggtggatactgatatcatctccactttacctatgaggaaaatgaagcatagagtttcctgattaactaggaactggaagaactttacttcaaatccaggcaatctgacttggagcctgagctcctcaccactttgctgtgttgcctcccatacctgctgtttacaccagggttgcaaatgattcgagaaggtttaccattattgaccctggggtctaatgccctagaatttgctgatgagtctcaactgggacatcttttgataggagtttaaaaaagaaaacagataccccgcccagaagactaggtttaagtaagctgctgctagtgggaaagtggaaactgttgtaggttgttgggaaaagatgggagctaagagcaagagagcaaaagtgtaggaaagtggatgggagaaagtgttaagcggtggttagagtctgatttcttctgtcttgcttagctgatcattctggagatgaactgagatcatatgtgaattcatttgggatctataaagtttgattcaaataatagtgtcttttatgccatggtgtgccccctggaagttagggtggagtagtgggtggccagaggttcaggagacaacagtgcatgggttggaatcagagggcatagatgagaacctgggaggacatggcacagggagcagccactttatgggttttgagaaaggtgatacacactggtaagccccaaattggggagctccaggaaggggagtccaggaactggtcagcagtcattctccaaatctcatttcccatttgcaactactgcccaatcgaggtcttagtcctgatacctccagcccagtagagaagactgaagcccactgccattagatttactatgatctcaaataattgcttaggtagagttcattcaacctctgcccctcctcaacttctcctattagggtctgataggccactacattctatggttccagcttcccttttatctgctgtgtgtgcaggaaaatattttctaattacagtctttgcagatcagttgagtgaacttggaaataaagggattatcagacccctttaatttggggataaaaatctaatgtgaacaccatgtggtcactctgttaattgcgtaaattttttcctccctacttgcatctaattcctaacactctttgctataggccttatttttattcttgtcctgcattattgtttatttacatatggacgtgcttttaaaataactatattaattccttaaaaattatacttgatataaaataatgcccaggtttcaccacacagagataacaacttgcaacagcttgttggacgtgtctccatgcacttctcttgcatgtgcaaactcctgaagtccacaatttatatgaaggagcttatgccatatataattattcatgacttttcttcacttcacagcatgttgtagccacacttccctctaaatgaataaagaccttcagtatattcaaggtctgttctactaactgaaggtctgtatctataaatatcccgcctgatgattgtttattgataaagaaagaaatctgagcagcacacagagatcatcagactctgccaatccagactttatagttttgccgtcaaatccatgggattcttggtatttatccattgacaagagagtctgaactcctcagaggagcagagaaagaacatgaaactgatgagtgaagggtccaaggctttgcgtttagcactgctacttagtggctatgtgaccttaaaatcacttcacctttctgaacttcagtttccctacctgtaaatgatattgtgagttttcagtatattcaaggtctgttctactaactgaaggtctgtatctataaatatactgtcaagctgtatctccaatcacaacttaaatgcttcggctttatttgtccatacctttttgatgtccagcactatggtaatacaaagtaaatacccaacaaacacaatttgagtgatggatcggtatagctgttgaatctgtcttttcaaatttcccccagaaatatccatctctgtagttttatactgatttttttaagccagtgaacctcagacatttttacctgcctaccatctctctttagaatttgtgcatgtatatctacacttttaaatagccacagtttaaatctctctctctgtctgtgtgtgtgtgagagagagagagagagaaagagagagagaatgcaccatgtgtgagtgtgcacatatgtatctatagtttgatatgtatgtgctattttgggtgagtaaagtgggattccatatggagggagttactatactttgcactaaaatgaggctttagacaacagaatgagattatttttttactccctcttccagagttttactgaaattaaatgggtgtgtgtctgtgtctctgtgtgtgtgagtttgaagtgaaggtagagaggggtgtcctaatattgtagacacagtattcccttctttcatgtattctttcttatctttcctgttttccttctttccctccctcattctctcccttcctctctccctccgtctttctctttctttttttctttatttctgtttccttctttccttccttttcctcctttacaggaacaaattaaagaataatgccattctttctactttagtcaatgacgttagtcagtggtgacttttgtcaccatttaatataaaaaaaaagagaagcctctgtatgagaaaattctctcaaccaatgaaatcccagtataaggtcgtattgaaagacaagtaggtattttgttatattaatatattgaagaaatgtattgacccatcgtggtggtgatgaaaaccaaattattccactcaactaatgcccaagattaaaccactttcaaaatatcgcttaagaaaatcaaggagtcgagttacagacatttggggagtgaatagatgttcagaaagtttggtgctgcaccattttattgcttaatatgtgtctggagtcagtatgcattgaattctttcaaaatgagttacgcacttcattctcttcctaaagaaaggacactgtacatatttaaacatttttcttcattttggaatgctcagagccaccattacaagcagtgtttattgcaatatgctttgactgagaggtgctgtcaaaagaggctattgagctgtgtagagctacttcggtctcaaccctgtggcttctggactcttggtctgctttttaaagatagtttttccatctctctgagggtcaggctgcccctgaccatgtcttactgtgatgtgcatatctgcctgtggttcttaaagctccactccacctcccactatttcagatttgctgaatctaatttattatgtaacaagcacatgatcttattaaatgttttaaaaaatcaatagaaaatacgatataaaagtgggctccaaaggctctttttgcatatttctatattcttatgtaaattccagaaacttttggtttctggagaagtgttctccagatcactgttcaattctgataaggaacccacctttctggtttgaatgtgaactcttccttctaaacatgaagagacaatattgcccttattccttcaggtgcatggctaccaattccgctctctcatttgtatctgaccactcggttcttgttttgcagtccccagtctgtcccagatcgtctgaggatccgggtgaacaaaatcagtttacaagactatgaaggattccactatgacaaggagaaactccgagaagcttgtaagttggaagtgcctcattgatttcatgcgatcagcctatcttcagcttcttgatcctccttggtttgatgggtagattcatttatccttgtgcctgaaaatcatggttagagaagtgaagtgaaacacagtaacatgtgggctccaagtgataatgtatgggctacagaaaaaggaactggaaaaggaaagcagctgaataaaatcattctgctgtggatgccaagtcaggatctcttggcttattcgccactttagtctcagatttgcctaaaatgaggaaagcaaaaagttcgtgataccaatggtatagcaccatccagaaaactcttgagacaacacagatctcttcttggaggctgcgttatcaaacactgccctcattcgtcacagagatgtggcaaagaggcacattcagcacttctagatattatgctattatataatgtcagagaagggcctacgggaatgttgtgatattaaagtgattcattgatgatgaggtgccattatttttgaaacctgcacttgagtcgacgtatgaattacttctcaaagtttgtattttctgtatgcttctttgaatacatagctaattgttagttcatctcactagtcaatcagtatgtattggacactttttacaatctggtacattctgatcactgcattaaatctgtctgtataataatttatgaggtaattggttaaaataagccagaagttaagaccatgagagtgttagatattagggttctcggctccttcctaattgtgggggccaatagtcaactgcaataaagtcaaagaagataaggaaaactggtgtccaagggaataggcaatgatgctgatataaagaaatgacttttatatggaaccaaagacttacgaacccagtccccaaatggtctctaagtgtagacctggctacctgtgtaaaagaggaaaatagttagaactggcaggattaatagtaggaaagccttcctgggatggtcttttctgagctctggtttctgagactgatctgaagtaagctttagtggatggaaattctgaggtccaaggataatcccaggggtgggtacagagggttctacaatctggagttgccacgaggtgaggagccatatccctggtagcctaatcactgaatctactagagaatttgctgtgaattttctttcttaattctctcagctgcttcagcttcctaaaccctttatgttgttttccttagacatcaatatcttttaatttctccccagccttctcacttccatactttaccctcatttccttttataggaaagtgtgagctggaggaggagcaattccccaaacctctgaatttcttccttctgtaaacaacatattacattttctaatctaagtgaacttataagcgacagactagcatataatctgtttgatccataaagtgttagacatatatttttgcgatgggaagtgtagctacaatgcaaattaaattgagttctaaaggttactaatcataaagaacagtgttttatgttctttcttgtttgaagcttccaaacaaatagctaacagttcttaaaagaagataacagatctcaaataatattttgcagcttacgatcaactctgaagaaattcaatttggagtggggacacatttgaaatttttagctgaaatgagatttgaagcttatttatagctttcaattatctgttttatcttttctgtggcattatctgtctaccattcctggaggtaattgtggtttgaggttttccaacaagatgacattttctggcaagggctttactcagcatatgtgataaaatttctatgtgaagaaacttcttaagtcaaatatggcataaatgtaagccaaataaattgaacagtgtctttgggaccccaaagaacacatatactctctaaaaggggataaaggagttattctaaagatgtaaaaattcattccaatgatttggatttgaagaaaacaataaaagaattggaattaaaagtgaccaactcaatcattctacttttaatatgcggtgatggtgcttctaactgtggtttttcaggaaagtttatcctttgaggttctggattcactcctactaacctttactcttttgcctggttccaacttgaaacagaatacagattcatgggaaggctgacagggctcaaactgagtataaagacaaaagcaagcttaagtccatatatgaggtgcatgccaaaataaatgttatttcagaagcattaattaagtgaaatttgcacaacacatctagataaaagggactctaggaatgtactctgacctgcatcccagaacaaagagagtgaatcctcttaggtcattcatttattgtcatcaatgactgacctagagcagtagcatggtactgcgtttgaagttagttccatttcttgatggtgtgccaagtgatatcttcaggcagcatgtggttcttttccatcactgtttagcagaatcttgctcattgttcccgttagataacaagctcgcatgtttgtcacctaacaaagcccatcttccgtccataatgcagggctccctgacaataatggatggcagccctttaaattgctttgcttattttagcacagagaaagaggactatactctttcagatatttcccattcctcttccacttagccccatctcactggggggcaatccttctaaaataatatcccggaaaaatttagtccttgtcaatctttccctcagctcttgctggtaaatttcagacttatgtaagacactaaaagtcttcctcactccataggatttatcaaccctcagataatagttgtggtttgcaagaggggacagtctattcaacttaagaggtagaacataaagagaaagtggccatattaaaaaaattaaagcaaatctgtaataatgatatcagaaaatcactctcataaacagaagtatacaagtgggtccttaataaagcttataatcatataatctaggcaaaggatgatctgtttttaaaaatctgttgtatttctaaccccagaagagattcactgacacatgatatattttttaaaaatctgagataacttgatattcccccaaatttaactctgttcccatgcaaactggttaaacttcagtttgagcaccagtttattctgcacttttaaattgccatgataatttacacagatctagggtttaaaacacaagcagtagaaaccagcttgaagccaattgaaaacagatgtagtctataaggatagggaattaacatttgttgtatatcaaatacagtgtttgacaatgcttttacatacatgatctcagtataattcagtattatctggatgtttataacatgtaatgcataatatatcaataaatagggtaaaatcctagtatcgttagtgttaaccaaactaggtatttagttaagcatttgccctaatggaatttccttgtttggtgatttagtagaaaagtcagaaattttggtgtttgaatctcagttgaaaccttgacaaagtcatttaatttctctgatgatcaaatctctcatctgtaaaatgaaaatataattataaccccattcagtgctgagggttaaatgtaatgctgtatatggaacccttggtgtgaagtctggcacattagtgtgctctccaaaaatggtagctatgatgcttgtggtggttgttgttagagaggccctgctgtcatactgctcatcagtcttcaagtccataaaaccagactcaaagtaggtcatagaggctgacttcctctatgtagaactcttcctggcttgaggcagctcacttcaaactgcacacaccaccaccctccaactcactttcttactttcaaaaatagaattgaaaatactggtaaatatcacagaaagattatgggaagaaagtgtaactaaatcattcaatttacttttattgtgtctacttgtgtaaacatctgctgtaatgacaagatacttaaatctatgaagcatgtaaatactgaatgcccatataggatgatctgaacgtttacctgcaaatttccttccttaagtcctaatacattctcttaagtgtgtcatctgttatccaccactgaattttttgcaacaaatttttattttggaataattttagatttacaaaaaagttacaaaggtaatacagggcattcctgtgcattcctcccccagtttttctcattgttaaacactttacattaccatggtgcgtttgtcaaggaaactgatattgctacattactattaactaaacctttggaatttctatcccaggatcaaatctaggataccatattgcattgagttgtcatagctccctagtctcttctgatctgtaaccgtttctcagcgttctttctttttttatctttctttctttctctctctttctctctctttctccctccctcccgccctctctctctccctctttctttcctctctttctttctctttctttctttctttctttctttctttctttctttctttctttctttctttctttctttttcttttctttctttctttctttctttttcttttctttctttctttctttctttttcttttcttttctttacttttcttttcttttctttttcttatgaccttgatggttttgggggaatactgcttcctgtagaatatcttccaatctggctttgtctgttgttttactcataattacactggatttatgggtttttagaaagaatactgtagaggtgaagtaggctttttgccccatcatgtcaagacttatgtgatatacacatgacatccctggtgatgttaacctgatcatttggtaaaggtggtatttgccaagttccttcaccatagacttacaattttttccccttccctactctattctttaggaataagtcactaagtctaacccactttcaaaatgatcagaggaggtggatcaagattttttaaattgtttccagtttgcatatttgagctcaactgaatttgttaactatgccaaaatggtagagccattcaaccattcatgcattcatactttcaataattacatgtttgcatcagttatatgtcagataccacactagatgttagtcattgaaagatgaaactagaaaatccaacattataacataatttattcagtgtacctttattgagtccttaccgtgagcaggggttggaagaaaaaaaaacaacagaattcgttcctgattttctggagctttttttctttttttaaaaaatgtgataataactgtgatggggctatggaaacattctgtacctatttttctagcaaacgtcatttaaataatgaaagaaagataaaatatataagcaagaatgagaaaatccagtctaaccactaattaagtgtgtgaccttgggcgatgcatttgtcttcttcaggcttctgtttccttatctgttaaatgcagtagttaaactagacatttcttaagaacagattataatataataaatgtttagttttatagaaattacacaggattaaaaaatttttcatcagcatatttccttagtagagtttttaaagctccaacatcattcataatgagtataagcattagaaaccatgtaagtacattgtgcttcaagagtttgctaaaaacactgattttttttccctatcaatagcttcatctaaaattgaatctttccccctcatttaacaagttgacaacagggctgttcagtagagattaggcctccatttggtggaggtaggctttccaagttgaaatctgtctgaggagttaaatgatgtcaatttgtcctctgaagggcattgtccttcctttttgcaagtgtgtttatgtttattcctattttcacgatttgacatttacccagagtttcgtgcttagtttcttttactgtcttttcccatctcttgtctgtctcttatatttatcattttattaaaaatataataataataatggttaacacacatcgtactattgctgtgagctaggaaatgccttttttacatatattgtgtaatttaactcacccgacatctcagtgtgatagatagtactgttattcccatttcacatataaagcaattgaggcacagaaaactcagacagtctaaggggctgacattttgaatacttatttaatcactgtgttttctgcttcctccaagtagtacttcctatttttcatataaatgtctttaataacataagtaaaaatttacatgtcagtctttcacaattccatttcaaatgtcttcttacatttaaactgactttgacttagtttatcacactcaggtttgttggacaagtttctgtttttggatcttcctccaacctcaaatcagccattcataaattcaacaaatattaattgactgcttaccttatttctagtactatttcaagtatttctagtactatttcaagatacagaaaagtgcttgcccggaacttatgttccagtggagagacagacaattgaataaataatacaatatggagcaagatgctataaaggaaagtaaagcagaacagtgacagaggatcctgtttttgataaggtggtcagcaagagactttctgaagaagtgacatttaaagagagaccagaacaaaaagagtgcatgtatatgtggatttctagaagagtatccctgggcagaggaaatggcaagttccaaggccaagcatccttagtatatttaatgaatgtcagggatgtccatgtgactggaacctgcttagttgaatggagatagtcaggaagttcttttaaagggtcagcacatggagggggcttataggcatggagaaggctttggattttattcaaagtgtaatgagaaggtgttggaactacttgaggagtgtatcatgcctgaatttattctagataaatttggctactaggtagaacattttcaggttgcaatgatggaaatagggcagcaggtaccaggctaatgtgatactccaggtgacaggcaataggaatgagagagttaaagtagtagagttggagagaatcagttggattctggctacattttggaggtaatgctggtaggatgagatgatggattcgctgtattgcataagagtgtaaaattcagttgcctctgatgttttgaccttggcaacttggtaaatagaggtagggaagatgcagaggattcagcaaaggagaccaagaaggagcaataccaaggaggagcctatggttagctacaaaaacagcaggagagcttgttcattggaatcagagagaaaaataactcataaaagctgtctagctgtcagcgtttcagagaagttgagtaagatgcacactaagaattggtagttggattggagtagagggtagttagtggtagcctcacgagattgtggagtgaaaaatgtgaaagtgcatagagaggattcgtgtgcaaatagggtcaagtgaatgtcagatgtgagctgcataatgacatcttgatcaatgatggactgcatatacaacagtggtcccataagattttattttattttattttttttaattcttcagctaaaaccgcggaagaggtgatttattatatggttgttacactcggccacaaataaacacagaaatagtccagaatgtcacaggtccagggcagaggaccaacatgggcattttgttcatgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgcagaggtttccaaaaaaatggcgctaaggccgagagcaagattttaataccatagttttactgcaccttttctatgtttaggtattttagatacccaaatgccattgtgttacaattgcctgcagtattcagtacagtaacatgctgtacaggtttgtagcctaggagctacaggctataccgtatagcctaggtgtgtagtaggtgattccacctaggtttgtgttaagtacactctatgatgttcacacaatgaagaaatcacctaacgacatgtttcttaaaacacatccctttcattaaatgacatatgactataattcaccacagattgctcttttaaggtatttaactataaaactaaggaaagaaatgggatgatgactataaaagaatatagtagaatcaaaggaggattcttttttttaatttgtaagataatacagcaagtgtgtatgctggtgggaccaattcactagagagagaacttgattcagaagagggccaaatgcaggagcagtgccttcgagtaggtggtaagatggaacctggtgagcaatagaaggttgtgggcaggaatgtggggcaggttctcccgagtacagccagagaaggcagaggagggagtacagatacagatagcttggtgtacttggtgctagggagaaacagaagttctattctgattgcttttattttctcaggaaaagaagaagcaagcttactagttgaaagttggaaatggatagtatcagtgttctggaaaaaaagaggaaggtttgaaatagcttgaggagagagacagtgacagggttcggcagaattgctgacctttactttggaaatggatgattgaattcattgtttttttgtaagcacatagagcctgacttgccggtttctggctgtcttggtttatagatgagcctactctatgtctttctaatttcaaaggactctgatacccggggaatattgggccaaaatatgatcttattattaatataaacttttttgccatctaattctgtttatgacctaaaggctttctttctttataagaaaataaaatatgctctggtgctgtgctatattagaagttaataatgttagatttcagacaaagaactgggcctaaaatgatgatgatatttgatccttccttcactgttaaaacttagcctttggcaatgagagcaatcaattgcaggtagatccttaagtctctgcccaaaataatattttctcttttcattggtttattttatgtaacacatactcaaaattatggccaactcttactatttatagaccagcctagtccatttggttgctgtcttaccaggttgacaactctggaatgtaagctcagatggtagttagacttccctttgaagactttcttctaagatctttgtataaaattattactttcattcatcttgctaaggtttgagtagtgcagtgttggccattgcagagtcacaactatcctgtttaataataaataataacatccaatcattgcatagggcttcatggtttacagagggctgttgtatacactggccacatgcatcattacaaggacacttaagattgccttgcacagggttacattgctgtggtgggattttaataagaaattatatattttctctcttaatccagggcactttctagtatacagcctacttctttataaagacaaatttaaaagaatttgcggtcataggtcttgtcatcatttgagtttctggggaaacagactgtgagactgagttttgtgtacaagggttttattgaggatttcccaagacggaaccacagctgtgcagggcaagaaaagtgggaccaggaagagggagatgttgaactttgctgtagtcacaactgaggactcccacagggacctttggacctgggacagccattttgagttttctaaattgaggcaagggttattggacacagatcaggctctgccctggaaggggataaaccttgagtgaggtagcagcctttctggagaaggactcagctgtgcgctatcagcaaacttttagcctctgggaaaatgagtgcctcaatcctaacatgaatgcattgcttcagttccgaaagcagagtcttgctatgtattaataacctgatttttgaactaaggccaagaaagagccacccacataccaaaatccttgagttcattcattcaactcttcatttaacaacgatctattgaacacctactatgtatcaaagactgttctaagtgctggaaattcagcttcagtgagtgctagctctgaagtgtttctcttgttatatcttttaacctgatttccctgctatgccaaattcagggaattggagtacaagttgattattcagaagtgtctgaattagcaaagtaaaatggaaacctaaaaggtgaatgctgacctttccttaaaagttctttctgatgaattattgccaagccaaatattctccatttggaatttgagtaattaaaagtggaaacctgaatataaagccacctcaatttctggctgtcacttctagtctgacgctatagtcagcagagaaaacttcagagtttgattctcaatgggatgtgtattttttatatattcatttcttccttcactgttaaaatgtagcctttgctaataagagcaattcattgattgaactaaacagaatcaagggcggaagtgtaagctaatctgaaaataacatctttgcagattgactcagaaccacaattttatgcactagttacgtggataaaaacttcaggctttccctagttcacactggtggaaaacagtctttctcagtaccgagtgggtttcctgaatcactggtccactgccagtctcctggagtcatctgtaagcagaattagagatgtccccaggctgtcagctgctagggatgtctttgtttgagactgccctatttcacatctcctcatagaagctgtccatgtataatttgtttattcattttatttcccaaaagaggcttggggccccttcagctgattttagaaaatttttctgtcatgaattcttcacatgtatctaatcaactcagaaattccaggctgcatgactgaatgtgtccccagcatctagttgttggtgaccttgaccatcaccctgcagtgtaacagacagcatgatgtagaaattgtgaaagagatttggaccagtgtatctaatcatcatttcaagtattgaagttttaggtatggttgtgaatctttcctttcagacatgtaatatttcatcttgattttcagatgtatctggctagcctggccatgtagccaagattccagtgtcacagtcaagcctttgttatctccctcccaagtacttgagcactggtagtaaatatcagtagtggttctttctgtgtctaagaattttacgaatattcatttccattgtcaagggcatgctaggacctcacagttaaaagcttatatcacatttaacaccaggaataattgccaaaagattatatacatcatcttgttgtactagtactttattgcatgcaacattaggaaccttctttgaaatggaattatcttcatcaaaagtaggcatttacatcattgtcattaaacttacatattcagttggacaaggatgacatgtcatagcactatttggtctggacctttggttcctactatgtattagaagagaagtatgtgggccttctgcccatacttgctcctggataaccacggtcaatgcgtgaaccgcagtcatcagaagtaggaaaaaggccattacgaacagcatccatgattggatctcatgctccacctgacaacttttgtctttgttcagaagaccaggctttaacatctcctttttttttctccctgggattttctttctcatttctgcttttccatttatcatgtcatgaatgccaaagatttggaaagagaaaaagaaaaggatctgttactaactcctgaggggttgtgggctgggcttcgatgggcacctggagagtgtagtgttccctttcattctctttcttctgttctttcttctccagccttcagaattttctttccccaattctgtctataacacattctaactcagaaaccattttcttgtattttaggtgttatcaaactgcctttgaggcattgacaagtggtctttgtcctccatcatcacagttttcactaattttacattattttcacagtctctctgctgccgccttctttgctcttttttgctctctccagctcagcaggccacaagtccatggtgttaggtaagtgtatcagaaggttgtaacccccacagctatgcaaaacgacttcactgtcactcttgctccttttccctcttcccatccaactggccacagaggagttgcttccttggacttcgtatctctctcatatgcccttcccttcttgtctttctgccactcctctattccagacctcaccattgctcagctcattgactgtattcgcttcctcactcatcctccagtcactcacctaatttttcatcaatttgtcttccgtattactcccaatgatttttctaacattttgtccaagaaaaaggtgggagatttttaggcactgagatgagcgagtggaaaagtactggaggatgttgtggggaggttggtcaattgccaacccattgtatctgattattgtcatccatcaagtaagaattgtagttttttgataaccttggcacatttgaaactaacagaataaaaggaaagattccacttgtgtttacatcctcccttaggaatttgtttcttttctctactcccctgcctctcctccttgagttccttatttccaccatccttttgacttcctgagtaatgtgaatgctatgagtaacaaaataggtactgataattgttctatgtcaggatgatctcatcagcaaagtatctgtccatagcaaactcagaacagtttctttttcttttccctttctcttgatttttctgtaactaggcatctgtgtttgctaattgtctcttattaccaataattatttaggctcttacccacccacagagcctgagagagaggggctctgtctttcatgatgtttacatttcaaaaaatgacttctagctcctggagaaagacattcctgggttgtaaaatttggcatgagtctgggagcagatttacatacatctcaaaggggcagagaaaggatttacaatggaaagtttgctaaagtaaatgctctaagaaacaagtgttcagagccatataatcaagaagaaacctgtcggccgggcatggtggctcaagcctgtaatcccagcactttgggaggccgaggtggacagatcacgaggtcaggagatcaagaccatcctggctaacacggtgaaaccctgtctctactaaaaatacaaaaaattagctggacatggtggtgggtgcctgtagtcccagctacgcaggaggctgaggcaggagaaaggagtaaccgggaaggcagagcttgcagtgagccaagattgtgccactgcactccagcctgggcaacagagtgagactccgtctcaaaaaaaaaaaaaaaaaaaaaaaaaagaaacctgtctaaagttccatcatgctaagggaaacatgaaggctgttttggtcagtatacatctggaaccttcaccttctgttggaaacctattagtatctacccatccttttgagaataaagtctcaacttcttagtataaaaatcaaacctctggtcttagcctcaccctactctactctgtacctacctaccttcctaattcctgaacatttccttttcttcttttcatgctgtggttccttagagcctaagggtggtctgagataatttccttttgtctcaaaaactcttgttccttttgtcaaaccaccttattttcttcacagctcctcgtggaagagtgtctggtcttggggaatgtgtagcccttctggattctaaacacgtggagtacatgtctatccaattcctgccacaaagatatcatcagtaggatgttttcatgtactcccctcctcctccaattctgtaaactccttgagggcaggtaccatgtcttactcagccttctgtgaccaactgctgacactagagttgtccccagcaccagaaagtccttaaaacccgtttgctaaaatgattaagtgaatgacttatagacgtgaaaaatattgtggcataattctttgtatatgcaatatatatttaccaaattaatgaagatagaaaccatgagttgctcttcaagattatcaatgccataagcatttaagaggattttttttaagtgagttgcatgttccttatgttgcccacttaggtagtatactatcatgataaaagcagaattggatctgtacttggaaacccaaatttctagagaacctgttagtttctggaaagcactcagaaatcttatccttgaatagaatccaatgaaaactacataatttacttttatcttgtggatgacatttttaatggactatagacaggacctggtttagctcaagctagggaatccaaactctataattacttttaatcgtaaggactaggagttgtgaaactgctgacaggtcccagacatggcatggcaaggtataaagttcttgggatgttatgtttccttttgaatgctaatatgcccattcgttgctccccattggttccaggtgagcagtgggaaattaatgatgaccaggtggttgtaaaatggacctgtgacccacagcagggaaaaactggattgaaataccatattgcaaactgattctatctaattcttatcagccatcaagtaagaattgtagttccatgataaccttggcacatttggaactaatgaggtaaaaagaaagatcccacttgtctttacatcctcccatattatatttcctatagacaaagtatctgtctgtagaaaactcagaacagtttctttttcttttctttttctcttgatttttctgtttctttttaactaagactatttttcagagcagttttaagtttacagaaaaagtaagtagaaagtacagagaattccatatatcctctcaaccctcccctaccgcaacctatccacacacagttctcccctttattaacattttgcattaatgtggttcatttgttactattgatgagccaatactgatacgttattattgcctgaatcccatagtgtacgttaggattcactcttttgccatataattctatgggctttcacaaatgtgtaatgacatgcagtcattattgtattgtacagaatatttcacaaggaataccttgtgttatgtcttttcatttctcccttcctctcccaagcccttggcaaccactgattattttattgtcagcatagtttttgccctttccagaatttcacataattggaattatacatcatgtagcctttcaaattgccatctttcacttagcaatcttcatttaaaatacccctatgtcttgtctttgctttatagctcgtttctttttattgttgaataatactccgttgtctgggcataccacaatttatctgttcacctaccaaaggacatattagttgcttacaagttttggcaattatgaataaaggtgctataaacatccctgtgcagatatttatgtggacataattttcaactccattgggtaaataccaaggagctgatgctagattgcatggtaagagtatatttagttttgtgagaaactgccaagctgtctttcaacgtggctgtgctgttttctatttccaccagcaatgaatgaatgttcctattgctccacatccccaccagcatttggtggtggtggttttttttaattttagccattctattaggtgtgtagtggtatctttgttgtttaatttgcaattctctgatgacagaaaatgttgagcatcttttgatgactgtatttgctgcctatattttctttttgtcagattttgtttagatcttttgcccagttttttaattggctctcttattgttgggttttaagaattctatgtattttttgggtaccagtcttttttttttttttttttgcatctcttatggattctttgttgtaggctcctagatgtggattgcagagttacagaacatttaggaatactagtacctactgtcaaagtgcacaaatttacactctgaaacaattgatttcatggcacccttgccagcattgaacattattttttaatcttattttaaaagaagtgaatattctaatttgcttttatttactaagctttccccctgtattcactcacaatttgtatctagggtaattctcctgtttcaagacagaatgaattagatatgacatgaaccaactacaacagcataaatgagatggtttctctgagtattttccattgctcagatctgattattgatctggtgagccttgctgagacaaaggttgagcttctcaatgcacgttctctccaagaggtaggagagtatcataaggagaaggcatcattatgtccatgtgggacaaccagcttccttctgtcctgtggcctcagtcttttcttttcttttcttttttcagaaatttgtgcaaaatttaagatcagttttctttttgttttttcttctatccctcccccatccccccacccccagaaaggccccagtgtgggatgttccccccctttgtctatgtgttctcaatgttcagctcccacctatgagtgagaacatgcggtgtttggttttctgtccttgtgatagtttgcttagaatgatgggataccagtcttttatcagatacgtgttttgcaaagattttcacccagtctgtggctaatttttcattttcttaacactctcttttcacagagtggaagttttgattttaatgaagtctgacttaaccatttttttctttcatggatcatgcttttggtgttgtatctaaaatgtcattgccataccaagcttatctagcttttctcctatgttatttctatgttattttctagggaatgggttttttttaaaaggctattggtttcttaatactatgcataggttgattaaatgataccaagtacttgcataaactctattgattatgttagtaaatctaaaattgatgcttaaggaaatgtcaagtttttaaaatgtgtatatacatagtgttaacaagcttattctaagatgactatattttgatggtttaccatattgttcaatacctttcctattttctgactttttaattctgtgattatatttattgttcttttcagaaggtgataaccttttttaaaaagcctccacaattcatatatatatttaaaacttaaagcccagtctttgcaaacacagtggtttctgagaagcttttctctaaggtatcacacgttcttataatgatcctattgaagatagtttgtttgtgctttgaataggtcaatggcttcatatggctgcaattctattttaacagtaattgcactgtaacagcaatgtcacataattaaatctttttaaaaaaatgctgagctctcagctctttatttccacaatgacatcttgttgaacacatcatggtaccttgcagagaacgaattaactgctgtgtgttttctccctttttataaatcccattatcactttcacatggacttagtgtgaaaggtggctctttctgctttggctcttagggccttggcttgtgtcatcaagcaggcagctgtgattcccctcatctccttgtaggtttggttgattcttttatttacatgctttagtttagactctagagactttggcacaacacattatctgctataaaatgttctcacatatagtctgctgaaattggtttgggaatttatgaaagggcagtacatgttgataatagaattaagggtaaaaatgatgaattaaataaggcttagaggagtgaatataggatggtttttataggtaggacttaatcttcacagtaacccagtggggtagataatatgatctttctcagtacattgggcctttacatactatattgtaaaagaaccaaggggaagctaagctcattgagcaataaaaataatcaaaagtatctggaatcgtaattttcctgaatgtagttattgaccaaggataattaaacattaaaatgaatggtatgagaatatgtactatagcaaaactaccaaattgataatatcacaggctagccagactgaaaactaatactgttaagtaaacacaacatcaaaaatccttgggaaacacctttgaatagcttgtgcctctgatgtcatgaacttttcacacctcaagtgagaacgtgggttttgttttatgtttggtttgtgttaactgtcattgaggtcttcagttcagtattggaaattctgttgtaagaattttaatagcaaaacaagtcacagtgattttctgtaataatcttgattaaattctaggtactcttgttatctctattgtcccaataataattagcatctgctcacaattgtatagttgcatttctttgtaaagtaagcaatacttactttaattctgtgacccctaaattacagacaaggttatatagcaaggctgtcagcagttttgataagcttgagtcatggtctataagttcacctgaatctggcctatcggaaaaggagaggaatggggagcctttaaaaatgaccacatttctgccaagtatgttcacgagaatgtgtctgacttcactggtagtttctgagtctgatggttctggtcctttgtccaggcctggagatgtttcctccctgtttacagcctttccctagtgcttgtgaagctctacatatgggactcgtgagtccatcctcagctgctggtcagcctgtcactggtttgtgccttcacttctctgagctcagtgttgaaaactagtagaaactccatccttatgtgcagcccaagttcaatggaaagtaggaatagttcagaacaggggctcttgagtaagagaaacctaggatgaaagctggtgttccgttttagtggttgtaatatttagggcatgttatctatctgagactcattttcctcattttaaaaatagaaataatgacatccatctctcaggattgtggcaaagattaaataacacagtaaaactggtatattatttatgtgaacgtaggttattttttctccttcctccttgccctcccttcccctttctcctcctctccttccttgttcttcctcctcctccatcctcctctctttttcctccattttctcttccttctcctcctttttcatatcatgtaatcagtattatcattttcatgttcatccatatttgttccacccctccctaaatttatcatatgacacaatgctatgcaacatgacacacaattatgtatctttaatatcacatggatttgatcatactcccagatcgcaggcaatggaagtctgttctggcttatctggcttttccagaagtgtggagtatgattcactcacgtaagaaaataaattacttcagctactctgatccttctctcaatgctacttccttgaacccccaggcttaggccctgtattagtccgttttcacactgctgtcaaagacatacctgagactggggaatttacaaaggaaagaggtttaatggagaaccaacagttccacatggctggaaagcctcacaatcatgggggaaggcaagggggagcaagtcacatcttatgtgaatggcgacaggctaagagagggcttgtgcaggcaaactcccatttttaaaaccatcagatcttgtgagacccattcactatcatgagaacagcatgggaaagacctgcccccatgattcattcatctcccaccaggtccctcccacaacatgtgggaattatgggagctacaagatgagatttgggtggggtcacagagccaaaccatatcaggctccaagcagctgtgcccaggaaaagtgatcctagctcaattcagcatctgggagctcatgtagttggcatgtgtgttaacctcagagttccatctgttgtgaattttcattggcctctacgcaattcagcacaaagatgctgtgctaaaggttgtgccagaatgaaatttgctttagacatccctgggtagggcagtttaacctcagagtcggtctacaagggtcttttggctttcttcaacaaataattcacttgaggaaattatttgactgtcttttgcatcataccaactgaatcaagttttcttaaaactctacactgttgatgggaatgtaaattagtatggccaccatggacaacataatggagcctcctcaaaaaaactaaagatagattaaccatatgatccaggagtcccactgctgggtatgtgtaggtacaaaagaaaggaatcagtatatggaagagatatttgaatgcctgagtttattacagcagtattcataatagtcaagatgcagaagcaacctaagtgtctatcaatggatgaatggataaagacaatgtggtatatatacacaatagattattgttatgccataaaaagaataaaattctgtcgtttgcagcaacatggatggaactggaggacaggatgttaagtgaaataatccagacacagaaagacaaatagggcatattctgtctcatatctaggggctaaaaaagtcagtctcctgaaggtagagagtagaatagtgattaccagagacttggaagcgtaggggtaaggggaagtgaagagagtttggtcaatgggtgtgcaaatacaggtagatagaataaataacctttatggttctatagcacaggtgatagtagttaataataatttattgtatatttcaaaatactaggaagagaagattgagactgcttctaacataaagaagtgataaatgcttgaggtgatagattgcttaattaccctggtttgatcattatacattgtatacacatatcaaaatatcacatgtaccccataaacgtgtaaaattattatgtatcaataaaaaattaacttaagaaacaactctaggcacctttcattgtaacctttaacaacattggtttataaagctttgggcaattcagtctcatatatagggtccctgagcttgatttattatctggctgtttacaatttgtggtgaaatctatgttttataaattatattttgttatgttttatcttggtgtatatagactttaaaagttttttatgaatataagagtataattgtggattggttgctagaagattttgaatttgctgaggttgaatagttttcatttatgcattatttggcataaatttgcataataagttcaagtagtctaacttcaagtatagaagacaaaattaattagtgtgacctgtgggcattttacttcaaacgtaaaatccagagcatgcacacgtaaaatgtataatggatttctcaaccaattaatttaatcacagtctggattatgagacatttaaaccaacaggaaatagggaaagagggttaatggaggtcaggttgaagccatagaagggtgctagggcaggacttatattttggctggaaaggggtaatttgtagtataattttctcagggcttaatatcaccagtaaattccacagtgtagttcctattacctgaatttgtcaaagcttcctcgttgttttagtctgctctggctgccgtaacaaaatactatacattggatggcttaaataacagacatttatttctaaaagatctggaggcaggaagtccaagctcaggatgccggcatggttgggtctggtgtgggctctctttcttgcttacagacggctgccttcttgctatatcctcaaatttgtgtgtgttagtccaggttctctagagaaatagaaccaactggatatgtagatatgtaacaggacatctattatgggaattggctcatgcaattatagtggccaagaagtcccacaggataccatctgaaagttggaggaccaggaaagccagtggtgtaaatcagtgcaagcccaaagacctgagaaccaggggagctggtggtatatcttccagtctgagagcctgataactggagtgcaggagtgggtatcactggtgtaagtcctggaaagagaaccaggagccatgatgtcaaagggcaggagaagatggatgtccaaactcaagaagaaagaattcacttttattccacctttttgttctatccaggccccaagcagattggatgacacgatgacacttgcccacattgacaagggtgggtcttctttactcactccactgatacaaatgctaatctcttctggaaacactctcacagacacagccagaaattgtgttttaccagctatctgagtgtcccttagccaagtcaagttgacacataaaattaatcatcacagtgcgtatatacaatacagaggtttaaatattagtagtaaaataggcaccggtgtacctgccacttagactaagaaatagaacaagtaccacccctcactgttctactgggataactactttactcgttgtatttgccattctcttgataggtatatatttaccaccaacgtatgcatccctaaaccagatattgagtggttttgaaaaaactaagtagcagatctaaatccccctgtgtaaagaaaaggtgatgctttcacttttagcttaagtttcccaagaaagctgaaaagagtctctagttcattgttgagcttcagtttttctgagagtgcacacggactcattctaagagaacttagtgggcaaggtaatgactgactcctgggcagtccttggcaggtgttaagttgagttctagctatcaaatgaatatattatcacagggaataggcttctttgaatttttctgcttcactatgatccaactcttgctgtcaggaataggttcaggcagagcatgtcagggggtaatatagtgtcaatatattttatataacactcattcgtattgcaaattcaactttattggggcagataacccagtagcttcttgacagatcatgggtccttcattcaactcttgcacttgtttgattgtttgggttatctgtaaaagtcttagaactttgaaggtcttgtttcattgtcttccttactgtatggttgcctttgagaagttcaaaaacattccaaattttaatcctttgtatataatctggtttttcctttctataagcttgtagattcttccttttgtccccagtactcttcaatttcaaaacaagatgatgttatattgttctgtagttattgtgcttggcatttgatgaatcatttcagtttggaaactaatgttttaggaaatattcttcattttgttttttatatttattctctattttcttttgttttttgagactcgtattatggggatgttttttgaaactcctcttattgggacctcctggactaggtttctaatttttttagtttttctctcctactttctatctctttttatttttgctctacttttttagagattttctcaactttatcttttaacttttctaatgaggtctctatttattttatcaaatttttattttcaaagggttttgtactcttttattctctgaatgaggttcctctttgttttccttcatattctttgtatcatttaatattataatttttccatttcttggaaatttccattccattttctctcaactccctgaggatattaaagatatcatgtttaaagtgtttttctttgcgcaagttcattttctatttttaaaaaaacttttagattcaggggtatatgtgcaggtttattatacaggtaaattttgtgtcacaggtgtttagtgtgcagattatttcaccacctaagtagtaagcatagtaccagataggcaattttttgattgtcacgttccttctctctaccatcaaggaggccctggtgtctagtgttcccttctttgtgtccatgggtacacaaaggtggggaatatttgtgtcctacttataagtgagaatatgtgatacttattaaatagatttctgttcctgaattagttcgctgagggtaatggcctccagctccatccatgttgctgcaaaggacatgatcgcatttttttttaatggctatgtagtattgcatggtgtatatgtcccacattttctttatcctctctacccttgatgggcatttagattgattccatgtctttgctattgtgactagtgctacagtgaacatacacgtgcatgtgtctttatgttagagtgatttatgttcctttaggtatatacccaatagtgagattgctgggtcaagtgctaattctgtttgagttcttagagtaattgccaaactgctttccacaatggctgcaataatttacattcccattagcagtgtataagcactccgttttctccacaacctcatcagcatctgtcatgttttgactttttaataatagcgatttgactggtgtgagatggcatctcattgtggttttgacttgcatttctctaatgatcagtgatgttgaacttttttttctatgattgattgccggatatatgtcttcttttgaaatatgtctgttcatgtcttttgcccactttttttttttttgtaaatttgtttaagttctttataggtgctggatattacacgtttgtcagatgcattatttgcaaatattttcttccattctgtaggttgtctgtttattctgttgatagtttctcttgctgtgcagaagctcttcagtttaattaggtcttatttgtcagtttttgttgtttttgttgttgttgcaatggcatttggtatctttgtcatgaaaactttgccaagtcttatgtccagaatgatatttcctaggttatcattcagggtttttataggtctaggttttacatttaagtctttaatccatattgagatgatttttgtatatagtataagggaggggtcagtttcagtctctgcatatgactagtcggttattccagcaccatttattgaatagggagtcctcttcccattacttgtttttatcgactttgttgaagatcagatggttgtaggtgtgtggcactatttctgcactctctattctgtttgatttgtctgtgtgtctgtttttgtaccagtatcatgttgttttggttactgtagccttgtagtatagttttgagtattgtgatgcctccagctttttttttattattattatttccttggctatttgggatttttttggttcatatgatttttaaaatagtttgttctaattctgtgaagaatatcattggtagtttgataggaacagcattgagtctgtaaattgctttgggaggtatggccattttggtgatattgattcttcctatccatgagcatggaatgtttttctatttgtttgtgtcatctctaatttctttgagcagtgttttgtaattgtcattatagagatctttcatctccctggttagctgtattcctaggtattttattttgtttgtggctattgtgaataggattgtgttttttattttgttctcagtttggatgttgttggtgtataggaatgctactgattttttgtacatttattttgtatcctgaaactttactgaagttgtttatcagaaaaaggagattttgggcagagactctagggttctttatgtatagaatcttattgtctgcaaacagatagtttgatttcctctcttcctatttgggtgccttttatttctttctcttgcctgattgctgtggctacaacttccagtactatgttgaatagaagtggtgagagtgagcatctttgtcttgttctgatttttaaggggaatgcttccagattttacccattcagtatgatgttggcttatgggtttatcatagatgactcttattattttgaagcatgttccttcagtgcttagtttgttgagggtttttaacatgaagggatgttgaattttgtcaaaagccctttctacatctgttgagatgatcatgtagttttggtctttagttctatttatatgatgtatcacatttattgattcgtgtatgttgaaccaccttgcatcgcagggataaagcctacttgaccatggtagattagctttctgatgtgttgctggatttggtttgctagtattttgctgaggatttttgcatttatgttaaagaaggattttttttttttttttttttttttttgtctctgccaggttttggtatcaggatggtgctggcctcaccgagtgagttaggaatgagcctctcctcctcagagttttctttctttttttttttttgttaaatagtttcagtaggaatcataccagctcttccttatacatctgctagaatttggctgtgaatttgtctagccctgggctttttctggttggtaggctttttattactgattctgttttggaactcattattggactattcaaggacttaatttcttcccggttcaatcttgggaggatgtgtatttccagaaatttaccaactttttcctgtttttctagcttgtgtgcagagaggtattcatagtagtctttaagggtgttttatatttctgtggggtcagaagtgtcacttctgattgtgtttatttggatcttctctctgtttttctaccattatgtaatgttgttctttgtcttttttgatctgtgatggtttaaagtctattttgtctgaaattatggtagcaacccctgcttttttctgttttctatctgcttggtagatgttttgtgtgtcatcgcatgtgacctgggtctcttgaagacagcataccattgggtcttgtgtcattatctaacttgccattctgtgcctttgaaatggggcatttaacacatttacattcaaagttagcattaatatgtgtggatttgatcctgtcattgtgttgttagctcattactgtgcagatttgtttgtgtgattgctttatagtatcactggtctgggtatttaggcatgtttttgtagtggccagtaatgacctttcctttccatatttagcactcccttcaggacctcttataaggcgggtctggtggtaatgaattctcttagcatttgcttctctgaaaaggatcttatttctcctttgcttttgaagtgtagtttggctaaatatagaattcttggtttgaaattcttttctttaagaatgctgaatataggcccctaatctcttctgtcttgtagggtttctgttctaaggtcagctgttagcctgatggggtttcctttgtaggtgacctgccccttctttctagcttccttaaactttcttcctttcattttttccttggagaatctgatgactgtgtgtcttggtgatgatcttcttgtgtaatatttcacagggtttctcttcatttcctgaatttgaatgttggcctctctaccaaggttggggaaattttcatggatggtgtcctgaaatgtgttttccaagttgcttgctttctctttttctctttcagggatgctgataagtcatagacttggtctctttaaataatcccatatttctcagacattttgttcattcttcttcatttttttttgcttcatatttgtctgagttattctggaggactggtcttcatgctctgagattcctcagctggtcaattctgctgttaataacttgcagttgtattctgaaattcttgagttttttagctctagcatctcaatttagttatttcttaaaatggtcatttcatctttcatctgctgtatcattttattgtattctttagaatttttggattgggtgttaactttctcctgaatctcgatgatcttcattcctgtccatattctgattctatttctgtcatttcagctatttcagactggttaagaaccattgctggggaactagtgcagtcatttggaggtaagaagactctctggctttttgagttgccagagttctcgcgctggttctttttcatctttgtgggctgattttccttcagtctttgaagttgctatcttttagatgtttttttggtttttgtttgctttcattttctttggtgttgttgggtgtttgattatggtataaggtgggtttggtcaactggcttcatttctggaatattttagggggccaatgctcagctcaacactcctgagctgtgtgctttaactctggtgggctcattttgggccccctgctttcatctctggctcctcagggttaggaacctgttgccttgatgggcagtgacagccaaagagcttcactgggtggtggaagtaagatctgtgctcatttgtacatgccagaagcaacagcagtgtgatgacatgcatgctcatcagctggagtggggccctggtgagccaggggcttccagcctccatacaggcatttgcaagtggcagtaatagtgggtgcgatggggcactggcgggtgtggggctggtggtctccatgtgtgcattcacactggaggcaatggcaacatagggcagggagtggggctactgatcttcatttgagtactggtgctaacagtggtggtacagctgggtggatgggggcaggttgcgctcatgctggcagcagtggcacagtgggtcgtagatacgtcccagcagggaagggtaggcaaggtctgctggcacacacacactggcaaaatggtatgggggtggccttggatgagtgcatgccagcaaagtggtacagaggatgctgcagtggtgggagggtgcgggtgggctgatgtgccttggcagaggccactgggctggagctatttgattgtcaggcacagtcagccagcgcaggagctattatgcatgtccctgggagacaccccagttaggcatctgcggctgcactgcaagcaggagatgccagcatacaggggtcactcaggtcagactggccctgctctgttcaggtctgacagtttgcctaaggctaaagtttcctaggggagcatgggacgccttggggatgggtatccctggtcatgcttcactgtggacattgctgcaccaaaccctctgggctccacactggctggagccctgcccttaccacctctctaagcaactatcccttccagcttaagtttctgtgggggtcttgtggtctcctcctgccaggattctataagtccatggtgagagtatgtcattccttccctgctcaactcaccactaccccaggggttactgagggccaggaactgatgaatggtagcccctgcagggtttccagcttcctcccccttaaacccagcatctgtgtcctttctctagccattctcaataccttccttctgaagatctgcttagagtgtgccagtcttcctgatgtcctggtctctcgatggcagatgttccttctggctgtgtctgttcagctatcttgcctggaggatcctgtttattttgatctttggcttctgcattagaaaaatttctcaattttctgatcacttttgcctttctcttcattattaaaagtgggaaacataaaagctgcctggaagttctgagctcatgcataaagcttattgacttcaagcttcgatgtgggggaactgagtgaactgtttcttgggaatgatgaatcagtgctgtctttagacctatggaagaggtgcttcagctttcgatgtcctagatatgtcccatttctggctttgccctgcttcatgggatgatttgtctaaagtgctaaggaaaagggctcatctagggatttctctacccttttctagactgtgctttggattcttagaattcctgccccaacagctccagacctgcttctaggatctgcgtaggcctcttcttctggtctagtctcacaggagtcatgtagagtgggcataggactaaggaaggccctttggggcagcagtttgcatgggctttggagaaagtttggggatgtggtctgtagtatctgtatacataagcacaagttctttcatgttttgaacatccatggagtggaaagagaaggaggtctaactatggaccacaagcactatgttttgttctaatactccttggagtacaagaattatgagtttcagcatctcatttaggtaactacaaaggaatatttatcaggataggaagatagaacatatttcatttaacagttttggggattaacattaaacttataaatatctagaaatatggaatgcaggtctttatgttcttgccttgagccttataaatgttggtagtgggcctgttctcatgttaatatatttcctcatggttttgtcagattccattgagatgagttttccaatgtttttcctagaaagtaaggttctggctgccagcttttggggaattcagggtgggaagaaaactggggatcactgcagtcttcagatgatcaattaatcttcattttctgtaaggtaactgtgcctttccacaatgggtggtggatatctggtgatctaacatccagtgcttctatcttaaccacctcctttaacctcagctcctgaggcacccggtactgccagtttgcaagccttttgagggttttgcagtagaaattattttggttcatgtctatacccactagtggtttaggatttgactctctaagggctctgagtcagttgccaatttttcatctacttcatctgttattttatccttatttttgttgatttcttttaaaaatctatttactgtaggttagtagtatttctggtgagagattaatatgtgcatgaaatatgccatcttattctggaacacagcttgttcttttcacttagttagaacttgtgaattccatttaatccctgcaataaaagttccattgtgaaggttgagtattaactcatgcttcctggacttaaacaaagtctctgctaccaaaataagatgaattgttgagctcagggatagtgacactggtgctcaggtgataagtgctctcactactcctaagtaaaatagaggaaatgtcaaggaagcttggcagttggttaaccatagtgtagaaggaaggtggtaatttttgaaaagtttctgctttttcttcgccatgtaaaggcccaaatggaagtgtcagattacaatatttttctactacgttgtttttttacatggcaggaagagtagaagttagtttttagaaaactggcatataacttacgaaactactgctagctaatccttgtagtactatgctaaattaaaagatagatgattgggtatgtctgttttctggctaaagatgctcaaaagatagtgaaaagagtaagggagaataaaaattgatgttttgataatttatttttaaatatagtgttgtattgagtctttacaaaaatcctgtatgacatctattctaaacaccgtagtctttaaaccaaggctcagaagaattgactaagtagctaagttgagtaatttgcaagaccaaagcaatactgggatttaaacccagcagtggatgactgcaaatcctttctactgcatattgccaccttcttggaataaatttgacagttgttggtaatcgtgttataaaattgtggtagagaatgcccttttttctttcttttctcctcgcaattaacagctaagtattgctcaatcaaaagcagttactcttactttgctccttgaagaacaggcaaagttgttgattttatacccatattagagatgaatgacacatgtttgaaaacttctttttagctattcctcttgattccatatcttgaatatacaatctctaattgtagtttaaaatgtctgctatgaagtacattgaatttatacttggaccagactaactccaaacactgataatagaaggaaatcagaggtgttgatgggattcctgcgtatgtataaaatatatctcctaacttaagtaaatggataaacattgattaaaatctattttctatttttgcacatttaatattaaaaggaaatattaagcaagattccaatgtggatgcttatgttaattatagctatattccacttccagatttattatctatgtcaaaattccaacttttcctcatcattcctcaaatattagaaattctattctgctcttatcttggtggatcaacttatttccatctttatagtaggtctagctgaagatgattactctaatcactatttttaggagatctccttattgaatttcccttccatttcctgcaaagatgcatgattgccatgctgaaaactttttgatgtttctgtttatcttttaaaaggaggagaaatattcttttagaatgattattactcccccaaagatatgacagttacaagtgctccttatcctctactgactgtcttttgcttaccttgtttcttgtctaccctggacaggtgacttgcacctgaaagacagactttctcttttgcatccaaacagtcgttaagcccatcttcctccctctttttatactcatttattgaatatctaccatttctttactaggcattggggaagtgaaggtaaacaatccacactcactcacaggcttccatagttccacaaaatcatggatgccttaaagatttatgtatgcaggactttagaaacataagggaatggggtggtgggattgattaggtctccctagcagaaaccaatctaggaggtaacattgagatacaaactctatttctttttctctagaccacctttactcctctagctaaaacgtcaagtgaggcttcatgttcttcagagagcctaaaatctaccccttcacccaggcaagaattagcccctctttcctatagttttcaaatgactaagttaatacatttaatacggcctgtgttatacttatcatttttttgtttatatatatgccttctctactacgtggagattcttcaaggttttttatgcattttaaatcttcttctgtgtattatgaatttttaaggccctagtactttgtattttcagacagatttatggatgatggctttaaatatacactcaatgagtgaacgattgtaaaaaattcttagagaacaccactgtcttatcatttgcttgctacttaccagttggttaattcaaaattttgaaggttttatgttagatcatggatttaatcgtgtaattgtacttttaaaatgagaaatttgtagatttttttttaagttttggaaagaagactatttttcagtatttcaggactcttgtgattctatctgaagtaggttctatacactaaagccactgtgtgtgtttgacactacctaagtaggatattttataaggtgcataacttagtcttgtcttattgttttctgaggtcctactgttaccactcttacattggccatccttaaaattagttggattttttaagctttgcctcttctagaagctgttttttgttcttttctttctaacattttatgcctttagttctgatattggccaccaggtagcaacagtgccttgagtagctcaagtctcataaataggaaactgttgtagacagacaaaaagatgaagttgtctgcattcaggaaggaaggagtaagtgtccagaatcctcaatgtttaattcccccggcactgcatcctcatgttgtctattgcaaatgcaagcataaatttaggcataagcataaaaaatgcaagcataattatcaactgtccatgagcagcctccctgttctgccaatccatcgttactgcgacaattcacttcatctcagggccagtgaaacacaatgagatgaggggcaggtggcaaggggcaacatggatcatgctaggaaagtgtgtgacaactgcaaacaagaagagactgaaataataaaaaaggtgtagggagaaagtacttctttctttttacggacatatctaaaaaacccataatatttatgagattgttttttaaccacgagaaacacatttatgctgatatagaaaaatcaaatatgttattttagatttttcttcttccttcacccttagcgatacctctgggtattctagttgtgcgtggagactgtgatttggagacttgccgtatgtacatagaccgcctacaggaggtgagtttatttagccaattttttattctcctcaactttccatttttgtaaacaattaccagccatatatatttgcttctgaaatgatgcatttggagaggaagtggaaatgtggtggctttgtccttcaagcatacgctgtatgtcaccctctcccactgtctctgttgttcactcctcagatggttgaaatgggaaagcattgactacagggtgctgttgccctggtgtgttccataactatagcttggaacttgtcattttaccagacacatacctgtatatttgagatgttcagaatttcaacagggactgataaataatgaaagaaaacagtgatatttaatgttttgtgtctgacacttatgtcagagacagctagattttgtaaacaaaaaaataaataaaacttctatgggaaagaaaaatcctctacatctcataggaatttgtcagaacacaaaagaataatctatttttttttctcaatctagtcttgctttagagaaacagaaaggaagtgaccccgtatatggcactcccataaatgtgaactgcaccagcaaagccaggagacccaaactcatcattacaattgttgttggttgtttttgcaaaaatttgagggggagtcttaaccgtctccattccacaaattgcaaaaagcatatatgacgatttctttatcattttttttgatgaaagatgtatattagagtcacttttcttgggtgtggcctagacatttgtatttttaaagctgttgggttgtcttgataccccttgataagcaattctgtcccagacaacatgttatacataggtaaatattgtaaataaagtagacacatactgtttaaaatccctctgagttgtaaccacttcaccctgaatatttgattctgtttctcttggtagaaataaattcaggggagaggcacatagtgatgtgaaaaattactgattttgagaaatagatgacaaatattgaatactgatgtggatgagagaaagatggtcaacaaattttacacttacggcttcattaagctattttgactgaggatagctgcttaaacaagttaaaatacgtgaatttttagtgactcaggtccaattctgttaatatgttcccaaacttctagtatctcatttcccaaaataatgtttgtattttgctgtggaatctcactccagaaacctgtaatgaaaaaaatgaatcataattggtaccaaacctttttacctttttttaaaattaacacatgtagagctttgttaacaagacttcacagtagaataatattaatacacgattgatgaattgactttgttaaaaaccaacttaactaacttaatagcatgcttaatgcaccaatattcaactaaaagtaggatttttaaaaaagaggcaactcaacaaataaagaggaaaaatttttaaaactaatggaaagtaatgtgatgaaaccctgtgggaaacaggtgtaaggacaaaggtacccaggattgctgacatctgtgaatagaatcactacactcattagcaaggaagcctaggaggcatgacaatggtgacaagttcgttataaaactttatgaaaggagtcaggctttcacaatctgccagtaaaacctcattaatttcaaccctgttaatttgcactttgtgataatgtggaggtggttggtgattttctctttgtagtctatgaaaacccctatttgctaagcgacttatcagtataaacagttaccatgacagtatgtatctggtctgaggtaaagaaaagctttctaagtgtttaaagggatttccaaagccttcttcacaagccaaaagtttatatgcacattaaatataatccccatttatcagaacaaaattgcctgtcttttacttctggtctcctctataggagattgaaataataatataacacttactttaaacactatgtaggacttataggtttcaacagcttaatgaccttctctcagtccagcttggtttgattttattatttctggcattaccttctttatttaacctttatgaatttgggtgtgttcgatactttccagatgagcatagtaatattaaattgggagttcagttgagattgagttgtggggcagcttgttcaaactaattttaaggtatggattttttttttcattttctcattaggacctacagtcagtttcttctggctcccagagagttcattaccaggtaacaaataattgactctccttgtttcttaccttctggccaaatgaagtccatctttcaattaatgtcttattttgatttagagttcacatcttccctagggatagagttcattctaagaatctagtgaaaatggtattctgattcttttgcattttcctgattttggaccagcctagtctagcacaaatttagactgtggattttctcctagatcatttagaaaagattataaaattgagtgctttcagtaacaaataccagaaaactcagctgaaactagcttagcaaggaaagggtctcttggttcacataagcaaaaagtccagatcaaggtggatttctcatcccatttggtcatggctcacactccactttcctgctggtccttctactttgttctcctcttcctgtcaattttacctctgggctagatgactttgtggtccaagatgactgccattagcaaccaggactatgtttttttccatcatctcctgaaaaagagaattacatgcttcctacaaccatcaagcaacagttttaaaatgtaatctgagtggttcatcctgggtcttttggacaatctaataaacccagtctgcatctctctatggcccatataaagtctgtaggagaacactcagttattctttatcccagcagactttgggggtgcagtttctttccaacttccccatcccacttgtgatgcacagatctcttcagccatcctcttatgcattagatttctcagacatgatgtagatcctagtacacagtattactcccgactgcaaggagcccaaacaaagctctttgactggtctcattaaagcccttttatctgaaggctccttaccctgccctgttaagaggaaaggtatgtgggaatcacagcatgccaacaattctctccaaataaatctcttcaaacccttcatacttccatgtggggaggaatataactatgcctaaatttataaatgtgaaaatcctggtttagcacttcactttggatttttgtgtctattttcccatgcctgaaatttccaatttaacatcctttaacataaatagaaaacacaataatttaaagaaaaacctatatcttgtagccttctaggtattccccctaccaatgataccctctgtccttggctgaagcagcatatcttcagccttaatgacaggaatggcctttgtgttcttatttgtgtatttatttctcaaacaacgtatcccacacttccagagttctttcttccatctgtctggccttgaaaggaagaaaagtcacttaggatatgtttacattaaaaacaaaacaaaatgaacttcttctagactgtttttaccaaacactagaagacaaatttccaccaaattttttagatagagcacaactttcatcagagtgactatttgcatatttacccagagccactatcttggtgtaaattttattttaaaaagcatagtgctttcacaatagcaaagacatggaatcaacccaaatgcccgtcaacgatagactggataaagaaagtgtggtacatatatactatggaatactatgcagccataaaaaggaatgagatcacgttctttgcactgacatggatggagccggaagccattatcctcagcaaacttatgcaagaacagacaaccaaacaccacatgttgtcacttacaagtggtagctaaacaatgagaacacatggacacagagaggggaacaacacacactagggcctgttgtaagggtgggaagaaggagagcattaggaataatagctaatacatgctggttttaatacctagggtatgggttgatgggtgcagcaaaccaccatggcacatgtttacctatgtaacaaacctgcatatcctgcacatgtacccaagaacttaaaataaaaattaaaataaaaaaagcatagtccttttaaaggtaagagctgatctctaacaattggcagtagtagttataagactatgaggatattgtctttaagagtttatactttttcctcttggacattttgaacctttaaaactttatcaaaatatgttagatttatcctagctaggtttatgaaactacttttatttattattcctggcttatatgatgtagtcatttttggtgtgagagttaaaattgtgggtattttgtaccatatttttttatgccctatctgtaactattcatggagatcaacggatggataagatactacaatatgagtgagttatgtattgcatgtattgtttggtaataacactcagaaggattaatgatatttttctatgtcaaaatattgctgcattattttgtttacttacagtcaagtcaaatcttggtgtcaaaactgctgcattataaatgccacatcaaaaggttttgtgtgctgaacatctaggataacgaatgcagtgatcagggatgagtgtcagaggtgtcaccttttcccatatccttccttaggacaaggaaggcgcaagaagagtgataaaaatcaggggactttgagcatgaaggaatggttggaacaaaaaagatccaagaagcccagaatttgctcattaaacaggaaagaaaaagagactgtgttagaactaacgtggccagagcacagggagaagctaatgaggaatttcctgagcagggcaaggagaactggttgaagcacgaagctgggagagataaactttcatgtttggccaagatcatcaaaggaggaatgagttggaggcataggaaatagagttctgtgttagccgtattagttttgatatgcctgttagatccaagggggttggtgagtaggcagttgggtatacgaatattaaacctcattaaaaaattcaggcccagagatagaaattttggagtcatcagcaaatggatgaatggtgcttaaaactacaaggccggaggagatcacttagggaggagttcagttaaagaggagggcccactgttctatctatgtttattcatgagtcaagaagagtgcaggttcaagacagcaactggtcaagaagaatcatggaaactgagataagcagcagggaagctggaaatcaaggagaaggtggtatcacgaaagccaagagtgaaatgtatttcagagaggaaggagtaatggacagtgtcaaatgccattgagaggctgaaaagatatggattgatttccgtatttttttctaggtgtgtgtattataaaacacatgggatataggtgctattaatttttatgtagaaagtgactggcaggaaatttaatactaaatcttttatttcttagtgcagaaactgattacatcagaattccctagtttgtcccggtgggagtaaggagtgttataggtgaaaaagaaacatgaacgacgaaatgccttaaatgcctgttaatgaagtttcttgtctatgagatgacattaaatatgcttggaggattaactgtgaagagaataaattaataccagtatgtttgaaaacttgagaaattcctgtcagctcactaatttgcagctagggttttagctgactgttttctaagaccagaaaaatctcaagagaaaagcagcatttagaaaggtgtacacgtgcccaagacaccttattagtgagccatgtggcagtttctcgccacttaagcatttcattgctttggtttcttccttttccaaatgcatagtgaattgccaacaaagcactgaagctcaaaaatgacacctcatgttaacctaacaaggtattatgggttatacaagaatgtgttagatatttatagcctgttgaaaattcctgcctacaccatctctgaggtcaaaattcaaaggcccctccatcctaatagcattgatgtaacctgtaactaatatgttttacaagcaaaatgcattgcacttgcagatttaggatattcttgaggttgccaaatgaacaagaattaacataagaattggactctacctgcttatttgataagggtcctttctgaggccacctactttgagataattccttctctgcttcctccctcgaaatcatgatatcccttcttaaccccaaatcacaaaggtactaaggaatagaggcagatgtgccattctagtgatttccagctgggaagaatttgctccctgtaggggacatttggcaaggtctgaagactttgaaatctgttggataaaggccaaggatgctgttaaacatcttagcgtgcacagagaagcctcctaccatgaagaattatccagccccaaatgtcaatagtgtagagcttgaggaaccctgagtcactctgacggttctcagtacataaatgagaaccccagataggtataagacctagatgaggaaatggaaaggagaaagagagaagaggaacaaaagaaaaggtagggatggagaacagaaggaggcatttatagatgtagtagggtagaataaagagagaactaggagcaattagaggggtttttttgtagacaccctgggtttccccatttccccagggtgattctttatggggcattaaatggtaggaattataacttgagattttagtgcataccataggattcacctgtagttgcaaaaatagattcaaccaggtgattactttctctaagaattaactcacttaaaaatagtaccagaatggttggaatatttaaaaatagagaaaacattattgaaaagccttttcattcttcagggtggtacagatgtctttcactttcataagaaaaaaaaaaacaacctcttggtcagatcggagtctacattacttgttcctcctctgatgtcctttgttcctacatgcctgctcttctggaggaccagcctatgttgtattccattaaaattgtgtctagttctaggcaaacagcattttcctataaatatttcattcatcccctttctctttattctggctgtccttattcatctctctcctttctctgaaatctcttcctcctccatttgttttctggagtctagaagagtccttcaatagatagagtgggacaaggtttagagagtcttcctgggaattgatttatcttgtgtgagagaggacagtaccagctagaaactttggagaatgccattcctttggactagattaaagctgtcagaaatgggtcaaatgaggaattaaataagacttgcctagggtcaggtctgttgtctcttacgagtgaagacagtactggagttgtcattattgctaatggagaactttctcacacaaagggactcttgaaaatgttagaatattgcttatttctatcttctaccccactgtcttcatcttcgaaatctgggttgaagaatggctatgccatttctgtattcctccactgtaggagtcatgagtggtaaagtaggttcgagatggaggggttttaagatattaaaataaatagtagcaaacctatttggggctgtagttagacagagacacatacatacctatttgtatgcaacattatgttaaaaaaatggatagatggcttgtatgtgggagatgttggggcagacagatgagaattttgaatgggtaatgagagaaatttaaaagtaaggtgattattgattggccattattaaatgaggcagggattcccaagccatagaacttttgttttgtttctgtttatgtcttttctcaattttatgaaagaaaaagaatttcattcacattgaaggcatagttcaacactaggtgaatattgcttaattggaaaacttactagtgtgtgatggggctgctgtgccttcattaaattatgtgtgcatcagctatgagcaattgcatgtaaattaagggtaactttggcatatgcatgccaaatagtggttcagatcattttctcatcaattttatataatttgtgccagttggctttcagaaatatatatatatatgaggaatgtcagttttgtgtttgtgcatgtgcctatatttttagcacaagaaacgtattttccattaatatatatcataagagaagattcacgtatcagggatttttgaaatgagcagtttttgctaatattattcatttaaagagcatgtaattttagaagattattatatttaaaatagaaaggagcatggtatatctaaggttatgtcatttggcctacattacagagcaatgacagttgcattcatctaaatcacaccatttatatgaagaaaagtcacagatccaaaatgggcaagtcaagtatcttatctctttgatgaatcattgatttgatcatgcaatttgagaggactggggagactagaggccctaaattaccattgaaagctttggatatgatggttagaggcacagctcagggaaatatagctgcattcatacaatcctattgcttcagtatctactgtcagatgcttttgaaagacgcatatttttaagattgtgttttttctctctattggaaaataggtcactgtacatttatttaatgtgcagcattcacaaatcaaacacactctgaccatttgtgttcttgtgtagtgatgagaacatcgccaggtccaacctagagcttccatgaagctaaggtctgtcctggaaccaatattcaccccctttccaggagccattagtttttcttacttcctatttccttccaagtctaattcacggtccacattgcactgcttttcacccttctgcagagactagaggatgcccctgaatcaaggaatccttaatgccagggctacccagtctaccagtcttccagaccctctgagaacagagaaggtgtttacctgatgtgagctgtgtggattagtaacgagagttactttaaacactaattagagaaaattcagtaatacctgtctattaacatcactatcactcacttacactccaattattattatttttttgaagtacaagagaaaggtgtatagatagacgtgatgcaggaattatttgtaccctgcgtacggaagaaacccattcatctgtgtggtcatggtaggttaagaatgtgcgagcataaaaagtttatggactatcgcggtaaattgtgaattcctgtctgatattctgcttctctttattcctgctccatttttaacccatacaatatgcatttctctctgatatcaaggtcctcatggtatatctcttgacttttataagctatgtgtgttctgcaatctgccaggttttataatcttggtttacctcagttttgatattgtacgtaattctagacttctgtttggtttttaactctccacccaatgtagacctttatggtgcgcatttttgttttcctacatttatacaaagttacgcacatagacatacatgaatacatatgtggggattgttgtttaaaaatacaaatgtagctgggcgcagtggctcatgcctgtgatctcagcactttgggaggccatcatgggcagatcgcttgagcccagcagtttgagaccagtctgggtaacatggtgaaaccccgtctgtacaaaaaaacaaccccaaaattagccgggcgctgtagcatgtgcctgtagtcccagctacttgggcagctgaggtgggaggattgtttgagtccaggaggcagaggatgcagtgagctgagattgcaccactgcactcccgcctgggtgacagggtgagaccctgtctcaaaaaaaaataaaaattacactaaaaataaaaatgtgtttacaatttgcatgtgcacactatacatattataccacaatttatttttaacagtaatgtaccatggaaattcatcttgctaataggtgaaactctaattcagtctttaaaaattatcactctattccatggtatatatttaatgctgtttctatggatggcatttttaggttgtgtagtattgttgccaatgtttgcaaaattccaataaactttatggtacttcaaaaataaaatcataacagaaatgaaaaccatgcaacatgctaaaaacatattaagattggctatatttgtgtgaagattataagttacataatgcatacagcaaagttacccaaaatctgtaattggatttttcttcacatggttgtagtctcggttcctgtgtctgggttggggttgcctgccattcccattgattaccatatttctgtggaattcttaggcagcagggaacacagtggtgggaagtgggaagagagcaagactgaagaatgtgtgggggcaggaactctgagctaccaggagcaaactgtctggtaagaaacaggaagcttagtttgacatctgtgtaagatccttgactagagtagaatgagatcttcatagccatttagatcattctaggtttgctttcttcctgcttttgtttgagctgagtctagaaaattctgagctctcaaacttgatctataccaaacctcactcttccttcaaaacctgaaatcataattcctctagaagctgtaaaaccctgtgcataaggtcatgagctctgaagtaaaagaagtctgtactctccaccactgaatagcttggggcttctgggtagtttacttaaattctcaccactgcagttctttattgtggccagctcttacatgcaggagaagaggttcaggaagaatagtggggtggattgcaggagaggtaggtaggagctagattatgcagccttcttaataacaaaacgaaaaaagcctgcacatgcatagaagattatgggttaaaattaagctattattgagactgtagcctaatatttctaaattatctctatggcagtgtccaggtaaccctaaaactaagggagatgactatgtgagacttgaacactccaattgtgaattctgatagtaacatatatggctgagtgaaattttatcaagtataaattattcagtagatgaaataaaaaatggaatagtctaagctttatttaatctatagccaccattaatacagaagtagagccatgtttatgggaaattctcagaagcaaaaaatgagcacaccgtaaaaagaaaaaaaaaggaaaattaccatcaccaaaatgtggttcagtgattttttgacagcttgtccggattagtgtttcttatccttcactgccagacagtggagatgagtcagggcagaagctgtaggtggaagactaagagtagggaggaatgaacgagagccagagtcaagagctacctgttctacttgacatcgtgacagctggcctctatgtaacggggttggatgactcaggattgtatctgctggcacttcttggccgtacgtcagcaccaggactatttgaaaactactgctccagaacaaaggtttttagccccaaatttgagactttgaaaggaaagggctttcttaaatgtgaattgagccttccatttggtttgccaacaatgaatttattctgctgtcttctatttttttttttaattaccaagctctgattcttttggcagctggctcaaaatcctttttccaaaattggtggctgttggcagtagccaggaaataaattgaaatcgtaattaaaatagtcatccattgggaaaagaagttgaaacttggtaaatcagacttacagtaactccaagaattggagccagaaagaagcatgcagagcacctagactggttcctagtgtagtggccaccctttaacgacatggtccatgcttcgttttttgtgaccttccgtcacatgccttgcatttcattggctttaataaatacacattaaaaaggttgatcacagttgtatcacaggaaaaagaataatgtatagttttgtgacaactgacaaattagcaagtgacacgttaattttggtgaaactaaggaaatagcaagtaggcagttactattgaatggggaagggagacatcagtaaaataaaatgttccgaaatgtatgcttgttggtgatagaagacattcagccttgaagacaatatcctgtatttaagacaattatataacatctaatgttgtgaacagaggcactggattgctgattaagacaagccctataagcaccaaaccaacaaatggcatgatttcagcctttgtttaaagccactctgttttgtgttcactcatacaaatttgtcctatttctttgttttctccaaaactcagaatctgagtgcaaatgtatttatggataaatagtgttgtgttaggggtagcaccatctaaatgatctggtctgaaatgtggcctgtgtcccatgagaccctcatgtgactaagggcagaattgttttaggtaaaataatgtctcagctgcctaacatgagatataattatctctcgcataattatatctgcacataaacatgtttcggcaaatgggttaagcattttatgtgtcattaattcctcaaaagaaccctttatgatagatattattgtagccattttaaaatgaggtattcaaggaactggataagaaactatcctacactctcacagcgagtagcgggtagggcgccaggattgtcgtgcctctcaaagctggtgtgcttcccatcagccttccgccgcctctgggcttgctgcttaattggggctggatcccatacaatctctcgccttgtttttccatctcattcatcagatctgtctcccctacgatattttaacacctcaaggacaggaacattttttggcatctcaattcttagcttgtctgtgataatgatgatcacatcctacaacaatttcagttttgcgaagcagactttctcactatctttttgctctgtttttcaactcaagtgaaatccagcatccaccaccgccacctcaaccaccaccaacttttctgtccctagcctgctcttcacctcctattctgtcttggatctttgagatatattttcagcacccatttatgcttcgtacctggattttcttgtttcttgttttaccgattactggcatattttgtgggtgtattttgcatattgtcaatctgttatgttggaacatcattttaacattgacttcaaaaaaatctccaatttttagtgtcccgatgtaggtgaagcattttcatctgcttagatatgtacatggaatagattcaagggcaattttttttgagacttgatgcttttgtacattttatatatgtagaatttttaaataagtagtttagttgcattatgaatctgcccagatagtaattacagtttttcattggaattcaaatgacttttaacgtaggacctattatgtgagtagctgtttctttaagaactcacttcttcttaaaggaacaaggtggaaagagcttcacaaaagttggaagaggatgcaaatgtatttcagggaagcatttcacagaagttagaactctacttttgcttttctaacaactcccaaaattgaagtttaattgtcaggtcaccaggaaagtatccaattgttaaaatcagattcctgtgcctttaagtaatgatgtattgtttaacttcaattattaataccatacaatggtaaatataaatacattttttccctttgtttataaaaatgaacataagtagaagaacttaaggcactgaaaacaaacacttgggagagactatggatggaaataagcaaaaagttgagtctttccatgtaaaaattgacctagtttcagtctgctcctaggagaatagccacaagctcagagagcttttgttgtttgttgttttggtattacaattaccagtaactttgcattggtgattcctattctcataaggcattttactgatcagaatcttcttattttgttgaattctctgtgacataaatttttgattctttaaattaatagcttttttagcatcttggaaatctcagatcactttgataatctagaaagcagtggtttttctgtccaggaaaatgaacatacacatagacataccaaatctggcatacaattttggagagttcaagaattgttgaacctatttgaggacccattaaagtattttaaagagctttatggcgacccatgtgttttcaccaaacaaaattgtaatgttatctttagacgaaacctctttaagaacattgagttatatcagatgtttctgtagatcaaacatttttgcaatttccatctatggatcaaaatgtagagtaaataagtgaacaaaagcaaactacattaaaaaagtcaggcatgggcataaaactctccagacacacagccacctgcacataaaaagatatataccatctatatttccttaccaacctgtggtagtcatgttgctgaggcagtgcctcaatctagattttactaacctagactaaataacatccaattttctgtaattagaatagcctagagatagtgtgatggatccttaggtttttaaaacaataaatcaagcattcctgtattttttccattgatttttacatacagaaattaggattttttttattgtgtcctctgcagcatattcaacatcaaaatgcagaaagtgtccttgatgttttagcccctttattcatagagaagataatcctgtttctgtttaatctctttatttattagctttcatagttgccactaaatattttgaatcacttccaaatgtcttgatctataattacatttctcacccaactgagagacgtcagtagctttatctgtttttcaaaaatgcattaagtaccttaagttcctttaaaacaagttgtcacacatgtcaaaatataattctcaaaatgttacacataattctcatataaatagttactaagcacatgtcaagattttacttagctcaacaatcaggatgaaaatccagttcaaaaaagaggaaatatatacacgtgtatatataatatatatgtatatataacatataatatatacgtttatatatgtatatgtacatataatatgtatatgtatatatacatataataataatatgtatatatacatataataattatatgtatatatacatataataattatatgtatatatacatataataattatatgtatatatacatataataattatatgtatatatacatataataattatatgtatatatacatataattatatgtatatatacatataataattatatgtatatatacatataatatttaatgtatatacatataattattatatgtatatacatattatattatatgtatatacacataaatatacacatacatataatattatatgtatatatacatataatattatgtgtatatatacatatattatatgtatatatacatatatatgtgtatgtatataatatttatatgtatatacatatatatgtgtatatataatatttatatgtatatacacatatatatgtgtatatatatttatatgtatatatacacatatatgtgtatatattatatataacataatatatatgtatgtatataacatatatacatatatagtgtgtatataatatatatgtatatatgtctgtatatacatatataatataatgtatatatacacatgtatataatatataatatatacatgtgtatatattatatatacatatatacatatagagagcaagagagagactatatgtaacatatattttttctgtatatattatatagtatctctgtatccatagctatatggatatatttataaatataaatgatatacatattttatatttataaatatagattttggtagcattcctgaatgagaccattttttcctctatcaattatttaattcacagaattcatttagagtaaaactccatacactccaggtttctagtttactaagatgcatccttttgttcggtaactttaggttctttcacatacatcctcagacctatctgaaaggcttgttaaaacacattgctgggttccacccatagtgcttctgtagacctgggatgggccctggaaatttgtgtttctgacaagtttctagctgatgcacactttgagaacaagtgatttaatcccaggctttatttgaggatcaagtagggcagcagggagtgttgattaactcccaggaaagtcagtacaacctctgattgggtccttattacttcttctatgttattcctgttttcttctcctgtcccctctgtacacacaagatcatccacacctgcggcttcagctgccaagtctttattgctgcctgcacagccgcaccccagtgctgctccctacatttgaacatttcaaatccctattaagggccagactcccagtgtcttccccacagagacctggcctccctcgtttgtcccatttctgtcagtgatttcaattccactgcaaaccagggctagaatgctccaaatcacatgttgtaaactagaaggtgctctcctccctccccagttatcactggcaggcttctcttagtagagaaaatgtttaatttttaaaagtttggaatcttaaagagaaaatcctttcagttttcaatctgccagttctctcttctgtttcgtggatgtagccttaattctttataagaaataaaagcttctgagacttcaaggaagtttgggaactgagaattgtagtaagtcagggaagcaagctagtcctggcaatctcttggaagggcagctttggaaggctgggaggtcagaggccaagcttctagaggtcatgtctgaggtgtgtaagtgagacttggagcaggagataataaacataagcttcaggagtttggaagggcaagaaaggagagtttaagaagattatcaaaagatatatcagcttcagtttcagctactcaggaggctgaggctggaggatcacctgagcccaggaaactgaggctatggtgagccatgatcacaccactgcactccagcctggaagacagcctggaagacagcctgtctcaaaaaataaaatataaatgaaataaaaattaaaaaaatagatgtaacaagatcagctgagggtaatttattttggaagagagggaactattgagagcagaagaattaatgagtggattttaataatgctacagaaataaagttcaaaggagaaagaaagatagtccagagtctaaattaagtgattgactttggagagaagagaactatttttatccgaacccagaggaaagaatgatggtagttatgtcaggcagacttgatgttaaataggagaggggaaattgggaggtcatagaaatgagacgcctagaaaatgctcaggtgaatgagcacattgctgtctggatgagtgttggacagagtgattttgtcatgagttaacctggcactacttttcttccttgtctactcctctgtaattaggttcagtggagaaggctgaggttagagatgacctcagtatgcgaggttgattttctttgtttccatgtagatgaacagtccctgtgtatggatggctgctgctttttctcacgtaccgtatgtcccgtgtggccagtagataacgtttgattcattcccattctgtgccagcgccttagacctatgtgtcaatgacagccagctgtcactcattccttggcttcacaaagggaaagaaagaaattcccataaggaagtaaatgtcctaaattagattatttatgtttaatggaataattgaaaatatttaatggaataattaaaaacctcgtgctaattttatgagggagtcattttcaaaagttctatgtgaaagaatttcaaaaaagagcccttctttgtgttcctagagaaaaaaaaatgtgatttgctcttctcaccagtgctttgtgtaggaaaggatggcagaatgctgagtgagggaagcccatcaggttattgaaatgcagccactagagtgtgtgtgtctctttccaggaccatgaaacctccttccccagggctctctcagcacagaggctctctcctcggtggtgcttcctagatggtgagttctgcctttcttgcgggtatcgtgggagttggggaagttgaagagcaaggcatcaattgatagggtgggctctagttttccaaaagattattcagaaagccttcatgtgactccacatggctggtattggcatgcggaacaatgtgggcctgctgatattgcactgtcctttcctgaagtcatttccctcaacacagcttggttaactctggctgaactcagcatcaagttgctcaggccgatgtttttctttcatcagccctcttttcttaaagcttgactgcctgccttaaattaattcagaccagtagctggattctatatgcataggatggatataatttctatgttatttgcatcttatggaacattcatattatttttatgagaccattattgcagtatgatgtatacatttctggaaaaaggtggaaaaattcagttgcattcaaatctgctcagatccgcatgatatattgcatgcataataggttagttatcttatgattgtttaatgagtccgtttttttatctcaagtatctctctcctagatgctgcctaatactacatttctatccaattacccgtattgcagtaccttctcacctctgtatattcatgcttacatactaccgaatgtatctactacccattctctcttttgttcatatggagacatgattttcattgtagaccccttttttgtttttctgggtgagcatctgagaggatataaatgtgaatatgagtatgacaggatttgtgagtgtatgagcaagcattgggatggcagcagcagagatctattaagatttaaggactgtccagtagcctagcatgactgcaatgtaagggttttaactggcatagtggaagagaaggttataactttggtgccagatcacagaacactttgaatgccatatatatatttttctagtgttatgaagatgggcacttgtatctgtatgagatctaacccacataaatcatgatgtaggtttttgttaatgtctcatcagctgcctctcagaactttcctccagcttctttattccatagcaatgagaaacataatcatttgtcattcctgaatttgcagaggaacaacttgtatttgagaaaattatgaaaatatttatgttgttatgttctatctaaagtcttaaataaaagtacaaatattgtggctgacagtcttagcccaggtagtagttttactcctagttttaataaaataaaacctttaaaaggtaattgcagtcatggtttaaaagaaaaaagtagagtgaatttctccaaggcagattttattctattcttaggttttagacagcaggggtgatgattggctggtttcttagttctgtcgcctttggagagaagctactcattaaatgtttgtgaattttaaataagtgcttgcattttgagtttttctttcttgtgctgtttgttttgtagaaaatctatttataatatttgggctttgttagatagatttaagtgagaagcacataattctttttggtttgcttttttttttttttcttttttgagataggagtctgactctgttgcccaggctgaagtgcagtggcatgatcatggttcaccgcagccttgaactcctgggctcaggcaatcctcctacttcagcctcccaagtagctgggaccacaggggcacaccactatccctagctaattaaaaaaattgtttttgtagagatgaagtcttgctttgttgcccaggctggtctcagactcctggcttcaagcacttctcccacctgagcttcccaaaatgcagctgatagttctttctaatattaggaatatttaaaataatttctagaaacccaaaatttgtaatttagatttttttcgcataccatagatgtagctcaatctctttcagagaatgcttaaataatttttttgctgttttggcttccttcagacatgactctaaggatgcaggttgaaagtgaaatgattcatttaagaccacatatggtctctggcctgaatcttcaagccattttccgaagtgggaagtcacttcactgagaagtctacgtaactgtagctttttctagctttatttacttaataaatacatactaattcctaacttactttaagatcatttgctaatttcaggaggcataaaagattaaatgaaacagatttttaaagaggcaggtctcttagtctcatggttatctgtgaagatagtctgtataagaagttttaaaaaatgtaaatgtggatggatgcagggtcagcaggttctgtctggtgttgggaggttgggactgagaaaggtttcacagaagcagaagcacttgagctggttctttaaagacaagtatgatttagatggcagaggcaaagggaagggctttccaagccttagaatagcagtggcagaggcatggaagtgctgaggttttcttaatagatttagggactggccaggagactagcatgactgccatgtaggggttttgaccagcatagtcgaagagaaggttataaatttggtgccagattacagaacattctgaatgccatctgcattttttttcccctagcaacttctgctgatcgcttttatcgaatagacagatctcaggtaagtttttttccagcctgcttgtgaaagtgaaaaattcccaagttaatgtgctttattggtagctaatctcataaatttttctaacgaaaaccactgagacacaaattttggaatggtgttcataacttaagcttgaaccttttatttgtcttcacgtgttttatgatttatggactcaagatgatgtggcttaatcttgcaaatgagtacagaaaataagttgacttgtagacattatcaccagcctgtactccaaattttcattcacaaagatatttttactcctttttagccaaatttcatgtctttttaagctcatttctgtttagcaagtttgaggccccaggtgtataactagactacttagtttcagttcgccaatccctggaggtcagtgatgagaaaaaaaaaatggttttgcccaagttaagaattcctcccattatctgaattctcctaggagaaaaatgtacagtattgaacctaatgataaagttgttaaccatgctgcttagctttgaccagatgacggggtagaagtccacttatcatacactcctgctgggccaattgtatgtgggtgtcacttctctaatagtatttgggaagaagatgaggcaagaccatttctagatatatctaagaaaaagtcctggttaattggaaatcctgaaccaaggggattcatctctccctatctcccactgcctgcgttagcgcagctttggggaggatcaccaactgatcaagcttctgacaacacagtgtgatcctttgacacgttgcagaatttcattattcctcgagaccaagaatacttgttttgttattcttcatgcaacagacttcttgttcttctttaggaacatttgcactttgtgatggagatttcccaagatgagatttttattctggacccagatatggtggtgtcacagccggcggggacacctccgggcatgcctgacctggtggtggaacaagcctcggggtgagtgtgcttctcctggcctgtgaggctggccttagggtgacatccatgtctggttcgcctttgaacttgacatcgttctaatgacatcaaatgattttgaagtgtagattttcttgttgtgtttccttagagtggttattataagtctgtcttatgaatggccgtgaagaaacacaaaaccagatttacaccatgtccaagcctctttccccatcacagcaacccttcctaacaaacctagaaagcactagtacttgtgtttgtgcttgtacgtttgtagtaactctgttatctacattaaaaattgacacaggtgatttgacaaattttctcctcttcctcttctttgctatttccaggctgctggagacatgtagattatataataataactatgacataccaagccctttttaagagctctgtcctgtgtctctcttctgtttctaccaccgcttcatagtgacttaatcatcttaagtgctctgtgcttattttctcatctgtaaaatacaaataacaataatcctcactcagagaattgtttggcgattaaaagaattgatacaggtaaagcacttaaagtcattcctggcatttttaaaacatgcattaaacagaatgttattacaataataataatagtcatcaccatcattctagtgaccttgaaaatttggtacaattatccttaattcatagattaaaaaattgagacctaaagggttatgttacttgtctaatatttcacagaaaataagtagaaaaaatgagatatagtcctgggttacctgatgccagagcccatgcatttaactaccaccttctaccaccaaaacataattagtatttctaagttatttcaataattaaaaactatttatttagagaattttgtgtgccaggtcctagtgtaagcacttggggaataacagtacaaaaataaaaacagataagaatctttgtccttgtgaaatttagtgttttactggtctatggggcctgaattgttgaagtaagaattgctctagaaaccatacacaatgtgcccaaatagtaaatgcacatcgtgtacacagactcatacagtatgaataaacagtccactaggctagcacaactgcaatgtcatcttcattcctgttttccccttgtcacttgatttactttttttcactttttttggttcactgctgctatttgtgggtggtttcccactctgccaggggcagttgatgtccaatatgtaccaagtctaggtggagacaagagaggacacaagtggctgcatggcctgatagcaagctgttctcaggaagccagagctgcgatgtcagagcatgggggaaggccgacaggcacaaggggtaacctgatgcacccctgggagccccaaaggtggtggggaaggccaacttcgtggggcacatccatgcatcagacccatcagtagtggggaaagcaggtagagtgttttgtcctactgcagaagcagcaggtgctagagtctgggtgtcctcctaccccacctaacctgggctctgactcttgatctagtaaggagaaagtccattctgccaagttgccctggtctttgctcacttggtcattttctttttcttttccttttttttttttttttttttttgagatggagtctcgctctgtcacccagactggagtgcagtggtgcgatcttggctcactgcaagctccgcctcccgggttcatgccattgtcctgcctcagcctcatgggtagctgggactacaggcgcctgccaccacgcctggctaattttttgtatggtcgttttcttcatgtcaaataatggccaaatgctttggccttgctagacctctgttagctctagctccaaaaataaagtagcctgaaaatccaccaggacttgaatcagtgcctttcttatttctcaccagttgcctcccctgaactaaaccaggaacagggaagcagtgaaacaggatggactttgttattttctaatctgcatttctgccctaggtctattacttcttattcatgtcacatttaaaatgacttaatcttgaaaatcagttttctcatctgtgaaggggacagaatcatacaaatagttcatgattgttgagataaatgaatgaaataataaatgggtagtatctggtaaacacttcataaagatgaattttgcttctcacatttactggcaagattcatcttcagaaagtggaaacgaagtcacgtggctgactttgaatgtttaactgtctggtgcccttctttctctcaggatctcagactggtggaatcctgccctgcggaaacgcatgctgagtgacagtgggctggggatgatagctccctattatgaggactcagatctgaaagatctcagccactcccgcgtgctacagtaagagttctcttgctgttcttttcctctgtgccactgtgattgctgggagaggatgtactgtgggctgtgccccagtggtcaggattctcttttcaatggcgctcaggctgtctcatgcaggtgctactctgtgttttcattccatgcaccttgctcatatttatctaccccaaaccgttcatggaactccaccttccatttcttttgctcctgagccaccttgagccccttgcacgtggacctccacatactttaaacctcaccagtgtcttctttactggagtttagtgtttatcacacgtccctgtttgccacatcataaagacatgcatgagagtgatcatgagtagcttgaaagtgacacgtggtttttcatttgtgaacacattatcttgctgtttcagtggtcctcagtcctgagcctgtgcatgtgtgctgtacccaatattgccacgtgggtttgttggctaaagctgggtgctgcccatgttgtggttgcagtctctgtgggtaagcagtacagcatttgtttgtagatcagaacagtatgtgtgctttcttctgaggtctgatcatggtgagagtgtaggatgcatgctgaagtttcacagcagtgtcgatacctttgtgctcggtgaatccacctccctatcatctcctctggtgacagatacactcatgcgcacctactctttaatttcaggccaatcaatccatctcagaggttatgcaaatccagtgtgttcatgaaattaggctggtttccagtttacctggggtcttaatcaaataatgacaatggccttgtaaccacacagtcttagtcttttgacagaataacaagataactgaagattcttcgaatcctagggttaactaaagaggcaaaggaagtgctttgtttctggagaaagaccagaagcaatttcagtattacaaaggggaaaaaaatgagaaatttggagctaattatttcattggcaaagtttcgaggcacacaccctcagggcagaagacttcattttaattgcttctctgtattacctcttattttcttgtgtgaagacgggaaaggaacaacaatgaattactatggatttttctttttaattaaactgtgttgttagtttctgatggcattttgattgcttataattcaggatgttttccatttcctttttatacagaattgaggcttgtgaatcagggtgagtcagccacccacgaatggctaaaaaagtggccatttatctgttggcagacttattggaaaattagtgttttaattagctacagaaatagaaattaagcctggacaaaccagtatttgtttactgagtaaaaactcagtaaaccaatgagtattttagttgtatatatatatataatctgtttccacaaagcagaatatgagctcaatctagttttctaggtcctgatttttctatatataacatactgatgtacgtatcataataaataaaataattgtatataagatagtaaatattcttcccaagaatgacaaataaatttaccactttatataatagccaggttcttaaaaccagatgtcaaaatgaactctttctgtctgtttgcgttaaactatctttttagggatgtctcttaatttttggttgatcttcaatttacagctataagtttttgcagtcatttatactactttagttctaaaatgccctagagtagtagacactttttaaaaaaacctgaaaaattactttgaaaacaagcaaagtggcattcaaacattcatccccagcctttcagcttctccagctggatctccagacattgtggaacaaaggcaagtcatctctactaggctcagtctgaattcctgtctcatagaagacacagcataataaaattgttgtgttaaatcacttaaaaataaaactaaactaaaccagatgccttacctcaactttttaattaattctttaacttttaaaattattatgtccatttatttcttagaatatctttttatttccttcagacatcatctctgatacaaataggtataattgcagttgtggaaatatctaataatgttaataataactactattgatggactacttcccacttgctttgtatcataattaaatgatcttcattcaacaatttttaaatttagctgttgcttaacagataagtaaactgaggctcctagagggtaaaatatttatcttaggtcacttcaaatggcaagtgtagtttgacctgaggtcggtttggcttctgactccatgctttttccattgtcctacactatcttcccaaagggaccatacaaagtcagcgtaccagagccacagaagtttactttggtttctatttcttttttacatttgtacagtgaaaagtcctacaatataggggtactatgcatgcacattaaatatacaactgcaaacttacccagaagtaaatatggctgagaattaatttttaagcatttttttctttaaaagaagagattgaaacaaaatataatggtggtaaacttcagtttaaaattgctaaatatatataaactatgttctaatcaaaataagcgtaaaaattatatagaaggccatcatgtaccaaccaccttgatttattatgtcattgtttttctatatttgcattatatctttctttcaagccataaacaacacagagtagtgtaaaaaatattgttttatggttttgttttgtattgtacaagttggagtatctctaattggaaaatctgtaatctgaaatgctccaaaatccaaaacttttaaagtgctgacctgatgctcaaaggaagtgcttattggaacattttggatttcagatatttggatttgggatgctcaactggtaagtataatgcaaatattccaaaatcctaagaaaataaaaaatctgaggcacttctggtcccaagcattttggataagggatactcaacttgtatttttgtttttgcctgtgttatataatgcatatattttggaacttgccatttcactcagcattgtgtttttgaaattcattcatattgatatatgtgggtttttaataatttttgatatagaatattgcatcatacatatgctataaattgtttctctatttcgatagtgatttctaatattctattattttttaaaatgcagcaaacatcctgtgcccttctgtgttgcagaatatatatgcagtttcagcttactcgataatgcaaaatttaccttcccagttagagtactgatgaatcagtaactgaaaaggccctgaacacttattgtaataatctaggtatgatcagcatctgttgctttacactttaaagccccagtcaacttgggggataggaaaggttcaatttagcatcctgttgacagtgctaaataactcactatataaacagaaatcaaaagagaaactttcaattcttagaactgaaaatactacttatcagagttttcgagacactgctaacgtagtattcatagtacgttaggactgcagattcatttatcaagggaaaaatgattgtgtgcaaataagcaaagcattcaatttgataaattggaaaaagaatcccagtgtaaagaaatgagaggggagaaaaatgataaagataatgagagaaatcaatgacaaggagaataaaacagacagatgatgaacagaaaataaaatttttggccgggctcagtggctcacgcctgtaatcctagcactttgggaggctgaggcgggtggatcacgaggtcaggagatcaagaccatcctggctaacatggtgaaaccccgtctctactaaaaatacaaaaaattagccgggcgtggtggcgggcgcccgtagtcccagctactcgggaggctgaggcaggagaatggcgtgaacccgggaggcggagcttgcagtgagccaagaccgtgccactgcactccagcctgggcaacagcgagactccatctcaaaaaaaaaaaaaaaaaaaaaatttaaaaaattcgttgaaaagataaataaaacaaaattctgagaagtctgatttaaaagaaaaaagtactgaaaacagaaagaaatatacctgcaaggctttccccatatcattcttcctccaaggcacccagggcatttttgtgccaagcggccctttctcctccaaattgcaactgacccggctctgttggatcttctcagcattttcccatggttttaaaatttaaaatagtcccttagatccatcaacctccctttttctcaggcagagtgagaggcaattagtataaaaaggatgaattagatttctatcattactggaattggttgcatttattttaaatgtttccatttagaagcattataattttaaagaaagatatacacatacctacttatatgcagatcctataggaaagactgtaattccaaagtaggatacgcaatgtgtatagtgtctgcaaaacctgtgaacataataacaaatatttaagaaccaattttgaaatgaattggtgagaagtggttgactgacattattactgctgggaccataatgattttttctttaagttaaaaaaattttttttcagtgtccaaggaagttctatttaaaatgacatgattctggaaatgtatttgctcttatcattaattgtaccaccacgattagtgacaagactatatttcatttggcagaagattaatagagagggaatttacttaaattttagcagaccaaatctatttgagttgtaaggaagaattttgccacttgaggatctatgagaaaagaaaataggcatggaatgaaaactctgatatattcttcttaagttttctttgagaaaaggactgactcacctctgagtcaggtgggttaagagcaggcaggtaaagggtctaggagacactgcttttgtttctgaatcagagtaacctttttccggttcttagattttgtagttcgtaagaaacccccaaatgactgaaagagttgtactttttctcaatgtccccaagtcctagtcctgaaagaactaaaatggactgtcacacaaataatatcttgccactagactaagacacaggggaaacagtgtagtgaaccacaccgagggtagatattcaatccagataattgtgtctaggcaggtatctggtacccgatcagctgcacaaggctaatgggtttttatgattggcagaggatttctgtcttcaaggaaagataatgctatcaaatgtttaactataatgtgtgaggtctgatttgtgatttcattgtgattaccctaagaaatagggtaaacaattcagtcaatcgtgtattgaacaaatcagtattgggcaccttcagtgactgaagtcaggcactgaagatatacaactaaagaagaaataattattgcccttgaagagcttatatttaaaggggaaatattaaaccaattattaaagttccttctaataagtgctattatggatatatgcatagagtgttctggaaacaagaggaaatataatttgctgcttttttttttagatttaacttttttgaccctagaaatgatgaatatttaaagaattaacgaaaatgtcagcctcaaagaaaaaaaataggcttattaagtgttctatgtgtattttcttcattttttacatgtgaacagataagtatttgtccttcctcattgtgtaaaccagaaatatctctcaaataatggaaaacattcaatggtagttcaacctctccatatgctatgtgtgctcaaggaaatttggacaaccgagaaattatttggagataccaagatacctaataatactttaaactgaaaaactggcctttttagtatagtctgcaattgcaattctgaatcactatatcgagaagataaagcccggagacctcctgtgttctgaaaactcagatgttctaagctgattatgggagaaacaacatcattcccctctggtcctcaactattttctttattcagtttcttctgggaacattaggttatggcctgaacctaataaaaagggtaattgtgcttattgtgaaagtttcaggttctcaacaggaagacagactgttggacagcgattttgattttggaaatattctttcagcttcacaatcagataagcgggagaaaattaatcttcttagtgggatgcaggttttgctgaaatatatcttagagatgaaatcagtgctgtcaggataaagatggctcctggcatctgtttcactgagatagttgggtcccgtttctacctacctttgacatccctgcttacctttgactgggctcaatcttgctcaccccggatactcattccagctggaaaaatacaggatagctgacatatgtcttccttcttctttttcttcttgacttaccttgagtttgaaatgacttggtgaattactctatttggcaagcacataataacactctattcctatgggtgtgtgaaatatttaataagagatttgcctttgttatttttagaattgttcctcaatcagttatgcatatggaggccctaaaccactcggaggaaatggatttaaatttacctttccaagttcagttagtggaagagttagaacagagttccctgtgtaccagatcttattttgactgacattgaaagaaaaacaaacaaacttactttaatgttaaacatccattttatttgaaataatcccaggaaattctcgcccttcattgccatgagttccaagttttgccaatgattagagtatgaggaaatattagtgttaagtggctctctttttacatttgtaaaagctggcagccatatttattcacacttcaggaatactgtgaatgtgaggcagtattgattggatccctctttaaagcatgtgagttccttggatgaccaaactgtgcatttctccctctgtctccatagcactttgcaccatacctaaaatggtaggcatccaacaaggcaggcttttgggatgaatagaaggatgttccattcatagaacatcccttgatagaaaaggtgctttgtcaaaccaaaataaatacgtgtctatttatattgctatactaaacccagtacttatcaaattataacaaaataatagtgataacaaaataatatgtaaaatgttgaccatttttgttaggctgtgggttccatttatatatttcaaatttgaatataagtatgctggatccagggaattcacagatcaaaataataaagacacacctgaatgcctgacttggagaaatgttggtatttcacaagcgagaaagtaaaaggtaagtatggtcggtataggaagttgtaggcactgttggtgagcacagtggtaggtagagtggcaaggaagaattgtttcccaggcattcacctccaaaataaactgttggtccccggctgcattctccaacttccaccaacactcttgttttctcagtgtgtctgtcttaggtgaataatttgattaaacagatctaaagtgtgaaagagtgatcattttgaaatattttcaaaaaaattcgcttgcaaatctcaagttgctgggatgtggagcagtaatcacttaccatgttcagtgtggagttgaggaatgtgagagggatgtcatattatcactggaaatggtggtggctggggagtcatatcgggcatgggacttctctgcggtacttctggggccctctgaaccccctactctaagaagatcagaacaagagatatctccacaccatgctagcactacttatttggaattcagggagatggagaccacattccccgccccccccccttttttttttaacttttctggatgattgtgccaggcatcacacataagaacaacaatcctccaacagttttctccaatactctgtgagatgctggtcttactccatgactcccttacaagctccttaaaggtgggaatggaatgttttaagttaagtacctcccacagctcttggaatagagttaagtacatagcagttcttaatatctaacactggagtcactgaattattctcacagtctgtcgagcccattttaatttcttgttttcaatattactatgatttatctgcattcattatattttttttcacagagctcctcgaactgatctataactgagaaactctcttgtccttagacacattagagtcaggaggaagcagacaatgtttagattctgttcccaccctctcctgagaagggtggggtgggaggagatgttgtcagaaagctgctggggtatgttacagttatcttcagaggtgccaaaccagcttccaaccccgcctagttttgtctcccattttctaaaactgggatcagaagtccttatttggatttcctaaaaataagtagctgtggctgagcccttactcaattaccacagggagatattgcatatccgggatcacgagataagtgaggtgccttgcttataagccccacgtgctaagactaaacgtggctctcatgtgacttgccttcacaatccagagctccctcatgtttcaacttatgcttaaaaagaaaaaaaagaagtccacatttacaaaatccagatggattatgtctcaacagaagctgttggccggggttcccagagtcactaggataaagctggcagcttggcttttcctaaagggtccttcctcctggctctccgggtatgtctccgttgtctggattttagaataatgtgccttttctatttcttcacccttttttttagaaagtgggctggcaactatattgcagagactgatttctaaaggcaagccacccatcctttattgcttcacaactgtgctgggtttaattatttcttttttcattttgtctacagaatgctaaaatgtgatggctacatcgtcaggataaataagcttgtgaagtattattttctccaacttcatctctttattttatctatttcttttctgtgtccactgtcgcccattcttcctcaatctctcacatttcaaactgctttgccctcattttgttgcagttcttaaaagttaacagtaggtggcagtaaaattttatactcgaaagacattcaggcgactcagcaaactgaggagggtatacagaaagtatggaattgtaaatgctaaaggtaaaacagcgtttttttaaaattagtttttagactttttaattgactaattgcatatatttattgtgtacaacatgattttttgaagtacgtatacattgttgaatggctaaacctggctgatcaatgaatgcattacatcacacagttatttttgtggtgaggacacttaatatgcactctctgtgcattttttaagaatatattatatcatcattaaccaaagtcaccatgttgtacaatggatctcttgaacttagtctgctgaactgtaattatacgtcctttgaccaatatctccccaacctcaacagtgctattttctaaaagccaaatatatctaaatataggaatctatttaaaaaaaaaaaaaacaagatatttcaagcccagctcacatgggggtcatcaaggcatatatttgggtaggtgagtcttaaagactgggaaattatgataataaagggaattggtagaaatttgtatcaaatgaggaactcaccaagcagcctttattatttacatgctggaaatgatttccttccctccacacaaatgctcatctctgtcttcttcctttcattttgctctttctgcaccccttccctctgttggtcatgaatgttacctttgaggctgcttggcattccctgaatgggtttgtgaccacttgaatagagaatgtgtttgtctttctctcatttcaatgccactctgtgtgtttgctgtaactttcatctctcactctcattctcgcctgctctcttttactgtatgtgctttgttcactgttttaagagaaatattcacaattagaaggaccaaaagcaaacaaagagaggattatgtagtcgatggagatttgcagtgctgtgggatttctggtcctattttacctaattagagatgctttggggctagagtgataatggtgaagatgtcacacagatccatggtctcattctttctcccttgggtcctccaaatgatgtcataggcctggcaaactagttctccaggataggcaatgcacccttgagagatgctcaagggaagaaagctattgcacagagatgataatctgcagccatgctttcacagcacagtaaatcatacctttgctcacttgatttgaatgaagattcttgtctaccaacagttttaggaaatagatggaatttgtgtagcatcaccacttcacggtaaaacagaagaaaaagatgaggtttctgcagttgtgatgcagaccgttgaaatgtgcctggagagaatgcccaactgggaaatcggttttcattcgggactacgtaggagtgtaacagaggacaagcatcatggctcaagaagcagggaggaaagtggaacctggggaatgctgaccaggcatgaacattcttacatgttcaccataggaaaaaggtgtgagcacatgatgggaggctgttctatccaggaaagactggattccacccaactgtgacaaaggtaaatgagaaagtccaggaaactctcagggctgtggtcaggagaggggaaaagaaatacaagtaaatgactgaaacgacagagaaagaacattcagagctgacattaagagcttctctttcccttcctaagtaggatggatcatcacctgatgtttatagaaagtggtctttttgctgtggttctcatccccaaagctagacagtaaagaggaaagacaggcatgaaagggaaattgaataaaatacgcatatagtgagttgttttcagtgtgtggacatacgtgtgctgctttgttccccaacaagaacttcacaataaggagtggtgtacttatttgtagtgtgctgtgtagggtgtagaaggagcacggtgtctagcttgcccagcattcccgctttgtttccttttcttattgcaggatggtagccagaaaatgaaggggccttggctatttcagtcaggcccgtgaattggatgagtgtctcccacctcttctactccatccatagtctgtggtcctggggaatcccactgctgagtgttttcagaatatgaatctatgctcttgtgcctatttaaactctgctgtcacacctgtcctgcatgtttatcttaagcccatctctatgtggtggccccatcccttggccaactccccaccaggtgatggtttagcagtgctgagtagaaggtatatgtgttggggacacggaatagagatagacattcatttgtagatgtttctttacagaaagtaagagtcccatatagaggcatccccaatatttatctaatctatcctctgttctttaggaaagactaatggataatctattgacatcctatctccaaagaaggaaatgatgtagccattctgaggaagggccaagtaggaaggccatgggtgcttttaaattaaagccatgagatgatgaaaaaaaataaataaagcaaaatatgcatagagtctaaaaaaataaaaagaaagaaaactggacagtgttattgaaatgaaaaggatattgtattaggatcagcttgtaagttttgatcatttcatggagcttaccaagaaaatgcacatatctaaaacctattgtaaagtatattataccagatataaagactgaaatagtcgtgacacccattatttcatttccaggtttattgactaaaaacgataaaacatcataagaggtgcaatactttataaagtcctttgccttcccaaatataatactcatttgcttttatgtattgctcttttgctggtagaaaactgggcacatttttcagtgcccttaagccttgtaatcgatctactagaaagataaaaggctttgaaggaaaatttgtggattgaaggcaatctaaaaaaagtatctttgagtttcttagagatgcttgagtttagatagagtgctgtctgtaatgcagcagccactagccaatatgtgctgaatgtcttgttccctgatttgtgatatctctatatattaatctaataaaatgattcattccaagatattatagctgtgtttagttgggtaatttcatatattcagactgccatgacaacactccgttccagaggaacaaacttacttcttgggaacctggagacttgtctgaagctgactgcctcaaacacagatatctgttttgtcctgttttattttttgtttgtttgtttgttttcgaagtttgtgactttaaaaattcaagggacttttgcttttggatacataatatgactgtgctggtttcagtatgaaaatattttaatttttaccagttaaattacataatattctatctaaaatagcattttgttttccaagagcttccctttttttccaagtttctctgtgtatgctagtttgaaaagttgtctttattttagagacaatatggatattctcataagcagggttaatattgggaagggtactttcaccagcaaatattcagatcaagattcatggaagagtaaatccaaagtaaaatatatatatatgtgtatatataaagatatgtatataattaaaaatatgtaactatatattattttaattttttattttttcgagacagagtttcgctcttgttgtccaggcaggagtgcaacggtgcaatcttggctcactgcaacctctgcctcctgggttcaactgattctcctgccttagcctcccaagtagctgggattataggcgcgtgccaccacgcttggctaatttttgtatttttttaagtagagacagggtttcaccatgttggccaggctggtgtcaaactcctgatctcaggtgatctgcccgccttggcctcccaaagtgctgggattacaggggtgagccaccatgcccagctattattctagttctttaaaaataattttaaaattgacataaaattattatgtgttgtatacaacatgatgtgaaatatatataaccattaattatgtagctaattaacgtatgcattaccatgcatagttataaattttattgtgagagcacttagcatctactctcttagcattttttaagaatgcagtgtatcatccttaactatagtcagcatgctataccataaatctcctgaactattcttcctatctaactgtaactttgtctactttgaagagcatgtctcccatctccctcaccccgaaatgccccagcctctggtaacctccattctactctctacttctgtgaaatcaacattttagattccacatgagtgagacatgcagtatttgtctttctctacctggcttatttagcttaacataatatccttcaggttcattgatgttgttgcaaatgacaggatttccttttttttatggctgactagtatttcattgtgtatatataccacattttctttatccatttgtacgttgatggacacttaggttgattccatatcttggctattggtaattgtgctgtaataaatgtgggaatgcagctatcttttcagcatgctggtttcacattcttttaatacttacttttaatatttaccttatgattgctgaatcatatggtagttctatttttgttttgttttttgaggaaacttcatattatgtaggttgtttctttgctctggtgattgtttcctttgctgtgtagaagcttttgaatttgaggtaatcgcatttctctattttcgcttttgttgcctgtacttttgaggtcatgtccaaaataatcattgcccagaccgatgtcgtggagcttttctgttttcttctagcagtttcatgtttggggacttacatttaagtctttaatccactttgagttgatttttgcacatggtgtgcagtaagagtctaattatattcttctgcatttagatatatgcttttcccaacactatttattgaaaagactgtcctttccttattatgtattcttggagcttttgctgaaaatcagttggctataaacatgtagatttattttccggctctctatcctgttccattgttctatttgtctgtttttatgccagtgtcatgctgatttggttactgtagctttgtcaaatattttgaggttaggtagtgtgatggctccagctttgttcttttgctctagattgctttggctattcagggtcttctgtggtttcatacacgttttaggattgtttctactaatctgtgaagaatgtctttggtatttttataggaattacgtagaatctctaggttgcttaaaatacgaacattttagcaatattaattattttaattcatgagaaagagatgtctttccatttatttgtatctttttcaatttctttcatcaatgtttcatatcttaatagatttttaattattatttatcttctcttaatcttttttcctagtgcggtggtaccacagtggaaaaagccacaagtttctttaataacaactagttcaaagactctgggcagacttttgctctttttgcctccctgtaactatttcttgatcatttttcttctttaagtttacatttcacaaatgctgtatttacccctacctcccttccttccctccctcccttcctccctcccttcctccttcccttcctccctcccttccttccctccctcctccttcccttcctccctcccttccttccctccctcctccttcccttcctccctcccttccttccctccctcctccttcccttcctccctcccttccttccctccctcctccttctctccctcccttcttcccttccccttccctccctccctcactccttccctccctccctctctccttccctccttccttccctccatttctaaattacacgaagatttattaatcatttttatctgctttatgccatcatctttttagtgtgttctttgcctgtgttttgtgttctcctctggtatttttgcatagatgtcatgctggttcttttctgttattacttgtaatatttgcattgggtgagttttttttttttttttttgagcttctagtttgggatggatggtcggtcttagtgatttggtgtgctgctcttaagtttgactttgtctctgttatcttcaaacttttgcttatcagcatcctcttctaggtttgggtctacttctggctagcagaacaccctggctcaaagtggaaggctttctgccatagattttgttgtgtatgaaatagtttatatctctttagctgactaaaatcaaaattatctgtttccctaaaacttagctctatttttactgtacttggtagctcttcttcatgtatgatggtttgggcttataaatacctagtttaatcaaagagggtatttcctttaccatttctcatcctccctgtcattttccatgggtttcaaaaaaattgaagggcagaggaattttttttctgtgttactaacatggaagtttttcagtcatagtctttaacttgacctctgccttttaatttgtcttcttgttattttatggttcactctccactgcctgctcattgcagaatgtgtgacttctctgcctcacaagcttgctccatttagcttagaaggtaaattgcaagtacttcaccggggccccacacgccatgtatgaaatggcccttgccacttatttctcaagtccttgcttttgttactcctttacattctagcaatactgagttacttgtatatctggtaggattctatgcaatttcatatctgtactccttttcacacgcctattgctattctgcctggagttcttctccttcctaacttacctaataagctcctctttattcttcgaagccaagttcagatgattcttgtttttctaagccttctttcacacttttcatactgaatcaatctccctgttctctgtgctacctctttgcctcatatatattttgatcattatatattttttacattataatcatttatttacatatttttctttttcactagattatgagttccctgaaattgttctttgtgtttccttcccttggcacatggcctggtaataatagggtctcaagtaataaattgaatcaacataaatggagagagtcaaacctgaataataatgatttaggcttagtaggagaaatatttttaaatgcatggcttgaatttttgttttgtattattttgctgcatttaagcaaaataaaatgtaaaaagtaccaaaataaataaaaacaaagcacaaacaaatatgaatattctgtagctaaaggactcatgatcaggaaagaagtgaagaggacagctataagaatgctagtaatagtttacactataagggcagatgcttgctccaagataaagtatacatggaggaaaaataaacagtctgggatacaaccacatgtctttcaggtgtggtgaaaagaataaccagagggctttcctgcatgcctcagttgtcaggtttaagataattatctctttctgggattgaacctctgttgttaaaataactacttatattgctgatttcagaatatttcttctctcctgagctaacttctttcccctccctctctctctttctttctttcttttttgagacagagttttactcttgtcacccaggctggagtgcagtggcgcggtctcggctcactgcaacctctgcctcccaggttcaagtgattctcctgactcagtcccctgagtagctgggattacaggcacccaccaccatgcccagctactttttgtattttcagtagagacggggtttcaccatgttggccaggctggtttcaaaatcctgacctcaggtgatccacacatgagctaactttttatgccgatttccagcaataatggatgatgtgcatgtctcagtagtgcagtgcagtaacttgttgcagtgaaaggtgaaatactgagtgaggatggaaatactccatatgtcttaaaattccacaaagccaggcatatgggagacattcaacatggaaactcaacatgactaattttcacaaaacactctgaaattgatattttatccactgcctggacatactgcagaatgcgtccccttgggactctaacggagccatctggaatttttcagatttaatatcagggctttgcttttgcacaaagccagcaaagaccttgcttcacaagctctccacttgagacatttagttgtcctttggcatgaattttactttgttcctgtagctctgtgacaaattaattgcaaacaatccaagacacgttttcacttacttctcatcagcaaacaccaggaggaaagatatttccttgtggctgattctagtatgacctaagcacctgaagaaattagctcatcttacttaaaatataggttctcttttagattcagcttctaatttcatttcacctctcattcaatactcccctccccaactttatttttaataataatggaggcagaatatgggtgcctgtgtttctgggtgcttttgatgtcctttggctctgagagtgtccacattataaccaattggagcttcaggcactttcaagtctctaggacttttccttgcagctggcctaggagcaggcaagcttgtcttaaggatggttttacagtaacatgatgactttttgggaagctccagaatgtgtcagtctgaatatcagtgtgatggaactgagattaattcaattcaacacattttaattaagggctcatctgttctaaataagatacagccttagttttcaagggggttacaacccagtgagaaaggctggtatgtggatgataaaaaataagggaatccagtgggaggataaatcaaccctacccagggaggccaaatggtgcttctcaggcagtgttgactagggattgtggcaggtttccgctcaccacccccatgtccatctcccagaagccaattttctttccaccaaatcttgggactctgtagttttcatgaaaaagtctactttaagagatttgcacagttgaaataaattgatactttgccactcattgaggttcaaggccttttctcctttaccactgtgtctttattctttactgttcactcacataataaacagtaatcttactaaccagtagataaagtcatatcaagcatcccaaagtagctaaaaattattttcaaccatttttgtattgactgaatgattcttgtcctgaggtttatcttcatgtctcataaatattagttatagtaattggcagctctattgccaaactcctgagtttatctttggccatttccctgctatggatttgagtgagccaatcattcagagaagaggactccttcaaaataggggaagtatgtgatgtcttgtctttcccttcgaaatttcaacaactctgaatataatgttatatgtctctctctttctcctcagaaaagaataagtgtgagtcaaagccgtagtcttcaagctggaggtgaattcatctccaaacttaggtctatactactcaaagtatttcaactagtagtcaactggggggaagcaagccttttagggttgatatgatttttcatttgagatctgattatcataattaaagcagaactcacatatagtttgcaaaagttgttgataaagttctgaggaacctcagtgattgccttctggcctcatgctgtttctcccgggttctgagacataatgcagcgaatagagggtcagctcactcaaacattaaattccatgaagagtgaaaacaaaaactggtaatgataagggtgcatgctatttcttttacctctgtctcaatttatactgttcaagtagatctctttgtatctacagacacccaatctaatgctttttttatatccctggctggagccatgtccttgggcaatacacatcacaggatttcatctatactacatttctatgagttctctttttttgtgtggtaaatctagacttagctaagtttgttgcagtcctaggacaccatgcatagactgatattttagtaacctgtaacatccaaccaatccaggtaagagttgggaattgttgattgaaatataccatgcaatcaacacattaattacactgtctactatattgactttccatttaattcaatttgagggtaaaattactatgaaattattcttgattatcattataattatcatataaaatattgatcatgcttattatttccttttaggtcaccagtctcttcagaagatcatggtaagaatcatctgtcttatttataccaattcaggattgaaacttgacccctggtctttgcagttcattgtcagagcaaataattgtttaagcaaatgtctctaagatattggctttgtggtttttgaatgtgaaatgtcaaacacttttaaaaacttaaatcaccctagctgaatttgatatctttcaaatctgttccaacccgtctggttgacgaatattgtgaagccttaatttattctgcctgatttcagtcccatcagcagaaactttttgtggttttgtggttttggactagtcctgtgctttttatgactcagatttttatccttaaaatgataaaaatttttgtggtagtttgtggtagatattccctacagtcccttccagaatggacattgggatcatgttccaatcactcatttgtgaagagcactctaaatctgaaaggaaggcaagcagtcagtggtatttgttgttacccagttgagatgaattgtttgcattttaagagacagctaattcactcaaaagagaaaatatctcattttgttccatctcacctttggagttgttcatttatccaatcagtcacaaaagtgttaagtgtctacaatgatcagttatgctatgtagttatgttttacaaatatgctatatggaactttggtttggggcccctttgtatcttacttggactttggaaattctctcataattggtatccatacctctatatttcttttccctagtacactgtataccgggctagcaccaaaatgatcgttccatagtaaaaatctgctccgatggcctctagaatgaaatctttccagccgaccaataattgtgttcagcttttcaatattgtattttagcatggactagtaagcactaaatgatggaatctttgtcttcctccactgcttattgcttcatttaccatcttttcccttctcctacccatgatctgttttccagccatgtgacaatacatctaattctacatcaaatttctggagctcaccatcttttctgccatctccctgcttttctccatactgttctctctgacaggatgctacttcttttgccatatagatggtttctatgcacctcacctcatcctctgtaagggcttgctgatctgcttatcgttgtgcctaatatttttctacattctagggcttaatgcgcaaatttcatgctttatttacctgttttccctattagactatgagttctttgatatagtttccaacgaagagcaaacaaggaaaaagtgtttattaaatgaatgaattaagaaaagggagaaggagttttaggctggcctcttctactgccacattgtgaaatctgacttagtactggaatgaagttgtgttattctctatgaagaatcatagggaaaattatgttcaggcccattaagtcaggatcaggcaattgaccacctaatggtaacctgctattatgtgctattttgctgattgctgttggtattactaggtgtttgcccatttatataggcccttgggcttccatgttcacattataaactagaagcttgtgtttggtttttattttgaactaggattccctttaatgacttttggttgtctttgccttcctgtctatgagaatttattcctcattcagacaaaaatggtgggtgagggaaacttgtgaattataatttgataatccactaggacttcttaagtggttatgaaataatagggggcatatgtcagggtcctttgaagtcctaaagggtgactactgacagaaagacttgcttggaagattaagagcacttcagaattgattattttaagaaccttatatgtgattagttgaagaaacattattgaaattagagggccattataatttcatggcttcaaaaaatttcttacatgttcatacctcttagtttgtttctgtgacttccaaaaatagttcaagtacataatgcaaaattatagtgatgatttacctaatcctatgtaattgttcatcattttctagcccatatattcttgaaaaaaagcttttttctttattaccagaattttctatccaccactcaaaatatatttccttctttttatacatttttaagagctcatgtgtactatggctagtataaaacctcttgaatgttatagcatcaatcttacatattatttgtacacaataatggcattgcaacacacttgtaggagaggtgagaagtagcaatttgtctttctcaaatttattggtagaaaatttaaggcatgttggacacatggattgtgaaattggaatataaaaccttacgtctcttgattttctattttgtttgctttcctcaaatagtcctccctctgtaataactagtcactttggctctaagacaagaacttattcttggaaaaatctaattttgcaacgtccaataaccctggtatttttcattcccatggtactcttgcatagagagcttaaatacagtggctttgtcctttaccttatcttgtttgttttcttttccttgtctgtaaaatggagctaatcataaactgcgtacctcatgggattgtagcaagttcaattgagaaatcatttgtgaaatcactttctgatttttttttttttttttttttttgagacggagtctcactctgtcgcccaggctggagtgcagtggcacgatctcggctcactgcaagctctgcttcccgggttcacaccattctcctgcctcagcctcccaagtagctgggactacaggcggccgccaccatgcccggctaattttttgtattttttagtagagacggggtttcaccgtgttagccaggatggtctcgatctcctgacctctcgattcgcccacctcggcctcccaaagtactgggattacaggcatgagccaccgtgcccggcccactttctgatttgttaaaagcaccccaaacatagtattattcgctagcatccaggcagtagaagaggaagcacaagtttatctgtgatgtttgctcgggattatgttccgcccttgaaaagtttaaagaggacgggagagaataaccgtttttttcattatcattaaattttctctggaaaccttttattacatcagggtgaggaggagtaaaatgtttaatacaccatttagcttatagtgccagagtaaaggctcagttgatgattagatgtgtggtcatatagaattggcaacacaaggtctaaatgacacataaactgtttctatatttatataatagcgcatcagggtcactaagaataaaggctaaattgtattgagtgcttattatgcagaagcactgtgctcgcatgctccaactgccttatgtcctttcatctttcacaaataacactctgtagtcaatgtatcacccccagtttcacagctgcaaaagcaggctcagagtgcttaaataacttgcttaaggtcacatagctagtaggtgagagagttaattttcagacccaattctaacaatcaaactcttaactctcttttatcggccatgtccctggaaaaccaaagacatgattgaatggatagaactatggagataattcttccctcctctaacaagagtatatttactactgtgtaagttaatttctttttaatgacaaaacagagcagaacaaaaataacaacttctccctcctgctggtaatgatttgtccctgtagaaaaaggaaataccaatgtcacattttctcataattagttaactgagtgaaactgaagtttcagggaaacctgccatgctaaaccccagtggaaacattaagttttaatgttacatctggaaactggagccctactccttgttagaagataagcttggcagtgattgattgcactgtcctctgcatttcctctgtattgaatgcctatcacttcgtcatttaaattgctcctggagccatctcctgggcccaggctgcttccctggctctgagaactcatcttcctttctgtcaccttagcctgcttattttacaggctccttggaatgctgcgcttaccgctgcttcacttactgctgctacctgtgccagcacactcagggcaggtcatcttccaactaatgtctgttcatttacaaaataaaaggcattagtggcttctcaaagaaagtgccagcaatctgctgcatgccccactggaacatctgaggcaggcatccctctcctgtcctacctcttagacctgttgtcaactatggccgtcacattctagggcagcttttttgttgcagcagtaacatagtggacatgaattgcagtaatggctatttggaaataaaattgtcacaaccacaatcactagtgtaaagtgttcaataatgaatccactgtcaggcttggagacggctgtacttggcagtaggttactgatatggtttggctgtgtccccacctaaatctcaccttgaattgtaataatccccatgtgtcaaggatggggccaggtagagataattgaatcatggagcagtttcccccatactgttttcgtgatagtgaataagtctcatgagatctgatggttttgtaaatgggagttcccctgcacaagctctctcttgcctgccaccatgtaagacatccctttgttcttccttcgtcttccgccatgattgtgaggcctccccagccatatggaactgtgagtccattaaacctctttcctttataaattatgcagtcttgagtatgtctttattagcaacatgagaatggattaatacagttatgcagtgaaacacactgtggcgtggcccaaactctttgaggcatcaatggctgtacctcatcaattcacttttctttcatgtatattactgaaatagatactattcataaaatatataaaatgttatctgctcagtttaaataataagcaaaacgaactactgtgtacttggccctcagactaagaagtaaaacatttgtaggaatttgggagcttcatgtcatttgcttccctaattatgtccccttccctctccttcagaaataactactattctgcctttttgttaatcatgtccttgtttcttcttgttttactacatatatgcatatcttacatatgaatggatacgtggatatataactcatatatgtattcctatatgtgtgtatatgtgtgtgtgtacatagttttatgtattttgaatttgtacaaattgaatcatgttgttatttgtttcttttgttcaaaagaataatttttgtgattcatccttatggatgagtgccatatgcatttcatcaatagttcatgttgtatactactctattgtatgagtatataccaatttatatatccaatctgctaatgaatatttacataaataacaggtttcttgggggtttgtttttgttttgctcttgcaaacaatattactatgaacattctcttttttgtaactcttcctcgtatccatgcgcttaaacctgggaatagcttaagttaggtggtagattatacacatatttaacttatagcattataacatgttgttttccagagtgatcattttaatatacactcccaacttcagtggataagagttcccattgatctacatcctcaccaacacttgatattaactaatttaaaaatgtttgctagtcttgtgaaagtatgaaatggcatctcaatgtgattttaatttgtagtcaatgattacacatgagatcaaacatcttttcatatacttatgggccatttgtgtttactcttctatgaaaggtctttttatttcttttactcacttttccccacctggttggttgtgttcttcttaatgatttatgaactttttaatgtattctatgtaaaaattattttgtttcctatgtgtgttgcaaattttctccagtttgtggcttatctgttcgagctctttttgatgtcatctgatgaatagatggatattctttattttactgcagtaaaatcattaatgttttctctatggtttatgcctttggtattttttaaagaaatctttcaaagcataatcataaagatattgtcttgtaaaatttttagaatgctttctttaatatttgataacttggaattgatttttgtggtttggtaagagataaaggtcaaatttaattttgattctgttcatatacataactagctatttcattttcattcattttcttcactgacttacaaagtctgtcgtctccctgtaaatgtgagtctctaggttctattttctgttatattgatgaatatatctatccctgtgctattgttttagttgttataactttggtatgagtccagatatctgttggaggatatatcctgtaatttgtcctttgggagtgacttggttataattgagttttgcctgtttcatataaattataaaattagcgtatcaaattttgtggtgaaattttttatgaaaattgcatgaatctataaatttgtataaagaaaattgatatttctatgataatgcatcattctattccaagccacatctcttgacatttaattggctttttcaaatggctatgaatagagttttataatttccttcatgaaggatttggtcatttttgtgttaaatatattcctaggtactttatatttttagtgacaatttgtatgttgtatttttaaaattatgttttctaagtagtctttgctggcatattgaaatgcagttgaattttaaaatcttgtttctttatcaatattcctgctaaagttttaaattcataaatcttatctgaagcgtctttttgtgggaagagaattctatataggcaatctcatctacaaagaattttgtttcgtcctttccaatcattatgctttgtatacatatttctggtgctttctgcactggttaaaaccttcagtgcagtattgactagtaacagagatagtcagcatcattgacttgttcctgatcccaaagtgagtgccatccacaagtcacaattaagtaagaagttcactgccaggtggtcatgatgcaggtgacagtacttgttttgtggatatttcttataaggatcttttccttcgctctaatttgttaaattcaacagatgttgaattttatttaatactcttttcttcatcttgagagatgacaatttttttccccttggtctgttaatatggtgcattttactaattgatttttaaatagaaatcaatatcgtatttatgagaagaactcagattggttcttatatttaccgcctttatacattgctagatttgatttgctaatattttgtttagatatttacatccatgttcataagtgtgattagtctttaattttgctttctattatgtagtatgtatatgatattcatagcttaaaatgaattaggaagggtttcctcttttataatctctggaaggctttgtacaatacttgagctacctatttctggaatatcttgtatatactactattattttcattttacagatgagaaaacatgcctattgagtaaaaggtagaactaggatgtgaactcaggtgatctggatccagatccttttcttaaccatttctctgtactgtctgtcaatagcattgctgaaatttgagctggtgtaataggaaatcatgatattatttgttaaataaagacctcataattgtatgaggtctttttattgggtagaaagtgattattaaagatgggaattttttattcatgtaagtaagaaaaacccttgacacagaaaaacattcaaagatatattttggatccacttcttgtagccccatacttcataatcaagaaaatagggttccaatctcctgtcaataacattcatttttttaaatagtagagttctcaaaaggtagctattcccttaaagagatatcacaagtaggaagataattattatgaccatgatgactacgagtaaagaagattaagaaagttagatactggctgggtgctgtggcctacacctgtaatcttagcactttgggaggccgaggcgatcacctgaggtgaggagtttgagaccagcctagccaacatcgtgaaacctcgcctctgctaaaaatacaaaaataagcctgacatgatggtgcatgcctgtaatcccagctgcttggaaggctgagggaagagaagcatttgaacccaggaggcagaggttgcagagagccgagatcgtgccactgtactctagcctgggctacagagcaagactctgtctcaaaaaagtaaacttgactgatgttacagatggaaatatgtgcagatctttaattgcattgctaggtagagcctactgtactgagcgtcacagtacatcactttgcaatgactttgggctatcataaatataaagttgctagagtgtccttttttttgccccatatcagatttttcctatagaatccccgttgtaaaaaacagtgctcatttttgaggctctttctcttcccgctttagctcatgttgctttcgagctttagagagttacttctactctgcttgcgggaccctctctagacctcgcctttcttgtctttatttagccataagctttctgtcacctcctaccatctctctggcaggcaccttcattgtccttcatgcaggtctcacctcaatgctcattaatttccgtgtcttggaaccacctctatagacgctaaggacaaacaaagatgaattttcctgacaacttaaatgcccatgatttctccttccttattgcctgttttgtttttttgagtgtgttccaattttctttcctcatgggtaatgttgctcttcttatttgactataaactcagtgaatagagacattgccctattctgtgctgtgccctggcacagaactgattctctctatacaagtcttactgttaaatttgctgcagtatgtggtgttggcaaacagaaactttcattacacatctttgaatcccattgcagcctcattaatattcttccctgttgtagaagataggtcactcctggtctttttccagagattcagttactatgtgctgaaaagatggccttttgtggtagtctcagtgggtgttccctatagactgtgttttgaaaggaaaagaataaaaatgatagcatattttttcttagttagccttctttcacaaatcctaggaaaatagataattcactgctgattaaaaaacagaacaaaacaaaacaaaacaaacccccctgggctttccaaaatctggttatattgctttctatgtgtcctgaccctactattatctgtcatttacctttactaaatctcactattgattgtaaccatgtaatccttttgattgttctggtttttctggaatgctttgttggtgataattatctagttgtcttttgaaggttgattgtaagtggctggagaagatgagggaatactcttttttgtttgtttttgttttgttttgagatgaagtcttgctctgtcacccaggctggagtgcagtggcacaatctcggctcactgcaacctccgtctcccaggttcaagcaattctcctgtctcagccttccgagtagctgggattacaggcgtgcaccaccacgcccaggtaatattttgtctttttagtggagacagggtttcaccatgttggtcagcctggtctcaaactcctgacctcaggcaatctgcctgccttggcctcccaaagtgctgggattacaggcatgagccaccatgcccagctgcgggaatactctttattaaaatttacctacagcattgcattgggttgcttttggggttatagaatatttaagttaaaatattaacacattgtaaaataaaaaagtaacgggaaaaaaggagttagaaaaaggaagagagctggtgtccaagtcctagtttacttttttttttttttttgagatggagtttcactgtgccacccaagctgtagtgcagtggcatgatctcagctcactgcaacctctgcctcccaggttcaagcgcttctcctgcctcagcctactgagcagctggaattacaggtgtgtgctaccatggccggctaatttttgtgttttttactagagatgatgtttcaccatgttggccaggctggtctcgaactcctgacctcatgtgatccacccgcctcagcctcccaaagttctggcattacaggcgtgagccaccacgcccggcccctagtttacttttaagtggaaagatgagaaggggccatcagacaaggtgatgtgtctggcaacaagtgaagagatcatagatttcatttccacagataagtcaatacagttatttaggaaatgagaaatctctgactctggtctttgtgtaatattctatgatagcagaaacaaaaaattgaattgtgcctattgttaaaagtttactttgtttatgatttctactgtatgaaattatatgatctgggttatattaacacccagtgaaaccaaggggctgggttggtacactgaaagttattataatataattctcatgtgaggctaattgttactatatttgtttttaatttgactagaaatcccaatatttaatcaaaagtcttctcctctacctagagcttgttttatcgttttggtggcctcctcttgcaaaggactggctggtgaatggtttccctgaattatggacttaccctaaacatatcttatcatcattaccagttgcaaaatattagaatgtgttgtcactgtttcatttgattcctagaaggttagtcttagatatgttactttaacctgtatgctgtagtgctttgaatgcattttttgtttgcatttttgtttgcccaacctgtcaattatagctgcttaggtctggactgtcctggataaagctgttaaaatattcaccagtccagccatcttacaagctaattaagtcaactaaatgcttccttgttttgccagacttgttatgtcaatcctcaatttctgggttcattttgggtgccctaaatcttagggtgtgactttcttagcatcctgtaacatccattcccaagcaagcacaacttcacataatactttccagaagttcattgctgaagcctttccttcacccagcagagcaacttgattttctacaacttccctcatcagagccacaagagtatgggatatggagaccactaaaactacatccctttggccttaccagggaaatattgggaaggaaggaccttgtattactacctaatgaccccatagtattgtttgacagtctatacaaccagatgagcaggcaaggtagtaccctgctaaagagacaggctttctcatatctcataaatatttcacatcctggttctacatgctggttttattccatattagccatgaggtcttcagcaaattacttaatgtcattaaacctcaatttcttcatcctgaaaatgaggatgataataataagagtatatatctaataggcttattgtgaggattaaattaggtaatataggcaaagacctagcatacagtttgcttacaaacatcaacaaaagaaagagacaggaagagatgaagtgtgcaagagagagtgagagcaaccatcaatgtcagacagccaaaaaatgggcatatagatttttttataaatagacctcatatgtctcatttgcatgggcttttgggatgattaaagcctattgttctctaggattacttgaaatacacatttcctgcaggttacagcccaatggacacagaatgacttgtgtattagtccatccattctcacattgctatacagaattacctgagactgggtaatttgtaaagaaaagaggtttcattggctcatggttccacaggctatacaggacgcatcgatggggaggcctcaggaaacttacaatcatggcagaaggcgaaggggaagcaggcacatcctacatggctggagcaggaggaagagaaagcaaagggggaggtgccccacatacttttaaacaaccagatctcgtgaagactcactcactatcgtgagaacaccgcaggggaaatccacacccatgatccaatcacctcccatcagacccctcctccatcactggggattacaattcaacatgagatttggtggggacacggatccaaaccgtatcaacttgtatcattctgagtaattgcaactttcgaatgggtggtagggttggcaattgccaaaagccatggtttggagtcacttgcatcaggcctgggtttccccctggagcaggctgagcttggctgccttctaaggcctcttctgctctggacatttacaggcttctgagccaggagagaacactaagcaatgaaacacaggaggaaaaattaaaaacaccacctttaaattttggaaagtattttggagatacctgtgccctgctctctaaggagttcctgtagggatttctgcttatgaattccagtatattgtttctctttgggatgacaaatggagtttctgttgccacaccttgccacagacccactttttgaaaaacactaaaatccactttgcaagtgtataaatattgcaggcaggcagcttccacattctttggcaagggaacaaaatactatttaataatgcaggttccagcttttctcctgacaatgcaaagtgccaatgattattgaaaagggaatttgaaatctgccagaatccactcagttttccttgtgtggttacatttccatcctgtcaccctcgctagtgaagacaattgtttcagccattgagaaaaaaaaaaaaaaggtattttataagattgcaagaaagtgatttaaaccatgactatgtctgttaactgtttgctttgtttctctgactgtgtgcctctctagtcacccaatcttctttagctatcctgtgggctttttcctgttgtcaaaaagcatggtctacccaaagccattcttcaagcatctgatttcccagctgtctttctgctatatatttaaacttctagttctctttggggaagagggtggtagacttgtgtgaggatatagtctgaatgaagtctccgagtgattttttgttgatgttataggggtgggagttcggggagaggagggagagtctttggcctcacactcccctctgagtcctgaatggggttctctcagcatctcattttcccgctactcctgacacactcctccctgaccctattttagaggtccctgttatcaaatggaagtgcttcttatgtcttccttcattctgctaagctgactgttctctatagaaatctgtacccccagcttttctaccaatgcgaatcttcgtttttggaaaatttcttttaccttctctaggaaatcattctctacatcactctatttctttagcaatcagggactacatttggatgtataagtatatacatattaagtttctagatattctttttctttttttaaaattattttttattttattattattatactttaagttttagggtacatgtgcacaatgtgcaggttagttacatatgtatacatgtgccatgctggtgtgctgcacccattaacacgtcatttagcattaggtatatctcctaatgccatccctcccccctccccccacgccacaatagtccccagagtgtgatgttccccttcctgtgtccatgtgttctcattgttcagttcccacctatgagtgagaacatgcggtgtttggttttttgtccttgtgatagtttactgagaatgatgatttccaatttcatccatgttcctacaaaggacatgaacttatcattttttatggctgcatagtattccatggtgtgtatgtgccacattttcttaacccagtctatcattgttggacatttgggttgcttccaagtctttgctattgtgaatagtgccacaataaatatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgttattttcttgtaaatttgtttgagttcattgtagattctggatattagccctttgtcagatgagtaggttgtgaaaattttctcccattttgtaggttacctgttcactctgatggtagttttttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccactttcagctttctgcatatggctagccagttttcccagcaccatttattaaatagggaatcctttccccattgcttgtttttctcaggtttgtcaaagatcagatagttgtagatatgtggtgttatttctgagggccctgttctgttccattgatctatatctctgttttggtaccagtaccatgctgttttggttactgtaggcttgtagtatagtttgaagtcaggtagtgtgattcctccagctttgttcttttggcttaggattgacttggtgatgtgggctcttttttggttccatatgaactttaaagtagttttttccaattctgtgaagaaagtcattggtagcttgatggggatggcattgaatctataaattaccttgggcagtatggccattttcacgatattgattcttcctactcatgagcatggaatgttgttccatttctttgtgtcctcttttatttcattgagcagttgtttgtagttctccttgaagaggtccttcgcatcccttgtaagttggattcctaggtattttattctctttgaagcaattgtgactgggagttcactcatgatttggctctctgtttgtctgtcattggtgtataagaatgcttgtgatttttgtacattgattttgtatcctgagactttgctgaagttgcttatcagcttaaggagattttgggctgagacaatggggttttctagatatacaatcatgtcatctgcaaaaagggacaatttgaattcctcttttcctaattgaataccctttatttccttctcctgcctaattgccctggccagaacttccaacactatgtcaaataggagtggtgagagagggcatccctgtcttgtgccagttttcaaagggaatgcttccagtttttgcccattcagtatgatattggctgtgggtttgtcatagatagctcttattattttgagatatgccccatgaatacctaatttattgagagtttttagcatgaagcgttgttgaattttgtcaaaggccttttctgcatctattgagataatcatgtggtttttgtctttggttctgtttatatgctggattccacttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcgtggactctttttggttggtaagctattgattattgccacaatttcagctcctgttattggtctattcagagattcaacttcttcctggtttagtcttgggagggtgtatgtgtcgaggaatttgtccatttcttctaggtattctagttgatttgcgtagaggtgtttgtagtattctctgatggtagtttgtatttctgtgggatcagtggtgatatcccctttatcattttttattgcatctatttgattcttctctctttttttctttattagtcttgctagtggtctatcaattttgttgatcctttcaaaaaaccagctcctggattctttaattttttgaagggttttttgtgtcactatttccttcagttctactctgattttagttatttcttgccttctgctagcttttgaatgtgtttgctcttgcttttctagttcttttaattgtgatgttagggtgtcaattttggatctttcctgctttctcttgtgggcatttagtgctataaatgtccctctacacactgctttgaatgtgtcccagagattctggtatgttgtgtctttgttctcgttgctttcatagaacatctttatttctgccttcgtttccttatgtacccagtagtcattcaggagcaggttgttcagtttccatgtagttgagtggttttgagtgagtttcttaatcctgagttctagtttgattgcactgtggtctgagagacagttttttataatttctgttcttttacatttgctgaggagagctttacttccaactatgtggtcaattttggaataggtgtggggtggtgctgaaaaaaatgtatattctgttgatttgggttggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatgcatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtcactgcacatgagatgggtttcctgaatacagcacactgatgggtcttgagtctttatccagtttgccagtctgtgtcttttaattggagcatttagtccatttacatttaaagttaatgttgttatgtgtgaagttgatcctgtcattatgatgttagctggttattttgcttgttagttgatgcagtttcttcctagcctcgatggtctttacaatttggcatgattttgtagtggctggtaccggttgttcctttctatgtttagtgcttccttcaggagctcttttagggcaggcctgctggtgacaaaatctctcagcatttgcttgtctgtaaagtattttatttctccttcacttatgaagcttagtttggctggatatgaaattctgggttggaaattcttgtctttaagaatgttgaatatcggcccccactctcttctggcttgtagagtttctgcccagagatccgctgttagtctgatgggcttccctttgtgggtaacccaacctgcctctctggctgcccttaacattttttccttcatttcaacttcggtgaatctgacaattatgtgccttggagttgctcttctcgaggagtatctttgtggcgttctctgtatttcctgagtctgaatgttggcctgcctttttagattggggaagttctcctggataatatcctgcagagtgttttccaacttggttccattctccccgtcactttcagatacaccaatcagacgtagatttggtcttttcacatagtcccatatttcttggagtctttgttcatttctttttattcttttttctctaaacttcccttctcgcttcatttcattcacttcatcttccatcactgataccctttcttccagttgatcgcatcggctcccgaggcttctggattcttcacgtagttctcaagccttggctttcagctccatcagctcctttaagcacttctctgtattggttattctagttatacattcttctaaatttttttcaaagtttttaacttgtttgcctttggtttgaatttcctcctgtagctcagagtaatttgatcgtctgaagccttcttctctcaactcgtcaaagtcattctccgtccatctttgttctgttgctggtgaggaactgcattcctttggaggaggagaggcgctctgctttttagagtttccagtctttctgctctgttttttccccatctttgtggttttatgtacttttggtctttgatgatggtgatgtacagatgggtttttggtgtggatgtcctttctgtttgttagttttccttctaacagacaggacccttagctgcaggtctgttggagtttgctagaggtccactccagaccctgtttgcctgggtatcagcagcagtcgctgcagaacagcagattttcgtgaaccacaaatgctgctgtctgatctttcctctggaagttttgtctcagaggagtacccggcagtgtgaggtgtcagtctgcccctactggggggtgcctcccagctaggctgctcaggggtcaggggtcaggggtcagggacccatttgaggaggaagtctgcccattctcagatctccagctgcatgctggggagaaccactgctctcttcaaagctgtcagacagggacatttaagtctgcagaggttactgctgtctttttgtttgtctgtgccctgcacccagaggtggagcctacagaggcaggcaggcctccttgagctgtggtgggctccacccagttcgagcttcctggctgctttgtttacctaagcaagcctgggcaatggcgggtgcccctcccccagtctcgctcccaccttgcagtttgatctcagactgctgtgctagcaatcagcgagattccgtgggcgtaggaccctccaatccaggtgcgagatataatctcctggtgtgccgttttttaagcccgttggaaaagcacagtattagggtgggagtgacctgattttccaggtgccgtctgtcacccctttctctgactagcaaagggaactccctgaccccttgtgcttcccaagtgaggcaatgcctcaccctgctttggctcgcgcacggtgcactgcatccactgtcctgtgcccactgtctggcattccctagtgagatgaacccggtacctcagatggaaatgcagaaatcacccgtcttctgcgtcactcacgctgggagctgtagaccggagctgttcatattcggccaccttggctcgacccctctctttttcttaagaatatatgaattcctatgaagaatgaaggtttagtcttgatttcatttcccttcctatcaactggacaataaaaatttgatctttaataaatataattgaagacttactgatacactgaagcctattctatttcaaattaatgttttatgtcttgggcatgcttcagaagtaaccatttacataacaattcttctaaggcataatgttgcttaatcaatttagcatgatatagtgaaagttaagatttatttttacttttctgaaataaaatgcttaatttttatattcttccaagtaataactgtcatatgcttatatggggaagattcaaaattaatgttttattataacccagtaggggtgggtctaggggagggatagcattaggagaaatacctaaagtagatgatgggttggtgggtgcagcaaaccaccacggcaagtgtatacctatgtaaagctgcacattctgcacgtgtatcccagaacttaaagtataataaaaaattgataaataaataatgcaaataatctatatttacaataataagtgagggtatgctcttgacattttatttattttttaattgtacacttttgccgtatgtgcattttgctggtatgtctctgaacatgacctttgctaaattaactccttcctgactttacttttgttccagtgaggggtgtttggctgttcttctttttggtttaaaaagcctttatattacagagtggtcagtttgctgctagtcactgagaagaaatgtaatgtgtatcctgatgactggatgacttataagcttataatctttttgagctctagtacatacttaactgtacttggcttctgaccttaaacatcattttccaaacagtcttgatgtttggtaaaaccagtaaccatccattactctcaggccacatcagacctgcttacagatatcactgggtgaaacatgagtacacttgttcaccccaagttcctttcagaggccttgaaggacactgctaaaacacatccagtgagttcagggaccctgatcacaggaagaatgcctgcctgatgttggaggaaggggtaaagccaacgcctgaagctttctctgtgcttctctgtaacagtcaccagagctacaggccagcagcacttttcttttacatggcaccttcctctcatttgtggggaaaataaggactttattagttcttccatttctcttaccctctcaggattatagctttatcatccaaatgccaggaaagtaaaacaaaacaaagttagacaatctaaattaaactctctcaacattatagggatgaaggaccttcagagtactagaacttcttaaaaaaaatctcttgcattgctacatcagtttccaacacacatattatttcattcaaatgttaagaaggggaaaagaatgttacagtgtactgtaattattttaggttcatgatgaaaatgctttacaagggtgggcgcggtggctcacgcctgtaatcccagcactttgggaggctgaggcgggtggatcactaggtcaggagatcgagaccatcctggctaacatggttaaaacccgtctctactaaaaatacaaaaaattagccgggtgtggtggcgggcgcctgtagtcccagctactcgagaggctgaggcaggagaattgcgtgaacccgggaggcagagcttgcagtgagctgagatggcgccactgcactccagtctgggtgagagtgcaagactccatctcaaaaaaaaaaaaaaaaaaaaaaaaaaagaaaagaaaaagaaaatgctttacaaatatgaaaactcctccctggttttttttgaaagcttaatgtttgcctaacaaaaccgtaaataggattctataatattgatgttagaaatgaatttatatttttctagttttaagggaatagctgtatattactttagatggtggtactatataaaaatatgttttcccattacatccaaaggtgacgatattaatttattgctagagaaagaattgatattgagttatagagattttccagaaggtattttaagaccctttgctggtcctttgtgactggcgtcatgtatgttacacagcaggttgaaagtgacatgctgtgattctggaagagtgtgagtctattggccctgtaacccatgagcttgttttcactaacccagtgctcaaagcaaattaattcacccacgaagtttgctttaacacttatctaagcgttactatcaatgttctaggaagtaacaagtatcattgctgatatacagctctgagttgactcataaacatttctgatctcatgagatagttgcagtggtgttttgctgtgtttactagatgcaactaacaaacaccatgagatttacaaagagatttgaagatatctgtgtctccaaaattgattgcaaggtgtagcaggggccagtaaggtgagctttcttccactccctagaatgtcttcctcaatccagattttaaagtgtattgaaatgatagccggctgaatcaccaggtcgaaaggatcaaccaactatttattaagcacttcatgtattttctgtcccatagagatttcagtgaaagatatagtgtggataaaacaaagagaaaaaagtgtcctcatgcttatgacttaatcgcagaagtggaacttagacatgtgaaacaattaaacaatttcacaacaacagataagcaaatgggatgctttggagagacatctggtccctgtgctgtttatagccaattccagtggtgaataaaagaagtggaacgaactgcttttgaagggagtgcatcctgatcctctggcagcaaggtagaggttttctgccaggagggaacactagacggaggctgtttgttttttctccaaacagaaatctcttccatgctaataggagcttcaaaaggattgccacagcagatggaaagaaccaatatatattcatgcatttaattagcaggaattaattgaattgggggattaattctgtcattagagagaaacaaaacctatttttgtctcccatctatggttacacaatctaagatggatttggcacaggtggtgtttgaatataaagccaccgtagtatctaatggccttttgatgccactgatggattaatcccagggatgatgagaaggtagccatgtgagatgtgtgctctgcaccatgtttcagcagtggaggagaagctggtaggtggagtgtgaggggtataaacctagaattcagtgagtgtttgaaggaggaaaaaggggaggagattgggagagtctcttctcttacatctgatttttttttctttttctttttcttttttattgagacggaatctcactctgtcactcaggctggagtgcagtggcgtgatctcggctcactgcaacctccgcctcctgggttcaagcaattctcttgtcttagcctcccaagtagctgggactacaggcttccaccgtcatgcccagctaatttttgtatttttagcagagacaagtttgtaccacgttggccaggctgatctcaaactcctgacctcaggtgattcacctgcctcggcctcccaaagtgctgggattacaggcgtgggccacagtgctcggtcacatctgattattaatgagagattaaggacagacacacctaagacagaatttttaattcaatctaacaagcacccattgcctggtcttccccctgcttttctttttttttttcttctccaaaaatctgttcctccagaaaagcagttttcatcctttttaatttttaggccaagatactcatgacataaaccagatgacattgtatgcataacacattcccataagtgacataggtaaaaagactgttgattatacccctttcccaacactgacaagtcaacaccagccctccgactcaaagcacatcacaattcaagtatatgatgtgacagtttgtacttttcaaaaatagccatggcattttctcccacctacacactcatcttgcaatgtgactttgatgctctttccattgaaatgtgggatctacgctctctctccttgtatatgcgcaaacgtggacttcagcaggaatgataccttgggatttccaaggcgaggtgagttgatcactgggctctcttgggatggttgcttttggaacccagccaccatcttataagaaagcccaagaagcacacgggaagcccaggaatcccacatgagaggatccaaggctcctagccgataccagtacccagttactagccatgtgtctgatcatatttgaactggatctttcagctcttagtggagcagctccaactgctgccaggtataacaaagacaaactatctctgcagaacgctgccccaaatgcagatttttgagcaaaagaaataattgggttttaagtcatatactttaccatgcaataatagatagttgatacagagttgcatgtcattagaagaataatcttaaatctgttctaatatgttaaaaaccttcagtagtttaacttttattataacaaataatttgtcacatgtctttttactgattgtgaaaaagtcctctaggcctagataaaaatgcagaggtctttagaaatttatataattcattctttttctcacctcatcttggacttattcagtatgcctatgtagaataatattaattacagtcatttttcttgagctgcttcccatttatgcctcattagcataattcacagcggtcatccatacctgtgaattcgtgttagattacctttgctgtgtttgatgattatactaaatttcatttttttgcgagctaagccttcacagtttgttgctcatgtaccatggctggctgctcacaaaatagaaaaattggacagaatgtttctgataaggtaaatacagcaaaggctatgcagaaatatgtatctcagagagtgagctattgggcagctatggtataagttatctggtagccacgcaagaagtaacggattgaataaaggcaaactatgaagacttcagtcatgataagatcaagagaattatttgtgtcacatttgcgatggattttgtctctgttggcacacacaaaaagttgggccttaaaactgtaaatttactttaacttcattttgtatgtcatgcattcatgaaactttttccgggggttattttcatttttggctgtcctgctccaagttaaacagaggagaaacagcatcatatagtggaagaaactcagacctggggaaggggggaggcaagtaaatgaaacaagagtcctttgtctctcagctggattgctaagtaatctgtgtgatcctgcaaaggtcagttcagatctcaagccctactttcctcatctatgaaatgaaaggttagactaagaccaaatacacgctagaaagtagagtattattactcctcaagaaatagtttagggttgtgactcttgctttgcacatgaaaatatttaggagtaaaagttcacagaacttggcaaagctagatgcatttatgattcccagtgaatcaactgatgtttttccctatgtcttttcaagccattctttgtttagcagtttttatatttacttttatttttttcttctataattttggaaaaaaagagttagctgactgctactatgggcagacaacaatgtggtaataggatattatttttaaaactaaaaaaataactgaatatgaaagatcaaacttttaaaaaatagacataagtgttcagagttgtgattctattttgcatgtaacaatgtagttatttcagttgctttattgagaatcacaaacatatatatatggctttgccaagttctgtatactttttattccccaatattgtcttctgtacagcaataattacaaccttaagccatcccttcagaagtagtcatatgccaaattctaccttagtctaaaataattctttttctgtgtgatggggctaaaaacatcagttctccctgctgctctccacagatgtccaggtaccttaatggttaggttctctgtaccttgagcttatttgcaaggcagagcctcaaaagaactgcttttttaatttttccactgatagaactggagcttggtaaactaacttgcccaaggtcatagcagttagtgatactcacaggacttaaacccaggaggtctgaatgtagactcaattatggcatatcccttcctaataataagccagattttgttttgtacttcttgccaaaatgtaactccatgatgacatttgttttgtacattgctgccttcttactgcctcaaacggggcctggcatggtgggaacaggtggggatcttagtctgttcctgctgctaggacaaaatatcttagactggatcatgtttaagtaatagaaatttattgctcatggttctggattctgggaagaccaagatcaaggtgctagcaaattactctctgcttcaaagatggaaagctcttgctgcatcctcacataatgggaaagcaaaaagaaatgaaaactgtgtcctcacatggtggaaaagatagaaaggacaggcagctttctcaaggctcttttagaagggcactgatttccttcatgagggtggagccttcgtgacttaatcacttcctaaaaggccccacctcttaataccacactggggattaagtttcaacatgaattttggagggtttatacaaacatacaaatcacagcagctgtcttctccctttcctgattccacatgacagaagccatctcttccttccgcacgtggatgtctgagcacatccagactcttgagagcccagacttaagagagagaggctgtgagaaggaagatggcagttctctcctggaagtcttgacttctcagtcccagctttgtgtgttggtatgtgtactgaaaaacaatttatttgaagatacagcatagaaggaaaaataaaccatttcctatgaagtaatgattcaacttctaacctgtaaaaatgaaaaatttctcagttccctacgcccttgcattcctgtcttcataagtttgtgatttaattttccaagaaacttaatattcatatacttaaaaacttttatatccattaacaacttgactttccctgcttctttgaattttggagcattgtttccttagtatgaaggagttttgagaaaggcaagaagacaagctcagagcttaagaaactatgaagaataatattgtaatcataacaactcattatttgtttttaagctcaatccttcagaaggttattatctggagttgaataataatagattcaggctctttttatgtggaggaaatcttaaacaacagtgttcatagggaaggacattaatcaggagagagaagtgagccttgtttctaataatgtttgcataatagctacccttgggtgtattgcttgacttaaaataaatattcatgcttttcacatccagtacaattggaaactactcgtggttatgattctgtcatatgatcttctacctattcaaggggacttcaaactgggaagctgttggaaaccaacaaacataaataacaacgcttgggagcgatatggggtacaagctgaaagatgctataatgttggctatggggagaaaaggagcgaagagtaggaacttaactgtttccagagggggggaagcagactcacactgacatgcttaaggacatttatatgctctcctggtttgcttttagctcttcaatagcttctcatcaccaggagaataaaatttaagtgccttatcttggtgtcagactcactccttggagtggttcctgtgaaaccttggatcgcgttacctgagactactctccacctcagatgtgacaacacaaagctctttgcagattccctcagacaccatgacttacttttatctctttgttcacatccttccttcatcttgcgaggatttttcaaagcttctttgttaattaatctatgtatcattgaagagtcagcttaaacttcacctgcttcaggaagccttctatgaactccacacctagtcaagagttttacccagactgtcctatttttattaacttatatatttagtgatccttaaatagcctttgtcctggggagttttttcatcatcttgctttattgcttacatgtacctaattttattacataaatgctttcagttagttaattcatttttctttccttttctgtctcctttctcctttctttatctgtttctctctctccctttttattaacttttaaattctgagaaatgtttcaatacagtcttgagaacataggctattttgttgttgtttttttgtttgttggttggttttgagacagagtctcgctctgtggctcaggctggagtgcagtggcatgatctcggctcactgcaacctctgcctcccaagggttcaagcagttctctgcctcagcctcctgagtagctgggattacgggcgcccaccaccacacctggccaattttttatatttttttatttttagtagagacagggtttcaccatcttggccaggctggtcttgaactcctgacctcgtgatccacctgccttggcctcccaaagtgctgggattacagatgtgagccaccatgcctggctgagaacataggctatgttttgaacttctgtgtgtgttacaaggctttgcattaactgctccctcatgcaactttcctaaccttctttctctcctattagagacattctgcttcagtcaggagaacatcctatagtattaaagtccaaactgatttgttctcttggacctgtgattgctaatacagctgttactcagtatctgtgggggattagttccaggaccccttgcagataccaaaatctacagatgttcaagtccctgatctaaaatagctcagtatttgcatatagcctttgcacatcctcccgtacacttcaagtcgtctttagattacttataatacctaatctaatacaaatgctatataaatagttgttatactgtatttttaaaatttattgtaatttttactgttgtatcattattattattttttgaatgttttcgatgtgaggttggttgaatctgcagatttggaacctgcagatacggagggccggctttactttccccagcctctccttccttgtccttcaacgcagggtttttgataaacaccatatccttggctcattatctgtgcttctaatccgatgggttctatattaacagagatatgtctgcccagcttcacatgccaattttacccttattggtaggctccttctgaaggtccatatgtctttttcatgtacttatgtgcagtcacaaaatactgaaaactgtgccttctgtttatataacatacctatttataaaacactttaaaaattttatcctaactaccgagaggtgagcagtgcagctgttaacctcatttgcaaatggagaattggttcaaaacgattgaataacttccaaaatttatgtgtccaataaattgtagcgattagaattagactccagttgagagcattgttcacattacaaacctgacaacagtgtttttttcactgtctgtaggccttgcagagcctagtagagttctgtgcatgatgaactcaatgggggcactggacacaggctcacacagggtctgtattatggtgctgatttgggcctctatacctccagagaattaagttactttaaactccactatggacatttataaaaggaagagtgagacactgtgttttcatagggttttttttttttttacacataacactttgttaattccctttctcttattttcatctctcttttcttctctttttctgttttcttttcagtcagttcaacaattaattggtgtgcacctacaatgtgcaaagcattatgctagggttcacaggggaatgcaaagaggatgctgcttatagcttgttatggcgaggcacttttcttctctccatttttctccattcttctcttcttcctaccttctttttcctctgatgttcaagtagccctcatcatttctataaatttccaaggcttcagcgttggtcaaagggaaggcactcagcccaggggcagtgagtaagtttaacattcttatggtcctttgcatctgctcacccaggactcatacatactcaatataaaagctttgggggttttgctcagtgacagctggggactctatgtaatttaatgcatgatacagcacttttggctaactctgtatgagagactactcaaataggaataaaatatcactttgcaaaatacatttaaattatttttcttctaaaactttgtgactttaaagccttaaaatctattttttgaaagccaaaaaataacagatgttggtgaggctgtggggaaaagggaatgcttatacactgttgttagaaatttaaattagtttagccactgtggaaagcagtttggagatttctcaaagaacttaaagcagaactaccattcgacccagcaatcccattactgggcatatacataaaggaaaagtaatcatcctaccaaaaacacatatgtactcactgttcatcttagtactatttacaatagtaaagacctggaatcaacataggtgcctatcagcagtggagcagataaagaaaatgtggtatatatacaccatggaatactacacagtcataaaaaagaatgaaatcatgtcctttgtaacaacatgggtgcagctgaagaccattatcctaagtgaattaatgcagaaacagaaaaccaaatattgcatcttcttacttgtaagtgggagctaaatcttgggtactcatggacacaaagatgggaacaatagacactgggaactctagaaggagacagggagggggacaaaggctgaaaaacctcttgttgagtactatgttcactgtctgggtgacaggatcaatagaagctcaaacctcagcgtcatgcaatatatccttgtaacaaacctgcacatgcatcccctgaatctaaaataaaaatgaatttttttttttttttttttttgagatggagtctcactctgtcgcctgggcaggagggcagtggcgcgatctccgctcactgcaactccacctctcgaattcaagcaattctcctgcctcagcctcccgagtagctgggattacaggtgtgccaccactctggctaatttctgtatttttggtagagacggggtctcaccatgttggccaagctggtcttgaactcctgacctcaaatgatccacccaccttggcttcccaaagtactgggattacaggcatgagccaccatgcctagcctctcattcctcttctacaccccacataaggtgcatgaatcattagacacatatatttttttttccctaaggctacgtattcctaaaagtagtttaagttacctattacctctaggcttttttttccataagaatcatcaataaattaaatgccaaacacgtggttgttttctcaagcacacaattaaaatagacttgattcctctttgctgtctccagtcctcttaatattcatagcaataggtatttatctatcatcacaaaacacacaaaaagactggtgattgcttaaatcccaagagggcaaagtagaaggaactagaaagaaggaagcaagtgcaatcatgattaggcagttactccgcatctgtggctgggttaggaacattcataggacttcatgaaccctactaagttacaacctgctcttttacaaatgtggaaactgaggctcagaggggttaaatgatttgcccagtgtcctactgcttaaagtatcagagttgagatttgaacccaatttgcgtgactccagtttttaaaatatttactgtaccaaggctggagggggcacgcatgggccctagaagggtgcgtggaatgggtacctgggtggggaagggttaaagagggggcctcggtctgcttgaccaagatattttccttccctgattcctgccccaaatgtagactacttatccaaaatatggatccaactttgtgtaatattttaataagagggtcttctactaatgggacatctctcttttgtctttcacagcaattttgcaggcagtaatagctggtgatcttatgaaggtaagatatcttcctaccaaatctttggcgatgctttaagaactttaaatcaacatcattcctcatcaaaactctatgttcccatctatcatttatcatcccctgcttgcactggctgggtagaagaggcaggatgttcttttgagaactgagcagagatggtgttcaagagcaccggggtacttgtctcagttacttaaaatgaactgcatgtccccaggatgcaatgtgcacagtgtgcctgccctctagaagctgacatttgaagaatttaaagatttcctttcaggcaggtattgaaatgaatgtatctgtaagaattacctgggcaacactcagaaatgcatccttcaggccagagattaatctttccttgtcgtggttttatactttggggatcatagttagtcaaacaaggactctcatagttagtcaaacaagaaccctgatccccttggaatagtttaatttgtgtttgtgttttctggtgagttttgttcagaaggaaggaagcggtcaccactgccctgagggtgaatgtaaaatctgaagtcagactttctaagtttggatctcggctctaccattcactgtctgtgtgattttgtgtaattatttgattctctctgtgccttagttttttcatcagtaaaatggagtaatattacctctctctttggcttgtcatgaggaattaatgtaataatacatataaagctctcaagactgttcctatttcatggaaggggctctaaaatgttagctattttattaatattctgatagtgtagatctgtgttttttaatagctaaacatggtggaaatacaaatatttgttatataatataacatcatctatgaatattctaaagctatatttggttttcaggcatcaggctgatgactgcccatatgcccctgcaaaccccctgctggaactgatctgctctgtattaatgacagctgcctgaaggcagaggctacgcctgactcctcagcctgtggagtgaggtgccattgcagatcaaggaaccaatagccctaagagaaagctgaacagtcctaccctcagacataactttttttaggcgcatctgttggacaaactgaaggacacctgtgctgcatttttcaacaggttactagaggaaaacaaatggtgaaaatgtttgcaaacatcttgatcaactgccccctttaggcacataatcctgaaaacggtgcctgtgccactgcacagatcatagtgtcaatagaaattgttacccagaagagaagagtgctctccaagcagtatattgatgagttcagtgccgtttcttaccagtggattaagcccataccatcctgtactctgtgcaaggccttccattaggttttgtgggaaacaaaggcatgaataaaattgattcctgcccttggtggatttctacaccagaaaattttgcaaagcactgtacatttgaaacccttccattttattttctatatgcttttagttcaggcaactgatttcccaagatcctgagtttattatcacacttttttttgtacttttaaataaagaatcatttgcaatgtgggaaatcactatatccagctggttgtcttattataggttggtgcaaaagtaatttggtttttgtcatttcagtgacaaaacctgcaatcatttttgcaccaacctaatgcattctctgttataattctttcctaaatgactaaaacatgacttaataacaccttattttgtttttgtttttggagatggagtctcgctctgtcacccaggctggagtgcagtggcacgatctcggctcactgcaagctccgcctcccgggttcacgccattctcctgccttagcctccctagtagctgggactacaggtgcctgccaccacacccagctaattttttgtatttttacttgagacggggtttcaccgtgttagccaggatgatctcgatctcctgaccttgtgatccgcttgccttggcctcctgaagtactgggattacagatgtgagccaccgcacctggccaataacaccttatttactgagagatggaatatttactgagggcttaaggttttactttttctctcttacatattttcttattttccttctcaaatattcatgccctcttcctcttctccaatatcttttgtttctttcttctgagcagaaagtgcaatatatataaaatattaaatgggatacatgtgtatatgtttgtatgagagagagggagagaaagagagagagagagagagacaaagagagcgagagatagagactagcgaagagaacatctctggagccacccctgtgtgaaggctgtcacaaatagctcctggacaactgggctgcagaaagtgtccgtggactaactgaatgttcatggtgtctagaaacagcacaggaaggcaggatcaaggcagttgaccctgaacaggtcccatgctgctatcctttgtcgatctccccacaaagaaagggagtgtcattttaagacaacgcagttgaatggaacaggatatccttttagagttttgtggaaaattgctagctacttcttcctgccctcttgccccccagtttagggatgttccttacctccattgtccttacctccattcagctactgctttggatccatgtcctgggaggtcttccgtggctgtttccatcccctgcttcatgcttccctagtgcttctctgagacctttgtgatgttcctgtccattactgtgtgattctttacctatccgtctccaccatgggctgtgagggctttgagcacagtgactgaattgtattcacatttatcttcctggcatctagcacatgacaattctatggatgtatttgagtgaagacgtgaactctgaatttaggttctttttttaagaaagtatttttaattgacaaatgattatacatattaatagagtacatagtgatgttttgatacgtatacagtgatcagatcagggtaattagcatatccaccacctcacacatttatcatttctttatgttgggaatgttcaacatcctccttctagctatttaaaactatttaatatattattaactatagtcatcctacaatggtatggaacactaggacttattctttgcatttaggtcatttatgctctttcaccttatgggatgtttgattatctataatgtgtgccatctaacttcttgagagataatgtgttccttttgcttattacctgctgggttatttaattctcatttgtcctaaaattacctgttagaagcttcatgcaggcactcttgtcatgaaatactgtagtttggagatgagggactcattcacattttctgtaatgttcaatattttataaacttagaccatatcctcatgtagccaccttatcctcaggctacaaaattctgttttgttttttttttccagtcttctctcatatagaaactactacattttctgaatcattttgggtctcactctgtggattatctctagcctattaggtatgtgttggatgattaacagaaggtttgcaggctgggctgcatatctggatgaagaaggaagccagatgtgtgttcgtgtgtgtgcatgcatgcatgcgtgtgtatgtgtctatacttgtattcagtgatcttacatgggagaaaaagaagcagctttgatatttggtatataggttcataagactgaagaaaaactgaaggacacaggcaagaagcttagctacagtcaccaagctatttctgcttatagccataattactctttcactcaggagaatgctaagccaacatagagatgcttttgttctccactccacccctcactactccttcgagagagagaccatagagaccagtgctcagaaaataaatgaaaaaagtaattcagcatgattcagtttccctagcctgttcaatacccacagactctctccagagttagaagagacactggtcatctctgtgagtgataacacagtccaggaatgttacttcacctttttgacttttctctatgtcctctaaggctggaaacattgtggtctgctacatgactctcattttattaccggttagctgttatccttgttccggattctgcctgagcttctttttgtatgtctctcttgcagctaatagaaagctataaaaatggaggcagtctgctaattcagggaccagaccactgttcactccttcactacgcagctaaaaccggcaacggggagattgtgaaatatatccttgaccacggtaagtaggcatagtgaacttaccaaggatcacttacctgtgaaatccattgcattttgcattttctaagttacccttcatccaggcagttttcagaatggcagaaatactctcgaacttttagcagactctgcccctgcttatttgaggcagtcgtggttgcagaccactgacacatacgggccatcctatccaagcaattagtagaaacagtgttcataccaagctctttacaggctatttttcagactaattagtttttttttttaaatagaggacaaaaataaatgcagcctggcatcgtgtgctttatttttttctagagctcttctgtaaattaatgggttgggattccctacctcacctgtatttgcggttcatcgttgtgaagattcatgaggataattgttttgcatctttccagtttctcatttttttttctgtttgatctcatttatcttttccacccaagttacgctttattctctttgaaaatgtctggtactattgtgttgtctgtggcagatcatactaaccttccagactgctttctaactggatttctaatagttggtgccagatcgtttgcaggaagtagcatgcgctatagcatctgcctctaaaaaccctttggaagcataaacatatttaatgaataccaaatctaaactgttacattgaatttatcatgttttgtagtatttctaggaataaagaacaggaataaaggggaaaaatactgcctagctagtctgttttaaatgagaaggaatgaaagagtctaattctgctggatcttggtatacagagagattggaaaagtttctttgagccctgacagtcagcctgtggctgactccttttgtacccaaattcagcctgtagatagtaagcatactcataaacattcacatcctttttgctcctttttttttttttttttttttttgcaattcagcaagtatgtcttattccattcattgattcattcatttaacaaatatttgtgtagtgcctaacaggagctgcctgttatagatggtacacagacaaaaataaaatacagtcactgttttcaagcaattgcaggctaaagaaaaaaataagatcatgtgtataattaaatttaaaaccgatatatggagctgttttaagtcctatggtaaagccacagatagataacatagctaccatttatcaagcacatatttgccaattgtttatagtaaacacatcccgtcatttgacaaggtccttgcaaggtaggtactaaactatcaatcacgttagacaccccttgctttgtcttcaacaccttctcactgtgaagattctgcttgaacccttggtctgaaatacggtagaaagggtgggttagaaaaaggaaagaccatgaaaacaggagggctgcgatgacagcatttctttactccttgtaggctgggttggataatcccaaacctgtctgccctggaaagcctaggtagataggatgtatttttggtgctaagtctggggcttgtatcattccatctcctatttccctggctattcagtctcttgcagttaaaagcgttcctttctgggcaagagtgaagccacactaatatctcaggatttctactgcacaaagctcaggtgagggttagatgtatactgtcactttatttttgtttagctcaggtttaaagttctcctatttgctgtcttcttgatcacttccaatctactctctttagtttaccctttacccaagagattgaatgcttgcttggataccttaagccatttggtgcccacctaccctctctctggagttaggtgagacactggccatctatttgagtgacaacacaatccaggaatctctctctccacacccccccacccatcttttcacctttcctggagaagcagtatttcctcccctagtcctaggatcctctctgtatccaccgtctcacttggtctcatttaggaggctgcagtcagctcctttttttgatgaggctttgttgaagatggactctcacatgtttggggctttcagctgggagggctgtggaaggccaggacacctaagcctttctcaacacctcgtctttttttcccaagatccttcacagcatggtagtgctggggttcccaggggtgagagtggaagctcccagatgtcctgaagctaagctgggaagttctggatgatctctactgcattctattggctaaaacaagtcacagggccagcccagatttaaaaggttgggaaacagattccactgtttgatggcacgagctgtgaaaaattcatggagatatttaatctaccacactcccttatgtcccggtctctgcagtttaaagtgaacaatgtcctaaacttctgactcacctggaatcccttagagcttcgtttttctatttgactttggttctgggtcttaagaacccaagtttcacaaataaaaatacaagatggccgggcatggtgggcccatagtcccagctacttgaggctgaggcagaaggattgcttgagcccaggaggtgtaagctgagtgagctagaattgcaccactgcactccagcctgggcagctgagccagactctgtctcttgaagaaaaaaaaatgataacaataatgaaggttttaacataagtatagcccatgcaatatttgaaatatgattatactaaaaatgaaaacagcagaactcctcatctgagttgccccagggacatgaatgatgagtcctgtgccccagggacatgaatgatgagtcctgggatgatatcaccttaacacagtagcttttcactttctctacttcctctcttcccctgcgtccaaaaatagggcctttaaaagcaccgttcatccaagctcacaggccttggagtttctaaccccaaatatagatcagtacacacctactttgcctggcatcaattcatctggcacattagtctctgagggccttgatcaaaacctaacattccaatacaaatcagtttctcatcaccccgcattgactcttgcaaagactgagtcacacaataccactccgcccaaatggaaggacacaaaggaattcagtcttttttaggggggtgggggtgcttatttttccagtgctttggttagatgttataaattaatcagcttaatatttatgctcacgagaagaaacacaatgttcacagtaatcatcctaacttcacttccaggcaaacaatttctgaggtctcagaaggcatcctatacctttcctgcctcaccaggatctctaatagcacaggaagaaagactgtggagatgggagagcacaatccatctcttttgtttgtaaagaaaatgttattatgatgttcagtccaaggatcaccgcatttttgatggatggcaatttttaacactttactactatagctgaatatggagacttaaatgcaattgattcttactgaaattagtttttatcaacattgatagacattgtcaatttcatttttgatgtctatcttatcttttttatttattcagaaatacggatgtaaaatcatttgatatagcctaattcacctcattccacaagagctaaacacttcagctcaactgtcgttttgttttttaatatctttagttgctgattcagtttatattaacctttgcattttattgaaaactatcatagcaaaaccattcctctcttttagatgatagaaactcctttaaattatagtgttcttgaagtcagagacaagtacacagaaaacattaccctttttcaatactgtaatcaccttcttaaggtgatctctcttgattgaaatactctctcctaacttagtaatgatgataactctggaatatcctgacctgacaaagaaatcagcctttccaagaggcctcagtaagtctgggatttagggatgtataccagactatggcattgtatttttaaattagcatcagatttgcagtaggtaagtctgatcagtttgaattcatgtaaatgaaaaaaaaaataacaaataaaaattttacactatgccgaagatcaagaaagacattcctcctggttattgaatattgcaaatctcttaaagcctttgttgtttatttacttattttttacaatttggtttatgtctgtcccatggtttcatatgacataaatctgaaaaattgttcaaagacttgactgtaaggatgcctttagtaatagcaattctgaaggattcacaggctctttgccaggtgcacagctgatgttgtttgtggctcttgagttgacacttcctttgcttcctgcagccttactcctgagcccctctcccctctgctctgccctcttcttcattggctctggtcaggagtgtgggccgccaccatcaagaggacacctgaacaagagtcctgagattagttattctcccagacacaacaagcagcaactgatttctcttctatgggctcttttaaagcaggctgggggctgtgccacatgagatctgcggtatgttctgaaagcgccatgggaggcttgaatttttttcggcttgcatcttcttcctttggatgtcttctctcatctatacagcatgctgctttcctttatgaaaaactggaatttggacatttagagagttgaaaagagactcggggaggaagagttaataattccacagagactgggagagagactaaggatgcagggattccagctgagattcctctcagtgcttcccgcttttcagctcctttcaaccatattttctgcccgctccctcccccctcgtttgcccctccaaccctccaagggacttttgtgttgtttctttccttcgccaccctgcacactctgctcttttgtttttattctccccacgcctaccccattgcctcctactggttttcctgatagaaatctcactcatgcatttcctttttgatttcaatgggttattttgtcttccctctttttctgtcttcagtctttcttttctctttttttaacccccctttttctgcctctggtcccagagagaactgaccaccatcctgctgggacaggatgacagtactgttagcattcccagtgccagctctccccacatctgtgcagcttttgtcctgtggcaggggaggatttggaatggtctgctggcagcgtcagggagactaatgggaaatgagggcccagagagaggccatgggaagtggaaggaatagcaaaggggatttggaggcattggtgtgggaagcaaattaaaggatgcatgtgacaaaaggcacgtcatatataatacaaatataatattgatgacaaagtcacatcagcgggagctggggtatccaacagaagagcctatggaatgagtactgggcagcaacattgtaatttggaaggcctggctgcttaacacgatgttcactttctcattttgaaagatttgtgaagttttgcttcctttcgcattccctgggtgtctcctgaatactgatgtgtatgtccacttaacagaattttctttcccttagctttcagaccatttcccatatagcacagtcttttgaatccatatttcaattgtgaatctttctcttaaagtgatattggctgggatccaaaatggctttaaaatgtcgtttattcattcattcattaaaacattttaattccgtcccaggcacttttgaggaaaaaaaagtttctgtaacaatcactgctaacctctttgttctaaatgttctaaatgcattatcatatttaatttttacaaccctatacagtaggctctcatctccgtttgacaggtgttgaaaactgaagtatggtgaagttaggttccttgccaaaactcatccatacgtgagagatggtctgtgtcctccatattcctaataccagcaagggaaatgaaacatggataaataaccacaatgcagggtggcaccacgtgaatgtcgtaagcagagttcaaatgacaactgatctagggttctggaagagcagaggccgttttcatctgaaattttcatggagaaatctgcacccatatctcctcaatagggattttatagtattttttctggttcaggtcagccaaaggatgaagggtggacatttcagtaaaccctggaagagacagagacctgagatttccttttctattgaggaaacaacagtgaattctctgctgacaatttgatgatctccctcgaaattccttaggggagatggcatagtgtctgcaatcagaacgtatgtgtatataaaacaagccccaaactcaaatgttacccattcatatatgttgaaggaattcaattatctttatttttatttttttgagacagaatctcactctgtcacccaggctagagtgcagtcatggctcactgtaactttgatctcctgggctcaagcaatcttccctccttagcctccctagtagctgggactacaggcatgtaccaccacgcccagctaatttttttttttttgtagagttggggtcttgctatgttacccaggctgctcttgaattcctgggctcaaacagtcctcccacctggctgtcccaaagtgctgggattacagacgtgaaccaccgtgcctgactagtctttatttttttctctcttgtttttctccttttgtctcgtttcctttattagtgagactcaaattaacttttcaaaaatcacaggtgttattgtttctacactaaaagtcacagggtacagttaaactccacattgtacagttaaagcatagctccccattgggcagtgcaggttcaaataaggagaagaacagccttgtcttaggcttctcctggcatccactctctgtaactccttccttgctagcattatgcaaacagttatcctaaagcaggccaaaaatgattagaaaatgtacctgtgcttttaaaaatagctgcccattcccatctgtagtcagctggctgctacttttgcctcttcttggccagtgttcagaacattctgctattttgtgattatctatgttgatgggagaataaggaaagttgaagttaattaaattgattatttcagagccattccccaaaccttttaatgggcattttttttttagatattaattatgagcaaaagtttcttgccttgttattagtgcctctgcctctcacctctgtcagctgcagaggatgaaagggcgtggagggaaggagagtgatgggtagccgcgggcatgcctgactcacagactggataatcagctctggaataattctgggtagtgactctggtcagaaattgtgaagaacagctttcttccttgtccccaccttcatattgtcaaattattgctgtgctagcccaattaaaagccttgaggatcccctcacttgcatagaggcttagaccctggataactgtggactcaccgtggcatggctctgagaacaccgaatgacagagctgaatgaaggagaaaagtaaacaaggcccctgttgcctaaatagttgtgcaattagcagtaccaatgggaacagagctactaatgagtgtaggctgctcatgttcatggaatttcttccaaaaggagtggcttagaatgttcactgaaggtgacaggcactctttaagaggaccattgggtacttaagccccttgctgacgtgaagagtgccctgttggcagctaaataggcctcaggtgcttgtttctcaggacatagaatttgagtcaacaagtgtcttcacatgtaagtgggagtaaagtgaccctttcataccacattccttcactgatgatcccatatcttgatgtagtgtgacctgctgtatcaggacagagaataggacacttcatgctatctaaagttgaagcagtacctgtggtgtgccaggcactgttttaagcacactatgtgtattgactcttttctttctttctttttttttttttgagaagtcttgctctgtcacccaggctgtcacccaggcagtgagcacaatctcggctcactgcaacctctgcctcctggattcaagcgattttcctgcctcagcctcctgagtagatgggattacaggcacacaccaccacgctgggctaattattgtatttttagtagagacggggttccaccatgttggtcaggctggtctcgaattcctgacctcaaatgatccacccgccttggcctcccaaagtgctgggataacaggcgtgagccaccatgcccagccctcttgaactctcacaacaaccctgtgagataaatattattattaatttgactttacatgggtgataaacaaggagctgagagattaattagacttggccaagacctagtctatatagagctgggatttttaaccaagaagggacagctccagaaacctcgcccctggtcactgtcctgtgctgctctgcacttttgtatgtgtgtgggaggataaggatcattattcatgttttcatagaatcacaggaccaaggaacaaagaggtatgagttaaatctttgttgtttccttaatatagggtaggtgctagaaggatacaaaaaataactgaggtgttcttatattcaacaaatatagaataatttatttatggaaggcatgcattcaaaaagcaaatacatagtatgaggatagaaccaaataagtgctttgggagctgagagaaagaatacattccttctgtcaaaggtcatcttttgagaggaccttgtcacagactagcctttgaagaacatgtcagatttagataggtggctgttctggatagggagagctgggaaagcctgagaaatatgtggttgagtgtgcaattaccactttagcttttgtgaaaaaaaaaaaaatggaaccctgggaacaaattgaggaaatgtagttccagatgaaagactgtgagctccagtgtttaaatacttgcaagtaagcagtagatatgatgtattggaaacctagaaatctagatgatataagaccttcttatctttcttggtaactacttctgcatgctaataatgttccaggcagatactggttaggaagtctatttgtcaaataggacaagcagaaaagacaaataggagagactttgcaagagaagattcacctggtcccagtgaatagcaggtgtgaaagagaagaggtcaagatgatttggatgaccaggagaattatgaaatcccataacatctctgttatgttgtccttggccaatgactttcatggtaagagtgataacctcttccaccccttcttactatgcacaataagttaatttttaataataatgatatccaccaataaagagagcaaattcccaggatcgtctttctaaagacaaaaatactcagtaccttgaactgtgtttggcacttacaagcatatttattcatccattcaatcaaatgtttaagcatctacttatctccaggctctacactagacaccaaggaatgacacaatgctagacaaagcatgggccaaaactttaaggggttttctggagtctagttatagggagagataaatcagtaggttattttaaaacggtttgttacgtgtcatgatcagtatcatgatcatatatccccccttgcctggggtggtcccaacttggatgataaatcccattacccattcaactataggaaatagggtcagtacataaagtgagggattgtataggcaggtgtttaataagctgcttgaagtgggatcatgaagggctttatggggaaaaaaagtctcattggatacccataggctgaagagggcaagagatggcagggagagaagcagtggtacagagctagaaaggaagacattccaagcagtgtttgtagattgaatggattaattcatgaatacacaaaacattgtgaaagggaaaattcacagaatatttccattcctaaggatgcatctatagtcatttgatgtatatgcatagtatttctttctggtctgagaagggaaattttataaaaactggaattgtaccctagatgatacgtatagtatcttacagccttaatattttgcttcataagacgccatcccaagcaactcgtttgagaatgagaaattgccctgattcctaaagcccacctaatcttcccctttctccctagttagccacttaattatttttcagttattctattccagttttatttcataaacttgatcgaaagctgcttgacagcagagaccataccattcttttttatctaccattctgtacatattggttcatggagattgggagtttggtgatgaggaggtagaggaatccttttatttttctttctgtcttattattcctatccccaaatttagctttccaaggcattttaattctgtgactatagattttctgttaatgtttagtttttgagcttatttttgacggtcatcttgctttcttcttatttaggaccttccgagttattggatatggcagacagtgaaacgtgagtgttgccttttattacatagtctaggttattttcttcagaacatatctgggagaagaatgtaatctatagagcatatcataggtaattttaacttaattaattcaaagtccactttcaactttgttcataaatgtgcagggctaatagcctaaataaaaaattacggaatagaaattgatgacaattgtcataatgcttgcctccatagtcagcgctaatcatcatttagagcttgcttcaaacaatgtacttctgcactggtgcatcttggaatgttgagaagtctaaataattacacttaccttttaatatacccatcacatttattctttctcaactggagtttctgaaaaaatggggccctactgccctaaggcattattcacatgtagtgacataacttctctctgttagtctagaacaggacaagttatgaaccaccactgaagaactgagaacatagtcactctattttctgtcttctgtggttcagagaagggatcctgattgaaaaagtcatcagctctgggatggtgcctaaactgatgataatgtttgttttcaaccttatttctaaagtagcgaaatagccactgctccccaaacaggaacaaagataggctgtacaactaatcctgaaagccatatttgaaaaggtataaagatgagttggtgtggagaggaatgaggtggtgagtagctaagcatgtgggaaggaggagaagtagaaatgaatagaatggaggacgaagagaagcagtagagctgtggaagaagctgtctatcactccatagagctggtccacatgccagcacatcctattggcaagattataagtggtgccatcacttaccccattttgccttctctaaaggctgctattgatttttcctgaaacactttggcgttaagcatcttggtgcctttgggctcaggataggaataccctcctccctatagagcctgtcagtgatggggaaatggccagtttcccttgctccttcccacactgagtggctggcctcaagcctgctgcctcctggggagagccctggctctcaaactctcccagggtctcactgtgcctctcagatatcctctgtggctgccccctccttccacctgccactcacacagaatctaaagtggatagagcagagtgggtgttggcctggttctttgaacttgggttctcaggagatactccactgcaggccgagtggccatcaaccaagggctgcgtgctgtgcctgaagggccagaggcgctccacactgctccctgttctttcacccagtgcctttctcgctctgctcaaatgtatgcacagaagagaatggcttcagtattcagatacatctagacaattagtctgtttaatactgcattgactatcacctaaatcaaatagtagtagcttttaaaaaaattactaaacttaatcaacactatttggaaagggggctagagtcagatattatgatcagttgatggctagctcaaggaatttttagaaatccccttccctacctccccagaatgtaccctacagccaaagtctcagcagcctacagggaaggaggctgaggagcaccctacatcagctcccctcacccattccctgctgcctccaacccctttatgggtggtttcccatttcatctttgatttaggggtgagactgcactgcacaaggctgcctgccagcggaaccgggctgtgtgccagcttctggtggatgcaggagcatctctgagaaagacggactccaaggtaactcgatgagtgagtgcaaacatcctcccgctgggcgagatcgcaggcgctgttgcctttgcttgtgaccatagcacggacatcctttctgtgcttatggaagtgcctggggctttggaaaaaggaggaaaaaatagagtgcttcatttagagaaactgtgatttaaatgtataagcacaaagggagggcgtgtgcttgcctatggggctttataaacctctgaacacgttgaccttgggactttggggttgtcctgctgagcgctagcagccaagtcatgggagttgaggtccaaagcccaaggagaggggtcaggaccattttcaaagactttggcctgactactgagaagcccctttggggttttccttcagtacttactccaacgtgttttaaattctatgatttatatggccccttatatgggtgccaaagggattctttcccagctcccaggatggtaggatctggctttgagatggtcatagtcttaaatctggtgtgtttatgtagttcttcatttttaaaaaattctttccatttgttttctaatattattctctaaaagttaacctcaggtactagatagcatgggaattactgtcatttataggtataggagctaaaagcctagagaaagttacacatacccttggaccagtagctgaggcttaaattaaattgagctcttttgacgtccagcccagtgttgtatcagcaggttggtggttctcatttggtgccagaacaccccagccacataacaaaatcggtttgtttatggagtctgttttgttgaggtacagtgatacctgtggcacttggcttgaaatgtggttggtttctccacagcaaaagttatgtaaatctgaacttaaagtgtccactttcttaggactatcttaataagagggcagtgaggccagatattgtactgtgacatgtatgccaaccttgatagcatcagctggcggaggtgaggccttaggggaaactctgtttaggagaactgagaacaagctgcaccacgagttgtttaagtttatagagagcacccaagagaaagggttgaaagatagagggaaggaggagttgtagcttagtagagttgacccagggctcagcctataagaaagaagagagagaaagaggagttagtttacatagaagatcaacaccatagagcaggggtgtccaatcttttggcttccctgggccacattggacgaagaagaattgtcttgggccacacatgaaatacactaacactaacaatagctgatgaactgaaaaaataaaaatcacacacacacacaaatcttacgatgttttaagaaagtttacgaatttccgttgagcctcattcgcatccatcctgggtcgcatatggcttgcgggctgtgggttggacaagcttgccatagaggattctgataagctctgagagttttagaacactctcggtagactccaggaaagaatgaaccacttacctatagacacttacagagaagaatcttgatatatagttgaggccttcattaagcaggtaccgagtagctcaggttttgggccaatggttgtaaccatgacacatacatagattacttagaagcctaattaatggcttaagctccattagatttatttaagtgataagaatctgcctatgtgcaatttttttccctggggcctcctcaaactgcagtccactttatgaaataactttgccttcctagtggactttctttcctttctgagccagttgtattacatagaactctccactttcctggcaacccatgagcacccttgctctctgaagtccctggctgcctaggtatatcaaacacacttgagctgtgtcctggtttctagtggtctgttacctgtctggctagctaattgggtacactatttcaaatggcagataattaggttggtgtaaaagtaattgtggtttttgccattaaaagtaataatttctcaatgtgatgttcttcccagatgttatttgcactcagatgttttgatgtttagcctgattgagaaacacacaacttatattcaggattaatggagccaggttatggggtagggttggtcttgccagggccactcagaccacagcagcacaactgcctctttaccacacaaaggctggtcctacactcaactcagatcattttaaaaacagagagaagccatgaaaaagagggacaaaccaaacaggaatcaggagacctggctcttgagcaggtctgcttttttatctttctaagtttctgaatcagataaaagactcaatgttcatggaaacttctttctgttttgtgttgtgtatgtgtctgctttttttaaaaaaaaaatggaaatagcttgtttttataattataaacccctcacatagaaaactagtaatgtaggaagatatgctccaaaaagcaaaaaattgctggaaacctcacaacctagacctagatatcattaaacttgtaatgatcccccttcacatgtagatatgcctgtttttctctcttgttgtttttaactagatgaagtcatacatacatgatatcgtataacttttcactcaacgttatattctagaggtcttaccacatgaaataatatagctatacttcattactttttaaggatttttaaattttgccattctgtaacttgatgctagtttaaagttgaatgtgatcattacaactgaatcttctcctggaattttttggagagaagcagcatcctgagaatttctcctattagagatcagttcctcagaaatcacctcaaaggcccacctcagcaacctctctgaatatttggaacctggaaattccaacctcattattatggaagtaaagacacaattatctactaaggctgcaaacaagttgaataaaaattattcaaggaacttcaaactagtggttaacggctaaatcccaagtgaataagtaacattttagaaagattctagagccattgttacttcccttttgtcctctccccagtaggctatgtagagcaggttggattgaggtcgccagtatctgttgggatagccgagatgaaagctgagaagtctctgataatatttataacacttgtgtgcatttgtacatggagctatttatttggtacaatgatcatgcctctacccttcctttggaacttaacataactttttaaatagttaaaactttatcattcaacaaaaattagaaattttgagcgatgccaagtaatatatacaggcattcaaaagaatggacactctttctccctttactgctgacttcttattcagtggcctcatttaaaaaatagcaatatatatatacaaatatatgtgtatatgtgtgtatataagtgtacaaaaggcattatagtagtctgtaagaaattatatgatcatttaacatgttgatgtaaaaaattaatgacaaatttatgatatattactaagaaaggttgtaaaacagtatgtaaatgaattgtggttttgtttttataaaaatacgtatagaggcatataaaagacaaaatctagttatcaatggaaggttagtagtggttatcttagtttggtggaatgattagggatattccttttcttctttgtgcttttcaagctttccaagatttctttaatcaatatctaccacttttgtattgagaaactagcttagtttttagagagatgaaatagcccaagtctgaaaccaataaagaaaacctttcaatttttttatgactatcccttccttttagtttctgtatgttgatttcccaagtttagaataatagaaagagtcctaaactagaaatctaaatgcctgcctccctattttttaaattcagtaatttctacctccccatcttccagaaaggctctgggtttcaaaactcgctttaccccactgtttccttctgtatactgttaacctctgtgaacttctgtttccctagtataaaccccacccgtcaaaagtgataaactctttccctttcatttaccaatcgcacatgttcaatttaatgctcatataagacaatagatttgaaagtgtcttgtaaactctaaaacaccaaatgtgaaaggatccttactagcaggtatccttgcgtagttctgtttctgtgatttttgttttgttttgttttttgtttttgtatttcacgactagcgcttgtgtctatctctctctctctttttttttttctcactattttcgtatagggtaagacacctcaagaaagagcacagcaggctggggacccagacttggctgcttacctagaaagccgtcagaactataaggtcattggccatgaggacctggaaactgctgtttgaccctggtattcgggcaaagaggacatgagcaagcgtatcacatctgccctccctgcaattgggcagctcccctggaagaagctgatggaattcatatatctgtctctctcctgcaagaatctacctgagaccatgccactagcttttaagggctaccaagatgtacaacagaacatgatagcccattgagaaggaggcaggatacctggagatttgtggaatacagtacgagttccacaaaatttgatccttattgcttccagcaagtagcatgaacttctgtgttcacctgtataatttattttaaagattcaaaggatgttcgtataaatggcactgctccatcctccccctatgcattggtttttttccctgtaccatacaattctactgtaactacccatcaacttaaagaaaaatattatctcttctctttacattcagtcttggaagaccacaagattgtctgaaggccttctaaaaccttctgaatgtcctgcagaaatataactgtaaaaccacttccatttctaagactaaatatatcaagactatttagtgactctctctgcatgtccccctcacccgccaaccctccgtttcattatataggagctgggaagtgccacatggataatgtcaacttgtgtgctatatctctgaggaatggtgaggtggcatgggagatgtctgtgcttggaggtacctcagagaggtaacccaggggtcagcccaggctgctgggctgtagccaatagccatgcaggactggttcagcttgggctgtctgtacagctccgtactgcctatgtgtagccatctttgccttttgctgcaatagaagatgagcaaaggattaaacagaggcccacagctagtttgcagaaccactcaattttaagtgctgtttaaattgcagagcaaataatcctgtgtgggaactgtggttacaggaaatggagcactctaacaatgtttacttctaaactttgttgaatgataatagaaagcaccctaattgacttggaaaaaaaaaacagcaaaagcaaaagtagcaacatatgtcaacatatgtcactgaaataggaaacagtcattggaatgttgcacagaggctaataactatagactgttggatacagtggtgagaggagccccattttaggtctttcttttaggtttttggttttcattactccaagtaatccttgacccaagaacaaaggcttgttgtatgagttccactgccagatttatgggatgcctggatcattcagaaggatgcttcaactattatttgtcaggtccaaaggtcgtacttgataaccccattttctatgtatggggtagtctaatatattattttatctactttatttttcccttttcagaaagtccttagtgcaaaccaccattggaatctagccagaaatgtctgtcagatagttagaattgtaacatctaaacctgccacggatcgaatggtacttacaggtacctctcttagggactctgtgatccctaaaatatcagaagaaaatgtctgtctttctgtccaaatatctacttgacttgggggtaagtcaaaaataaaagtaggtgtccaaggattttacttttggcgaaatctgacgtctcctgagcttattttcattttgtccttggacatagcatagtgcttccctaatgtttctacatatgaccatgaatgatagtgtctctacatttaatttaaaagtctaatggtgacattttgcttatctgagtcacatttcggtaacatatcatcattttgaaagtgcggctatgacgtgctatattaaacaggaacagcctttcagtggatggggattttattaccacagtctttccatagtcatttcaaaatcaaattgttggtgggaggatggattgggttgtgagtaatctacttccatatatcagcctcagaaatggaactatcctttggatattacaggagacactgcagcagattgtttccagaagctggaaaaatatgctccaggagaatttaatcactgggcttttgctgggggatttttagttggcgggactgtcaaggaaatgtgatgacagaaatataatccttaacacaaactggaatctggctttgaatggcatcttccattccctggattgagtcaaatgtttggccaagcagtcagttatctagctgttactgttgggatgaagaactctgttttcatcaactaccatctcacatttctctaaatacttccaagtagcccagagaaaatttagggtacaggtggctatgggccaatttctaaatagctccaattgaagacataaatctgtgttatgaaaaatgatgagttggtactgtaagattcctgatgcatttggaaattttttcaaaccaaaaaaaaaaaaggcattagagtcctgtgttattcatggagaccaatatttgatatatcgctttgaaaaaagcaagtaccactaggacttgggatttccaaaataaagtgagcagaataaccacatgtttaatggcttcaacattaaaccacctcctgtagcatgttttaaaaattggtcctgggctttggaaagagctaaggccttatggtctaggagtttccatctcagcttaagtatattgtatccctactattaggacatcaggaaagcaagtgatctagtcctggtctgaagagccatgtaactttaacagacataaaaatatgtacctatagaaatatcatttctacaaagcctactgagacagcactgaagaggcagctagcttggctgactcctctgtgtttgtttctttgtgtcatggcactgactgctttgagattccatttttagatgtggttgatagaggaatggaaaatgaagagttattaaaagacaacattctgtaacctgaaaggtagtcatttttgcaagcttatattttaatattgtgcatttaacaaaatagaacacagttaaactgtgctttatcgtattcaaggacttcataaagaataagagagaagattagtaagccaagaatggaataaataccatgactaggaattttgctttcagagcttatgtttcctctgtagatgtgataaccaaaaaccagtgcaagttttgaaacataatttagctggcaaatgcacagtgatggaaattagtaatgactgatggagagccgtacatacctgttgctccttatcctttcagaatggctgctttggcagatctgcctgtgctgggagctactcaacatcacttcattttcatctggacctagtgagagtccctttgcctaacgaatttctgaaatttatttatttactagaccccttataatattcatggctttaaaaaatgacacagcatctttattttattacatgtcaattttattaataatatttaggggtttttttaaattataaaaatggcacatgctttttataaaatgttttaataccacagatgagtatcacatccacagtcaaggcatccctttgttctggtgttgtgtcccacttcccaaaaataaatacggttaacactgatgaacactgttgctt

SEQ ID NO: 12413 - DNA, 41125 bp, Human
ttctttgcctcagtttccccatgtatgaaatggaggtcatacccccatcttcaaagtgtggacacagtttataacacatgcaaaaagtattcaaaaaccatacaaatgaaagcgcatgacggacatccctacttacatgtctcataagcaatctcaaacttaacaggcccaagatgaaattctcaatcatcccccaacacctactcctcacctttcccacctcagtaaatgtcaccacttcagtactctgggaaccattcttggttttcctcaaccaatccatcatccagtcctattcactttttttttttcctcgagacaaggtctcgctctgtcacccaggctggagtgtagtggtgtgatctcagctcactgcagcctcgaattcctcggctcaagggtttctcccacctcagcctcccaagcagctgggactacaggcgcgggccaccacaccaggctaatattttgtaattttgtagagacggaatcttgccatgttgcccaggctgctcgcaaactcctgggctcaagcgatcctcccctttggcctcccaaagtgctgggattacagccgtgggccactgcaccaggcccttcattcacttctatctgcactgtcaccaccctaatgtaagcgaaaatcatctctcacatgataatgaagcagccaaaatggtctctgggcttctcctgtactctctccagtccacaccagggctctaaaccctttaaactacccactgttcttgaaagaaaccaaacttctgaatctggcttaaaagaccctacatgacctcttcccctgctgctccctcaaaccactctccccgtccctgaccttgtgccagcacactggcgtttctgtagttctcaactgtattctgtttcctcctgacaaactcttaatcatcctttgggtctcatttcagagctgggtccccgccatacactctcagagcaccctgaagtacttaagcatttgtgtaattattttattacaaaaagtataaaatcacaaacttaaaaacccaatcgactataagctccataagggtaagtactgtcatctgtttggttcacctctgtatccccaggaaaacagggtccagcacacggtctgggctcaatatttgaacccagacgaggtgaggggggacaaagtagccacctaaaaatcctaactcaaaaagataaagttctaaccgtatgtggatgcccattttgtttcaactctctccacccccattctcaacggctcaggccaaatcatacatgggaccagatacctcaggtctccaagctcaggcagcccccgctgtcttccaccccataaagttctaagtccaaagtgagcccgtcctagctctggggcgagagaaaacaggcctctttcgcccctgcaggtgagggtcccggaccgcccggaggcaggttcctcatccagacctactggccaggactcctccacactattccgtgcagccatgacgcacgcagaccgcagcacttcgtcagcgaagaagccgctgagcgcgaggcgcttcttcgcggcttctcaagcaccgttcaaaccgcgcgtcgggcccaagtgcctagcttcgagtcgcaaagcctcagatgtccaccctattcaaggagaatggactgaaaagacgacgaccccggtcctctctctttaagaaccacccccattcgagcctgacgggggctctcagtaaactcgcgagagccaccggcttccgcccgcttcctcctctcgccttgccgggccggaagaaaggtggcacctcccaccccccagccttacctcacaaggcggcgcggacccagctgcagccaatcggcgggctcattgtaggctgcggggcagagagccaatgagaagtcgcggcggacgcccagcttctcctcactcgcaccggccccctcccttccgcctgccgccttccactccgcccctggcggaggaagtgatgtcacaggccccatgtgagcggattgcaacacatgcagctgcctggagagagggagccggtgtcctacgtcagagccgccgccgccgcggagccgccgccggggaggagcagccgctgccgcccaggactgggcccttaggtaaggcacagggagggaaaggccggtgacctttgtggcgagctgcaccggacgggaggagagggcctctgggggatggcgaggaagggggccgctctgccccagcggcggcgctaactctgtggtcttggtgtctccgggccccgccgggccgctctagggaggaggaggcgagaagatggcggacgaccccagtgctgccgacaggaacgtggagatctggaagatcaagaagctcattaagagcttggaggcggcccgcgggtgagcgccgcgtccggcaccctccgtgccctcttggttcccggacccctcaggatggacgcccccgcgccgcatggccggatgaggagaaccaggcactagccaactcccgccttctggatctctgggtagtagcccctgacccaggggcgagggtcggcgcggttggcccgagaaggggtcctttccccgcatgggggtaaggggcccgcgctccccggtttagatcactcggcccccctcgtggtaggccaccgctacttttgcacctctcccgggcccttaagtccaggtcctccctcttcgggctccaggtgctgccacccgactcgggtgctattgtggcaaagtgttcggccttcctttcccagggcccttccctgatttcctcttctcccttcatttctcagccaggcctcattaaaatggcctctcccttctgggcttctgagacccgggtgggtgaagtttggatgggacgggaagcagaggtggccagggacagcttctttctgattcctgatttctctgggtcttccacctgtcccaagatgacttctcccaagtcctctaattaccccggagcttcctggttttagctgttccaggacccacctataaactgaaaatgccaacgtacgcgcgatgtgaggggtgctgggtaggttttggttaatgaatctgcatgtgtatgtccaggagaaatacgggttagggggccgtttgataggaatcataactacagagtccctgctggcatttctctgaaacttgtggggatatcgctgtagagaggcgcctgatgtgcttgatgcttgttgagtgagattcataattgaattaaatgggctttgagtcttgtacattttgataagaaactgtaggtgtgtccattggggggagagtaggctagattaaaattagctgtgtgtgtgtgttttcttttttttttaacgttgttcgtttgaggaaggtgtgccaggggtattcctgtttcttttattactttattttgttcctttcccagtcatagaaactttttacttacaggaagtgcccccccccccaaaaaaaagtgtttggaacattattacatacttgtatgtctgagcattcttagaatagtagaatggcctgcctcaggccatgtgaaaagttgatttcagcacaagaatttgacattctggtttccagcccaggattgtcatttatgggtagatttgcaattttagaatgacagcccctccaagctcttcattattactgttatatgaaacaggatgtgcttaattgtactgaaggcccaattcacaggttggttttactagtgttttgttcttaataaattagggacagttctgtttggaatgaggcttctaaaagtttggccccattcagtgacgggcttgtgctcactccttcggtttactggagaaacgttagtttaatatgaatcgaagacagcggcttgttagtccttaggtttttctttgaattcaatagaatatccagaccttcttaatgatcttacaggaacttgtgccgtatgatagagtgaccagttattcccaaaatgtgagaatactgtacagaaagggtaatataggtcacgacccattatgttgcactaccaagaattagccaggttcttttgtttcagtaggatcttgttttgttacttgaagccttcaatccagtattgcattttatagattgctgttgttgcagtattgtatataggtggatgtgacctctggatttgttcttactgctttcagtagcaggcaggttcacacattttaatttgcatacgttatattctctgaaacagtccaaaaaattaaatcatgactataatttgcctgtttgaatgaagtaacattgaagatgacattgcttaataagtaacagcattcctttctactgcttaatgaaggaaactcattcttaaatttgttctacccatgttacctagccactagaaacttttaagcgcctctttaaggcttttgaaggctttacctctttgtttagcaaagttcagtaaagtttaaagcatgctaaaaatgaagttataagacacaacttgtatttcaagttgttgagtttggatatttcagacatgattaagctgtctaaaatagctggaggaccttccgctacacattgtggttaataatcatgtcctactttgcttttaatcaggatttggttgcatcttgatcccatggaaatttaaaatcttggccatctctgagtattggtaagggagtcagaagattccccagtatataccagtttttggaggtgggaatattttcattgccaacttgtgttaaagtcagactctagattttcatagatagggtacagtggaaaatgttattcctactttacctagtgataaaatatctttagaagaattgtaatgggctttaaagacttaagtggatggcaaaatgaatctgtatttgctgatgttttggggatactctggttttcaggaggaaactgaggttttcaggcatggttattaggacaaggtagtgagacttagtggttgagtaacagtattgttttggaaatgaaaaagccctttcctccccttagcagtgtagaattctaggcataggaatcatggatttgtttttaacagtagttattaaaatatgctagaataagagtgattttgaaattaagataatcctatgtggttatctcttgatatatgacccaaatttaatgtagcttgaaaaaggaaccacctgcaaaatgggctcactaactacatctgaataaagggaagtatgttggcaaaataatttattaagcacatactatattatagactgtgctacagtacattattaagtcatttaatcctcacaagtattgccaccatttggtagacaaggcacctgaggctaagagataatttgtccaagatgtcacagcaaaaatgtagcagagttcagaacttaaaccaatgtgctataatgggtatattttattttcagaaaatacaaaactagatttccttaaaatgtagtctgagctataacagattctattttatgttacacgtgtgtagaagagcatttatagaggccacattactaaaatggggaacttcatagcattctgttttgtaaccagcatcatacttaatcttctgagttgaaaggagtgtcacacataaacttgatttttgatttgggtagaacatgcttatttggtttcagataagcctggtcgaatgttagtttgtgtgtgctagtaaaataaccagttaattattttggtagacataggccccacttaaagttgatggtagttcttccctgttcatgattgctcctggtatatgctccacagttggcttatgaaggacaaatgtatacataaaccaatactgtggttgagggtatcttgaataaggaactaaaacaggtcaacgtatgttggaaaaagggggagaattattggttgttttttcccttggtgttttctgagcaggcaagaggtggcctcagaaataatgttggacaccttatagttttaaggtaatgttaataaaatcataactagagcctgtgctagccagggacagtggtgaatgtgacaaaggaatggacagtgttaatttgggttaggttgtgtctgtgggtgttaaaatgtcttcacttatcttcactaggaaaccttatgtgtttcttatccaatgaacacttggtcagataaccctcataaccataacccttgtttgaaggtcagtgagcttgcaaacttctgctgtagtgtttggacattttaaaaactgtttacttaaaaataacttgttgatatcttaattctaaatgaaataaaattggttgttcctgcccccaaatataaccatttttaaagaatccccactgaattcctcacattatatagatttaacagtgttttggcgagatcattgaataggttaatgttttaaatcttagagataattaatatgaacagattgcttaatttatatactttgaataaattaaggtatgttggatgtgtttgagtaccttccccaagtaaacattgttggttaatagaatattcacctaaatggtggtggaaataatattctcaaagcactgaatttcacattctttttttttttccctcactatcgttgaagggctggttgtagctaaaatgatacattgtggtctttgatacaaatacctgaaccatttaaagttcaggctcataaagaagactttttttgtcctctattctggctctttccatgcctcccttcccccaaactgttggttagacaaattaataggccacatgaggactgggcacgttgactcacacctgtaatcccagcactttgggaggccaaggtgggtggatcacttgaggtcaggagttcaagaccagcctagccaacatggtgaaaccctgtctctactaaaaatacaaaaatgagctgggtgtggtggcttgcacctgtaatcccagctactcgggaggctgaggcaggagaaatgcttgaaccttggaggcgtaggttgcagtgagccgagattccgccactgcactccagcctgggcaacagagtgaaactctgtctcaaaaataataggggcccaggccgggcgtggtggctcacgcctgtaatcctagcactttgggaggccaaggcaggtggatcacctgaggtcaggagtttgagaccagcctgaccaacatggagaaaccctgtctactaaaaatacaaaattagccaggcatggtggcgcatgcctgtaatctcagctactagggaggctgaggcaggagaatcgcttgaacctgggaggtggaggttgcggtgagccgagattgcgccattgcactccagcctgggcaacaagagcaaaactcagtctcagaaaaaaaaaaaataataataataataggggcctggtgcggtggctcacgcctgtaatcccagcactttgggaggccaaggtgggcaggtcacaaggtcaggagatcgagaccatcctggctaacacagtgaaaccctgtctctactaaaaatactagccaggcatggtggcgggcacctgtagtcccagctactcgggaggctgaggcaggagaatggcttgaacccgggaggcggagcttgcagtgagccgagattgcgccactgcactccagcctgggcgacagagcaagattccatctcaaaaaaaataataataacaataataataaataaagaccacatgagaaaaaagtcaagaactagactattttaagttttgtgagaagagatgaatatagaacaaacaactacagacttctcactctttccaaattttggtttccacatgtgtaactatggacattaatcttggattaggtggtaacagttgagataatatgggttaaaatacttaacaccacatttgccacatagagagtgctctgtaatgttagctctttccttttgtatatacaaacattgattctgtagagataccctaatggagaactgtattattaaaagatcaggatacagatgccacaggtctgaactatgagaaagaggagaaatagatgagagagaaaagaggtagtaaagggaagaggacagagtatatatgttagaaaggatgtggtggtggtccttagtttcctccaagtatgtaggctgcctgcttcaactcagaactagtcctaacagccgttgtatctggcatggtgttctatgcactgtgaacctaatgaacaattactccctttgaatttcaagtcttgacagacctcctattgtaatagcagatatacttatgcttccagggaaggaaggcttactctggacatattgcaaggtaagcaagagtacataattagagtatcatttaaggcagagtgctgtgtaggttataggtctctcccatcctccacaccagttggaccctttcttcacagggctcgttttctttgaacttgagattgaggatcggcccagtacagcaccaccccctgtcctgggatggtacttcattgttaaaaaagttagtgtcagctttgcagcagggctataaatggtcttcgatcctatttgaagagtaggaaggagaaatttgccttcccactgctggatctgttcaactaagaggctggacagtagaaattacttctcagtccagcctattctctagggctctcagaatagaaccttctcctaggatacattctgtaggtgtcttttaattcttcagcagcctactatcttagtgagggggagaaggaattaggaaggttcaggctttttttccccggcaggttagaaattgagagtctgaggtttctcactgggtactgtcctcagagagtatgatgaagctccctctgatacggttttatcttatgccatttgacacacatccttgcccactctctttactcttctcacaatcctttcaggttcagaggacttgacattttcaggtgcctggcaactggttcttatcatacagatagctctgcatgttgagtttgtactcttgttttcacattttcatttgttcttctaagatctcctttagaagaatgatcatagtcaaaataaaaggttctttttgttttcctgctgtgtctgtgaccttataaactagattttcctccaaaatacacatctgggtatatgaatatgaagccagaaatgcacttttactattaaccagtaagctaatgggcttcaccaaacatctgctgtgagttgggcactagacattttggaagaaatatgtaataaaatgaaaacatgatctgccacacaaccatggaatgataatataaaccattttcaactccatattagtgagtacagaataacacagtacatgttgaaggggatttagtataagcagatgattaaggtctttttttttttttttttttttttttttgaggcggagtctcgctttcccgcccaggcttgagtgcagtggtgcgatctcagcttactgcaacctccacctcccaggttcagctcagcctcccgagtagctgggattacaggtgtgtcccaccaagcctggctaattttttctttttttttttttgagacggtcttgctctcttgcccaggctggagtgcagtggcgtgatctcagctcactgcaacctccacctcccaggttcaagcgattctcctgcctcagcctcccaagtatctgagattacaggcacccgccaccacagccggctaatttttgcattttttagtagagacagagttttgccatgttggcaaagctggtctcgaactcctgacctcaggtgatccgcccgcctcggcctcccaaagtgctgggattacaggcgtgagccaccgcgcctggccgaaattcatcttttattaaaaggaggttgcagtgagccgagatcgtgccactgcactccagcctgggcaacatagccagtctctgtctcaaaaaaaaaagccaattattcatccatgggcttcagtttccccatctgcttcatgggggaactaatgctttcttcttcttctttaaaaaaggtaacattggctgggtatggttgctcatgcctgtaatcccagtactttgggaggtctaggcaggtagatcactgaggtaaggagttcaagaccagcctggccaacatggtgaaaacctgtctctactaaaaataaaaaaattagttgggtgtgttggcacatgcctgtaatcccagctactcgggaggctgaggcaagagaatcgcttgaacccaagaggcggaagttgcagtgagccaataccagcctgggctatagagggagactctgtctcaaaaaaaaaaaaaaaaaagaaactagttttctgaggatgagtaagcatacatttgacctcccccccttataaccttataacagctctgtgaggaaagctattattgccatttcatggatgaagaaattaaagtacatacagggagtaaatagctgcctaatatcacagcctttagtaagggtcagtgccagattctgtactcacttttctgatttcaaagcctgtggtgctaatttgtacaacactaccttgccctttggcaagtatttcttttgctgaatagagacgtctcccattcccttctgaaaggaagactcttgtccatggagatttgtaatttagtaggaggagcaggtgtgctgagactcaggtgcaaagatttaaaagaaaacagacatgctatttccaccctaggaagaacttggatactgaacatgtttattcttgacgagcatcagtggagagagaaataacttgttgcaaaatccctccccaggagctcattcgtatattagaaagatctaagtagtgaagtaatgaatcccgaacactggttgtgattgcagtctcttgctttgcactgttgtaagaacactagagaaattttccagcttcaaagctgcttcctggtggaatattccactgggtttgtgaagatcttttaatttttctttttaagactaataatgcctatcattgtagaaaaagtgtacacactctaccagatgtgtacatttttgttttagatgactgagtaaatctttgttctctgggggatagaaagctaaaatgaacctttgtgaactttattctgaaaatgtttggacatctgagttattctgtaccctagggtggaggttgctgtaatgtctcagtaagttccggtcttggtatttctcccatttggtaatagcatctgactctaaggtcaattgcataaactaatttcaggtaactttcctagtccctttgaagggtaacagaatcatccctcctaatttgatagtctaactaaaccttttataaaaggcagccccatccacctcctaacatgcctcatagatggtagtagcagagggagtggggtggcattaatgtgaggatcaacaaaattaaaatgacacttcataagggttggttttgtttagtgctggttttcttaaggtaaacgcctaatatagtatgatggtttgaacttttaggtgcagtgaaagatggggacagttagtcaatttaaggcacattagttcctctccaaggactgacaatttgttgttggtttttgttttgttttgtttttgaggtggagtcttgctctgtctccaggctggagtgcagtggtgcgatcttggctcaccgcaaccactgcctcccaggtttaagcgattcttctgcctcagactcccaagtaactggtactacaggtgcgtgccaccacatccagctaagttttgtatttttagtagagacagggtttcaccatgttggccaggatggtctcgatctcttgacctcgtgatccgcctgcctcggcctctcaaagtgctgggattacaggcgtgagccactgtgcccggccagatttttttattggtattttatttggtagtttagaataaatctctggtgtttgcttaaaaaagagtatatagagatgatggtaggaattggccatttattcatttttcaaatgtttgagcaccactatgtgctaaaatgatttttgccctcaggatgcttatatacacttgggctgggcccggtggctcacgcctgtaatcccagcactttgggaggctgaggtggatggagaggtcaggagttcgagaccagtctggccaacatggtgaaaccctttccgtactaaaaatgcaaaaattagccaggcgtggtggtccgtgtctgtaatcccagctacttgggaggctgaggcaagagaattgcttgaacccgggaggcggaggttgcagtgagtcgaaatggcgccactgtactccagcctgggttacagagtgagactccgtctcaaaaaaaaaaaaagaagcttatatacacttactgtaaacaatgtgtttcattgtttgatacttggtggaagagaaaagagaagttgagtatcaggtccctgtgaagactggccataggttatatcagaatactgaactcatgccacacaagttttagaaaggaatgaatttctatggttctcccttatgataaattacagagtttccagtgttctggccatattatttttggtatagctcttttgttctgtggaagatttggcaagtcctgtaatcccgtaaaggtgaccatcatctgctacaaaaaatcagctcatacttcaggacctaacaggattcaaataagacttcaaccccatctgatattacctctctcccctccccatttctagttgggctgtgctacttctttccaactggtactactggtggaggggaggcgatagtcaagaactagagctccatctcattaccatttagtgatcagttactatctgctctccaagctaggcacttgacatatatgatctcgtagaatcctcatgatcttgtgaagtaagtagaaacagacccacagggatttgtgtggtttgccttcggtcacacggccattaagtgatagagctggacgtgagcctgaatctgggctcctcctattctgttcccatattaaccccatatcaaaaagaccatcttagtttaaaagtttaaacttagttttgcaaatttgggagaagaaaaatggaaaacacacagtgaataaaacaatgacagttttggaaatggagtagaaattgaagaggaactgattgattttcaggtggtgatccatgtaatactgctggcttagtgactttcccagaaatgatctggctgagatttatttatttatttatttattttattttatttttttgaggcggagtctcgctctgtcgcccaagttggagtgcagtggctcgatctcggctcactgcaagctccgcctcccggttcacaccattctcctgcctcagcctcccaggtagctgggactataggcgcccgccaccacgcccggctaatttttttgcatttttagtagagatggggtttcaccctgttagccagggtgatctcaatctcctgacctcgtgatccgcccaccttggcctcccaaagtgctgggattacaggtgtgaaccactgcacctggcctctggctgagatttaaattgagctttgtgaggcaggcacagatgggagcttgaaaagggaagtggtgaaaaatttggccatccatagcctaggcacaacccagccatcaaaccctgggatgaaagcttcttggggagcatgtactgtacatcccggttagggagtatagtaagcagtgtctaaaacgttcctggtcctaacctgaaagtagttaacgtgatttacaagtgatgacttggatggcagagtacttgagggggagtgagtgttcgggctggtaaagttgagtatctctgagctgtcacaattcattatggttgtattatagctaggttgtcttaggttttgggggttttttgatttttgtttttgtgctgctataacagaataccacagattggtgttctggtaagggcctgctctctgcttttaagatggcaccttgaacgctgcatcctttgttggggaggaacactgttcctctcatggcaagagaacaaaagagagatggcccactacttataagcaccttattttatcttttttgtgtgcgcgtgtgactgtagctctcaggtcttataagcaccttattttaaatagcagcatgaatctattcatgagggcagagccctcataacctaaacacattccatatgccccacctttcaatactattgcagtggggattaagtttccaacacatgaatttggggggacaccttcaaaccatagcatagggtaaatgcagcaagcaactgctctgggttcttcttctttgggtggaggtgaggttgtggaggcttgttaccttcagcagacctagagatgaccctgtgaagaaagcaagccagatgcagtgattctcaaccctagttctgcattagaatcttgcgtatttgaggccgggcacagtcgctcacacctgtaatcccaattctttgggaggccaaggcagacagatcacttgaggtcaggagttcgagaccagcctggccaacatggtgaaaccctgcctctactaaaaatagccaggcattgtggcgcgtgcctgtaaccctagctacttgggaggctgaggcaggagaattgcttgaactggggaggcagaggttgcaaagatcagagatggcgccactgcactccagcctaggagacaagagtgagactctgtctcaaagaaaagaatcagctgggtgcggtggctaaagcctgtaatcccaacactttgggagactgaggtgggtggataatttgagatcaggggttcgagaccagcctggccaacatggcaaaaccccatcactactaaaaatacaacaattagctgggcgtggtagtgggcgcctgtatcccagctacttgggaggctgaggcagaagaatcacttgaatccagcaggcagaagctgcagtgagccgagatcacaccactgcactctagcctgggtggcagagcgagactctgtctcagagaaaaaaaaaatctttcatatttcaaaattgagactgtctcaaccaaaatcatcaccaccctcactctccctattcagaaactattgagtcaggatggaggaagaagggatcttttgtgtctgagcatgtattcttttattttgcttctttagaaagctctaaaaggattcagggctgggaggtatgcaaactgaagtgttcttgagcattgttgatgatggtgaacattgattaagatccttgtgggtcaggcgggcacggtcgcttgcgcctataaccttagctgctcagtgagtctgaggtgggaggagtgtttgggcccaagagttcgtgaccagcctgggcagccttgtgagatcctatctcgaaaataaaaagaaaaattagctgagcgtggtggtgcgtacctgtagtcccaggctagggtgggaggatcacttgaacccaggagtttccaggttacagtgagctgtgattgtgccactgcactccagtctgggtgacagagcaagaccccatctctaaaaaaattatctttctacttgagttttgtttgggatttatttggtttagttctgttacaattcctttttttcacctgtttgatttttcagacgttaaccctctgggcgaagcattgatgaaagctttgataagccaaagtgcccctaaaaccaatgagaacaagaagagaatctgagtgcagaggcccctgggagctttgagggatacattgctgtatgttgtctcttgttttgcccagtttttacaacctgcatgtgacacattgctgtaccccatgattcactagttctttgatttcggaagaggagtatagggatagtagaaaaacgaaggaaaactattacagttaaagaaggttgtagtttgcctgtgtagccagcatctccttagtgagagctttatttttcattttcccctgaagggtgttcactttaaaagacatggaagtattcagcttccttaattttattttgggtgtttacacaaactggtctaacaactttgattgacttgcaggagtgagggtaaatgaatgtttatcttgtttggaaactttactggaaaaacgttaatctgcttgttttttttgtttgtttgtttgtttggttttggtttttgttggttttgtttttgttttttgagatggagtctcgctctgtcacccaggctgtagtgcaatggcgggatcttggctcactgcaacctctgcctcccaggctcaagccgattctcctgctgggattacaagcatgcactaccacgcccagctagtttttgtatttttagtagagatgggtttcctcatgttggccaggctggtctcaaactcctgaccacaggtgatccacctgtctcggcttcccaaagtcctgggattacagacatgagccaccatgcctggcccagtctgcttgtattaaacctaacatacaaaacatcagaagttattaaagtaccctttaaatttttaaagtgaaagccatccatttaataatctgcatttcccctccctagtcaggtgtcttattttaaaggtaaattcagaaacttaatgtttcccccatagaaggtagggggagggggcatgcagggaaactagtgaaaggtaattttttgcacctaattcaaaaggaataagaagccaagaccaagtttcaagttttgtttcatttatcaactttgtagaaatctaccaaacaaaaaacaattcttaggcaagctacacttttgagccattttttaaagtggaatcctataacaagattacattcttaggtgtatttgctccttggtcctctggaatgttacatggatatggaatgtaaggttgcccaactgggctatacagtagggttgcttaatgaatgtttatcttcttaaactatcagcagtggaaagtaagtagctgcttatcttaaggtcattgctttgccctccacatcattatcttatttgaagggttgctgtaaggcattttgagttctctcagttaatttgtcccaaatttctcccctctttagccttaaacgttccaaatctttggggtttgttgcctgttcttcctcagctctgagactttacctttgccatccgttttcattccattccctgccgactgcatcttaggaaactattctctgtaagtcagagcatgtcggctttttaaaaaaccaacaccttttaagaaaaaacttccagccgggcatggtggctcacgcctgtaatcctagcactttgggaggctgaggcgggcggatcacctgaggtcgggagttcgagaccagcctgaccaacatagagaaaccccgtctctactaaaaatacaaaattagtcaggcatagtggcacatacctgaaaccccagctactcaggaggctgaggcaggagaatggcttgaacccaggaggcggaggttgcagtgaggtgacatcgtgccactgcactcctgcctggggaacaaaagggaaaccccctctcaaaaaaaaaaagaaaagaaagaacttcctacaaacccctagggttgtaggccccttgagaattggcttaccaagcataagccagtaaaattggtactcaagtgttttccccatcttttatctcttcgtattctccctgtgcatgagtggacccctgtgtcaggtaggtggcacctacagtctagattgtgatggaagttctgtttagttgcccagtgtttccagtctcttccaaagcaagtatcttttctctccattggcatgtatgtagagtttgacataactccagaaggaattatcaaaaaggttttttggaaattacagtttagaagcctagcaagtgttggtgatgataactgaagcagtgtatcataaatttccttgattccgtggtttggccagaatgcttgctcccctatccaaggggtggcagcagagcacacaccatactgtcctgtgtactgtctttgattagcttgtaatttattggggaaaatagcacagaagtttatgaaccagccttcaaggtagacacccaaacagaattctgatttttggatatgtaactttggctgccaatctgagagtagctatttttgatagtgggaggactggacagccagctcatctagttagaaagaaaactgttttctgggccgggtacagtggctcacacctgtaatcctagcactttgggaggccaaggcaggtggatcatgagctcaggagttccagaccagcccgaccaacatggtgaaaccacatctctactaaaaatacaaaaattagaaggtcaggcatggtggctcatgcctgtaatcccagtactttgggaggctgaggtgggcggatcacaaggtcgggagatcgagaacatcctggctaacatggtgaaaccccatctctactaaaaatacaaaaaattagctgggtgtggttgcatgcgcctgtagtctcagctcctcaggaggctgaggcagaagaattgcttgaacccaggaggcagagcttgcagtgagctgagatggcaccactgcactccagcctgggcagcagagcgagactccatctcaaaaaaaaaacaatagctgttgggcatgatggtgcatgcctgtaatcccagctactccagaggctgaggcaggagaattgcttaaacctgggaggcggaggttgcagtcagccaagatcatgccactgtactccagcctgagcaacagagcaagactccatcctggggggcagggggtaggcgggaagaaaaccattttctgcctggaaaacctgtggaattaaccactaggagaaaacttccagggcaagaggtcctgttaatgagatcccttcccaatgcaaataccgaagacactatagtacacgtttatgaaattttgctttatgaaaataagctttctaggacccaatttgagatattttcatattttaaacacctgtagttaaaagctaatatagggggtttattttcgttcccctcacagtgctgcttctgttcttactagtcacttaacacgtaagcccatttaatttgactctgtaaccagctttctgatttctttttcttgccagcttccactggactctggataggtgagattttattaaagctggcatattgggctactgtgagatgatgcactctcagtaattaggggaaagtttagatggttctggcagtctaactacaatattaaacttatataccctttaagggtatagatccaataatctataaggatctcaggaagtaactttcttacagtctcgtgaaatatcagatagaaacagtttataaagtgataacacatttctttttttttttttttttttaaacagagtctcactctgttgcccagactgaagtgagtggcgtgatctctgctcactgcaacctctgtctcccaagttcaagcgattctcctgcctcagccttcaaagtagctgggattataggcgtgtgccaccacacccagctaatttttgtatttttagtagagatggggtttcaccatcttggccaggctggtctcgaactcctgacctcaggtgatccacccgcctcggcctcccacagtgctgggattacaggtatgagctaccgcgcctggccaggtgatactgcattttttagtgtgcttcggttcatatcagatcagcctttgccttcaagatgtaagtcagctcaatttatactggtagctattgtactaaagccagcctttagatcaggtcagggcagatttgggatttctagtttcctatatgttgtagatttgattctgtttatactgctgcttgttctccttataaaattattaataggccagacatggtggctcacgcctgtaatcccatcactttgggaggctgaggcaggcggatcacgaggtcaggagttcgagaccagcctggccaacatagtgaaaccttatctctactaaaaatacaaaaattagccaggcgtggtggcgcacgcctgtactcccagctacttgggaggctgaggcaggagaatcgcttgaacccaggaggtggaggctgcagcaagccaagatcgccccactgcactccagcccgggtgacagtgtgagacttcatctcaaaaaaaaaaaaaattattaatagtaagctggtttttcttaacatgataaaattagaatttattgataatttagtaaaaacacaaattactacttctcgggaaaacatgctttggcttttatgggggaaactgtcaggttgagaccaagagacattaaaagaaatatcctgggtcctattatttttagtcatgatgaatgtattttgtataccatcttcatataataaaattaacttccaaaaatgtaaaaaagaaaaaaaaagggaaaggaaggaagaaaagaaagaaagaaatatcctggccgggcacggtggctcatgcctgtaatcccagcactttgggaggccaaggcgggcggatcatgaagtcaggagatcaagaccatcctggccaacatggtgaaaccccatctctactaaaaatacaaaaattagccgggtgtgatggcgtgtgcctgtagtcccagctactggggaggctgaggcaggagaattgcttgaacccaggaggcagaggctacagtgagccgagatcgcgccactgcactgcagcctggtgacagagcaagactccgtctcaaaaaaaaaaaaaaaaaacggaaagaaattttttttttttttaagagacacagtttcactctggtttccaggctgaagtgcagtggtgtgatcacggctcactgcagcctcaacctctagggcttaggtaattctcccacctcagtctcccaagtagctgagattacaggcacataccaccatacttgcctaatttttgtagagacaggtctcactatatttttttggtttttggtttgttgttttgtgacagtctcggtctgtcacccagtctggagtgtagtggcacgatttgggctcactgcaacctccatctcccaggttcgagcgattctcgtgcctcagactcccaagtagctggaattacaggcgtgtgccaccatgcccaacttttttttttttttttgagacagagtctcactctgtcacccaagctggagtgcagtggcacgatctcggctcactgcaccgcaacctctgcctcccaggttcaagcagttttcgtgcctcagcctccagagtagctgggattacaggcatgagccaccacgcctagcacacccagcaactttttgtatttttagtagaggtgaggtttcaccatagtggctaggctggtcttgaacccctggcctcaagtgatctgcctgcctcggcctcccagagtgctgggattgcaggtgtgagccaccatgcccagccagggtctcactgcatttcacaggctggtctcaaaactcctaggcgcaagcagttctgcctcaagcctcccaaagtgctgggattaccagtgtgagccacctcgcccagcctttcccctttaaagtgcattatttcactgtttttccagagttgtgcaaccactaattttaaaatattttccttaaaaaaagaaaaacagtatttccatcaacctaaaaatccctgtaccctttaacaatcactctgcattcctccctctcctcagcccctggcaaccactaatctacctttgtctctctggaatgcctattgtgaacattttgtgtaaatggaactatacaatatgtggtgttttttttgttttgagacagtttcactctgttgtcaggctggagtgcagtggcgtggtctcggctcactgcatcccccacctcccgggttcaagcgattctcctgcctcagcctccccagtagctgggactacaggcacatgccaccacgctcggctaatttttttgttttttccttgagacggagtctagctctgtcatccaggctgcagtgcagtggctctatctcggctcattgcaacctccgcctcccgggttcaagcgattctcctgcctcaccctcctgagtagctgagattacaggcacacaccaccacgcccggctaatttttgtatttttagtagagacggggtttcaccatgttggtcaggatggtctcggtctcttgacctcgtgatccgcccaccttggccccccgaaatgctgggattacaggcgtgagccactgtgccctgtctacaatatgtgttcttttgtgacagtttttacttgatgtagtgtaagggtttttttgtttgtttgtttgtttgtttgttttgagatggagtcttgctctttcgccccaaccagactgcagtggcgctatcttggctaactgcaagctctgcctcccgggttcacaccattctcctgactcagcctcctgaatagctgagactacaggcgcctgccactgcgcccggctaattttttgtatttttagtagagatggggtttcaccatgttagccaggatgatctcgatctcctgaccttgtgatcctcctgcctcagcctcccaaaatgctgggattacaggcatgagccaccacacctggccaatgtagtgtaagttaatgcaatatgtcatttattttattgctgaatagtttttagcatatgaatgtaccacattttgattattcatttatcagttggacatatgggttgtttctttttttcgtttgttttgtttttttttttactattatgaataatgcctccatgaacattgaagcacaaatttttgtgtgttacatattttgtcagttctcttgggtatctaactaagagtagagtggttgggtcatatggtaactctgtgtttaaactcctaaggactgccagactgttttctggaagtattgtaccacttaacattcccaacagcattgaatgaagatttcgatttcttcacatgctatgtctttgtagaaatgtctcctcacaccctttgcccattttttatttgggttttttgttgatgaattatgagtttttacatattctttatattctttacataaatcttaagagataatatgatttgcatatattttctcccattctgtgggtctttttactttcctaatgctatcctttgaagtccaaaggtcggtttttgggtttttttgagaatgaaagcaagttgattagagaagtaaaaaaaaccaaaaaaacaaaaaacaagagaatggctactctgtagagcagcctaaaagtttttaattttgaaatccacttgatgtagatcatctaatattttaaatagtcgtttatccatgttgtgactaaactaagaaaaatcaggatgagaaaagaaatgaaacttacaggaatcctttttgaaaaggaatcacctagaatgaactccccaggtgattttcatctgcaaaaaattgagaactgaactactgttttggggaagtgcatgctctaaaaaattttaacttacaggctgggcgcggtggctcacgcctgtaatcccagcactttgggaggctgaggcagggggatcacctgaggccgggagttcgagaccagcctggccaacatggtgaaacccagtctctactaaaaatacaaagaaaattaactgggcctggtggcacaagcctgtaatcccagctacttgggaggctgaggcaggagaatcgcttgaacctaggaggctgaggttgcagtgaactgagatggtgccactgcactccagcctgggcaacaagagcaagactccatctaaaaaaaataaataaataagttataaatggactaagtagttgatttttaagaatttttttcgttgtaaaaaatacataacatgaagtttaccatcttaaccatttacaagtgtatagttcagcagtattaagtacattcacactgttgtgcagccagtctctaggacttttcgtcttgtaaaactaaaacaactattaaacaactgcctagttccaccttactccagttgctggcaactgcatttctactctctgtctctatgaactttaatattctaggttacctcatgtaagcagaatcatacagtatttgtccttttctgtctggcttatttttcttagcataatgtgttcaaggttcatccattttgtgtgtcagaatttccttcctttaagactgaataatatttcattgtgcacacacaccacttttttttatttgttcatccaccagtggatgtttgggttgcttccacctctaggctattgtgaataatgctgctatgaacattggtgtgtaagtccccgctctcactcttgggtatgtaattgaaagtagaatggctagatcatatggtaattaggtgttaaaaaaaaatttttttttttggaagagctaccacacttatcccacatggctgtaccattttatattcccactggcaatgcacaagggttccaatttctccacatcctcaccaacactttgtttccttccttccttttttgagacagtcttatactgttgcccaggctggagtgcagtggcaaatcatagctcactgcagtttctaactcctgggcttgagtgatattcctgcctcagcctcctgaatagctagggctacaggcctgcatcacgtgacacccagctgattatttattttttgtacagatgggggcctcattatgttgcccaggctgttctcaaactcctggactcaagtgatcctcctaccttagcctcccaaagtgctgggattacaggtgtgagccactgtgtttgctttgcatagaagtaggaattttccgatgagatatttcttgactggtagtgatgataagtgtctttggaagttgtagacaaaaaagatatgttactggcattggtgttgaaatttaaagggggcttaaaaatgggttggtaactgctcagaagggacctcccatgtggcagggccttgatggtatttacccatttcctttagattttctagtttatgtgtatggaggtgttcataagggtctctcagaatcattctacttctgtgagatcagttgtaatgtcacctttgtcatctctgactgtacttatttggatcttctgtcgttttttctttgttaatgtagacagtggtttatcaatcttgtttatgctttcaaaaaaccaacttctggttaagttgattatttccctggattttggggtcttaattttgttcagttctgctctgattttagttcttttcttttgctaggtttggaattagtttgctcttatgtttctggttttccaagtatgatattggatcattagtttgatatctttctgacattttgagatacgcatttaacaagtgccccataaacatatgaaaaaaatgctcaacatcattaatcagagaaatccaaatcaaaaccgcaatgagacaacatctcacacacatcagcattgttattattaaaaagttaaaaaaccaaaatcttccataggtcagattttggtcccgttttttagttctaaaaacttgagtttggttgggcacccagaatttatcaggctgtcagtcattcctccttttaatcaaactcaaatgcaattaatatgttgccatttaaagagaatgagtttgtgagagagagatttttttttttttttctcgagactaagtctagctctgtcgcccaggctggagtgcagtgacatgatctcggctcactgcaacctccgcctcccggattcaagtgattctcgtgcctcagccacctgaatagctgggattacaggcacttgccaccatgcccagcgaattttttttttttttaattgagacgaggtttcactctgttggccaggcttgcctcgaactcctgaccttgtgatccgcccgcctcggcctcccaaagtgctgggattataagcgtgagccatcgtgcccggccgagagagagagatttcataactgggacatttctgtgacttccacagttctcctttcccatcattagaatactaaattcttgattacaaatatgcctagactttggaaagactcattgcatcatcctgtcatggcgtctcccactcaaccaccacatttgaaggctctcccacggacagattcactaccaaattccagcctgttgacactccttatttatcatagatagcttctttctttaggaaatgaggtgtttctcaagtatctctccaagtgtattctttacataacttacctcactattcaatcaaattgagcactagattctgaacactgttcctaactctgtgtatacgttcataaacaagactaatatagtccctacattactcctttgagagtgacctgtttccataactttggggcatctccctgtagcttgcttttaccagagagaaacatgagtttacttacatgatatttaaatccctaatgagttattctttcttccacagcaatggcaccagcatgatatcattgatcattcctcccaaagaccagatttcacgagtggcaaaaatgttagcggatgagtttggaactgcatctaacattaagtcacgagtaaaccgcctttcagtcctgggagccattacatctgtacaacaaagactcaaactttataacaaaggtaatctggagtttgctccttttccttctctacacattttggttatgttttatactgtgatgctgctatggtgctttgttcactaatgttcccttaagtcggctgtcatcagtgtctctttggccttggtggttagcttttttgttttgttttgttttttgtttattgaaagttaagtaggccaggcacagtggctcatgcctgtaatcccagcactttgggaagctgaggcaggtggatcacttgaggtcaggagttcgagaccagcctggacaacatggtgtgaaaccctgtctctacaaaaaatacaaaagttagccaggcctggtggcacacacctgtagtcccatctactctggaggctgaggcgagagaatcaactggacccgggaggtgggagttgcagtgagccacgatctcgctgctgcacactagcctgagtgacagagtgaggcgttgtctcaattttttttttttttttttttttttgggatgagacagagtcttgctctgtcacccagagactgaagtgcagtaatccgatctcagctcaccacaagcctcccaggttgaagtgattcttccgtctcagcctctcgagtagctgggactacaggtgcccatcaccacgcctggctactttttgtatttttcgtagagatggggtttcaccatgttggccaggttggtcttgaattcctgacgtcaggtgatccgcctacctcggcctcccagagtgctgggattacaggcgtgagccaccaccacgtccagcctgtttactttaaagaataaatcgtactgaaacgtctcagaagaagttttaaaattagggagagagttctgcctgagagatttcaagctttttctgctttatttaaattatgacttaaaggatcaggcagggaaaataggctatgggaacattttctattaattgacgaaaaactagatatggggtaaagtagaaaaattgtttgtgttctttgcagtacctccaaatggtctggttgtatactgtggaacaattgtaacagaagaaggaaaggaaaagaaagtcaacattgactttgaacctttcaaaccaattaatacgtcattgtatttgtgtgacaacaaattccatacagaggtaagaagtcaaacccagaacattttcatcgctccagaattctttccccgtacccattagcagtcagtcccccatccctcccacttacctgtctcattctaggcaaccactatattttctttccatagatatgcttgtgctgtacttcttttatttttatttttttatttttatttttttattttttttttagacggagtctcgctctgtctcccaggctggagtgcagtggtatgatctcggctcactgcaagctccgcctcccagattcaagggattctcctgtctcagcctcctgagtagctgggattgcaggcacatgccaccacacccagctaatttttttgtatttttagtagagatggtgtttaaacacattggtcaggctggtctcagactcctgacctcgtgatccacccaccttagcctcccaaagtactaggattacaggcatgagcaaccccgcccagcctggacattttatataatggaatcatatagtttgtggccttttgtgactggcttcttttactttatacttttaaggttccatgtggtagcattcatcagtacatttcatcccttttgattaccaagtagtattccattgtatacctatatgccatatttcatattttatatagcttctcgtttcatcagttttacatttgagtggtttgcactgtttggctgttctgaataatgctgctgtgaacattcatggacaagtttctatgtgaccatacattttcatgtttcttagatttgtggaatcgtgtaggttatatagtaattatgtttaactttttaagaagttgctagactgttttccaaaccgttgtaccattttacaaagctgtctgttttcaaaaagtaaggcaatttacatttattatgacactagtcattcagcatgttttgagacagagtctcacactgtcgcccaggctagagtgcagtggtgcaatcttggcccactgcaacctccatctccatggttcaagcgattcttgtgcctcaagcctcctgaataactgggattacaggtgtgcaccaccatgcctggctaattttttgtgtttttttagtagagacagagttttgccatgttggccaggcctgtcccaaactcctggcctcaagtgatctgctcgcttcagcctcccaaagtgtgtgtgtgtgtgtgtgttttgatttttgtgggtacatagtaggtgtatatggggtacatgagatgttttgatacaggcatgcaatgtgagctatcacactatggaaaatagggtacccatttcctcaagcgtatatccattgtgttacaagcagtccagttatactctttgagttattgcactcagttttcacataacaattgtaaaatttttagtagcagaactgtaagaactcattttcccccctttcccctgaaacttttgagtgacaaagctgccataggatgaacttgaacagtggaaaggaaacctcattagagtgacctaaatcagtcaacagtagaacaatcaagaattcacagctggctccttagttcattctcttgcctttcatcaacctagggaaaaacctctacagtggaattagaactgacatttgtcgacagtttacagtggatgatttttgctaacttgatgggaagtccatttatagttggatcttggtcgactgcatagacaatccagactgtttttctcttcactaccacactctacttacagcagagggtttttcagggagcctctcagccactgaaaccacttacctgtatctggttggatgaaagccgattttgaatcttgttgatttaaacagtgccaggtacccatgttgtctggcttttgctcacttactgagttagccttgttggcttttttccaaaccttaactccttttctaagatactgtttaatcttgctaactttgtacattttagctttaactgagagggttatatcctgtttatcagggtaattatatattctaataagggatatgcctattccctgataagcagatttattaaaaacttcaatctacctaacgggtcattttgataaggctatattattaacgtgcaatattcatattcatgtcttttttctttttctttttcttttttctgagattgagttttgctctgttgcccaggctggagtgcaatggcacgatctcggctccttgcaacttccacctcccgaattcaagtgattgtcctgcctcagcctcctgagtagctgggattacaagtgtgcaccaccacgcccaactaatttttgtatttttagtagatgagatttcaccatgttggctaggctggtctgaaactcctgacctcgagtgatccacccaccttggcctctcaaagtgccattgcaggcatgagccaccacgcccggccacaatattcatgtcttaatgccaactatctagcatggtttgttaaagatggattcttagttgatccatctgctttctagtcaattattgaaggggctattttcttaaaatggaatggtaaggccaggtgttgtggctcacacctatgtaatcccagcactttgggaggccaaagaggaggatcagtttataaaaataaaatggaatgggtaacaatttcttacttccaaagagattgtcccctggcaattagagatcaactaagtgtgtagtattccgattccactgtgagaactcttatctatgtatgtcccaggactgtttcaatattttctctttgggaaggcataaagggatataaagttaacatagaaggaaggttttcctcataaaactcagaatcattagctgcaatacctttaaagacatgctggctcatgcctgtaaccccggcactttgggaggctaaggcagaaggatcatttgagtccaagacttcgaggctgcagtgagctatgatggctactgcactccagcctggccagcaaagtgagaccctgtctcaaaaaaaaaaaaaaaaggaacaagttaaagtttttttgttttttgagacaaggtctctggatcacccaggctggagtacactggcacaatcttggctcactgcaacctacacctcccagactaaagcctttccaagtagctggtagggactacaggcacgtgtcaccacagccacctaatttttgtatttttttgtagagacagtgtttcgctacgttgcccaggccagtctcaaactcctgagctcaagccatctgcctgccacagcctcccatagtgctgggattacatgtgtgagccatcatacccagcttagaactctatattataaaactgaaactgtatccattgagcaataattccttgttcccccttttttccagcccctggcaaccaccatttgactttttgtctctgattttgattactccaggaacctcatataagtggagtcatacagtatttgtccttttttgacagggttatttcacttagcatgtattcaagtttcatccctgttgtagtgtgtttcaaaattttcttcctttttgagattgagtagtattaactgctgtatgtaatattgctataaacatgggcatacagatatctttgtggttttatatttacatgcccatgtcaaatgtgttgaaaagcttcacatagatatcattcgttatttccttattgggttcaaatttgtccataagagttacatgtttataactgaagtctataaattattccgtagaaggttttcccacagtgctaatagcatggtgagtggagtgaaagggcttgtatatatcctttcagagtttttttgaccttagcaaagctttgggattcaccgtgtggtacttgtgtttgcttttcaggctcttacagcactactttcagatgatagcaagtttggattcattgtaatagatggtagtggtgcactttttggcacactccaaggaaacacaagagaagtcctgcacaaattcactgtggatctcccaaagaaacacggtaatacaggaggagaacatgaacccacttactttgtgtctagcaataagaaaacagtatggtgggccgggtgcggtggctcacgcctgtaatcccagcactttgggaggccgagccgggtggatcacgaagtcagaagttcgagaccagcccggccctgtctctactaaaaatacaaaaatgtgacgggcgcctgtaatcccagctacttgtgaggctgaggcaggagaattgcttgaacccgggagacggaggttgcattgagccaagattgcgccactgcactccagtctgggcgacagagtgagactctgtctcaaaaaagagagagagagaaaacagtatgatgtgaggggagtgaatccagatgatggggagagaagcctcctgtaatgactggtgcctcattggtacttacagctcctctcttgacatagacttagtagtcgctctctgaaaacaagtagcagtttatgctgaacgtttagttaagggaatggtgatttttctttgtccttttcttagatgatgacatgattattttatttttaatttgaagacatcttgtagttcttaataattgcctttttctcttgctacttttgtgtcaaaggtagaggaggtcagtcagccttgcgttttgcccgtttaagaatggaaaagcgacataactatgttcggaaagtagcagagactgctgtgcagctgtttatttctggggacaaagtgaatgtggctggtctagttttagctggatccgctgactttaaaactgaactaagtcaatctgatatgtttgatcaggtaagtaagaagtagatgctttattatgtaagaccctaggtaggagtaggtgagtcctctgtgtgagcactggaacagacacatctttttaaaattccttgggttaaaaacttgcctctgagttaaacagcaggtttacagatgtttatcaggaaacattcccctgtgcttttctgaaccccttctcttctgaaatcaaccatttttaggtgggcttcttatggatcctgtggaggttccttgtttagttgggttgtcagaattggctgtagaatggagtttgatttcaaagaaactaaaacctgttccttattttctttttctgatttattcttggagatacatagcagcaaagctctcagcagtatgacagctgattcagcctaaagcatttaaagcacattttataacatgggctcagccataatacactttcaagatctggaggaagtagccttatggtagaaggtcccccaaagaaattgcctttaaaaaaaaaaaaaaatatatatatatatatatatatatatatatatatatattttttttttttttttttttttttttgagactgggtctggctatcttgcctaggctggagtgcagtggcaatcatggctcactgcagcctcgatctcccaggcttaagtgatcctcccagctcagcctcccaagtagctgggactacagggatgtgtcaccatgcccaactaatttttgtactttttggtagagacagggtttcaccatgttgcctaggctggtctcagaattcctggactcaagctgtctgcctctcctagcttcccaaagtgctgggattataggtgtgagccaccctccccagcccgtcttaacctctactaccttatttggcaggagccagtggtcccccctttcctccacaataacttatttttgtttgcacttaatgagttgtcctatagtaggtctaataaaatgtgtgatataattggcagtgctgttcactttaagagcagcttttgattaaattgggctccttccccatatttagacttcagtgatcataatgctgagctttgcataccattaagagttagtgggtttgagtaaaggtgttttaataatattttaaataagtaccagtaagtactaataatattttttttgtgtgttagaggttacaatcaaaagttttaaaattagttgatatatcctatggtggtgaaaatggattcaaccaagctattgagttatctactgaagtcctctccaacgtgaaattcattcaagagaagaaattaataggtatcggtgaaatgcaactacttattctgtgaaatgttttcgtgtgtgtgtgtgtgtgtgtgtgtgtgtgtgtgtgtgtgtatgtatgtacgtgattgtatgtatgagacaaggtaccaaaaatgtaaaaaggaatatttagtatttttattaactcttttgcctcagtaaaagcattattttttatcttctttagtcattaggtcgaataggtgtgtttgtatctactagggaaactttaatatatatcctgttgactgatccctaatcgtaggacgatactttgatgaaatcagccaggacacgggcaagtactgttttggcgttgaagatacactaaaggctttggaaatgggagctgtagaaattctaatagtctatgaaaatctggatataatgagatatgttcttcattgccaaggcacagaaggtatgagaattagaaaataaggttgctatttgttactgagccaggaagcctggggtggagatttgggagggatggctgatttcaggagcaatcagaaggtagatctacccattgttccccagtccttcagtctgtagcacattcctgcatagatttttctgcttgaactgtttaacgtctgcttaagattgttacatctgctgaggaccaggactatatcttgaacatctctgatgttccttatggttgaagcattgtacctagtagacactcagtgtatgctaacatgtttatggaaaaaatgttgagagattgagtccctgagcccttttctcatctaacctcatcttatggagcttacacagattagtatatgagagccaggttaacacattttttcctcctaatactacagaggagaaaattctctatctaactccagagcaagaaaaggataaatctcatttcacagacaaagaggtatgtgattattttcttggtttgatgatacgtgcaagcgtaaatccgtgtgttagagtactggctgtgtagagggtgagctttgggaaaccaaacctcatactaattgggggtgctgtgggaggtggtcatctatctgccacatacgaatctgatttcagggaaggagctgcagctttttttttttttttttttttttttttttttgagataaggtcttgctctgttgcccaagctggagtgcagtggcatgatctcggctcgctgcaacctccacctcctgggctcaagtgatcctcttgcctcagcctctctggtagctgggactacaggcatacaccaccacgcccaactaatttttgaattttttgtagagaggcgttttcaccatgttgccctgggctggtctcaaactcctgagctcaagcaatccacttacctcggcctcccaagtggtgggattacaggtgtgagccaccatgaccggtctttttttttttttctttgagatagggtcctggtctgtcacccaggctggattcagtggcacaatcatagctcactataacctcgaacccctgggctcaggcaatccttctgcctcagtctactgagtagccaggagtacaggcacaagccctcattccctttttttttttttttttttgaggtggagtttgctcttgtcacccaggctggagtgcagtggtgtgatctcggctcactgcaacctccacctcccgagttcaagcaattctcctgcctcagcctcccgagtagatgggactacaggcgcccgccaccacgcctgactaatttttgtatttttagtagagactgggtttcatcatgttggccaggctggtctcgaactcctgacctcaggtgatccacctgccttagcctcccaaaatgctgggattacaggcgtgagccaccatgccaggcagcctaattttttttatagaaatggggtcttgctgtgttcaccaggctggtcttgaactcctgggcccaagtgatcctcctacattggttttccagagtggtgagattacagacgtgacccaccatgcctggcctggtttttgtttgtttgtttgtttttgtctttgtttttaagtagttaagcaatcaggaaaacatttcattatccttgaaatttaatagggaggaaaatgtaatttacataatgcctctcctgcactgtgaaacctgtgctgctttcttcacttgatcagctcttccactgcagtggcttctctggtttgctctaagtgcatcacaacagttgaaagtatgaccctcccgtatgagataggtttaaatgatagcttcctcaaattctggtttggagagctttgttctctacgaggccactcccaaaagcagtcctggaatgtctcttctgagccattgaatgggtgctgcttagagacactacaacagcctgacttctagagtcaacagtaggaatcataagctgaatacccactgagtttttgtgttggtatttcatagctgagggtagagcctgaggagaagtgttgtttgaaataatccgaatttctctgctgatatccattaggttatcaaaaccagagatgacttacagagctttacacacagacatgcctataaatgggaggatgagagtgataggtgggcaaggggctgtgagagggactaattagccttcatatatcctaatcccccatttttgtatctcatggtcatccctgtagaccggacaggaacatgagcttatcgagagcatgcccctgttggaatggtttgctaacaactataaaaaatttggagctacgttggaaattgtcacagataaatcacaagaagggtctcagtttgtgaaaggatttggtggaattggaggtgagtagcaaatcagcaaaccaaacttaaaaccagggtctcaggtcaaggtccctcctggctagccctagccctgcttccggtgaggtgcttattatctgctgggataggtgattgacgcagcaggtgcaggttcctaatttggacccatgtttattattacctctttgctttctgcaattctgcaagagaatagggcttcccttattcccttaccagccacctacacacatgcccatcccatgaacacaggtaatttaccttttggtttgtttccccaggtatcttgcggtaccgagtagatttccagggaatggaataccaaggaggagacgatgaattttttgaccttgatgactactaggtagtcgacatgggtccggcaaaacgtgcctcaccctccagcatccaacccaaggagcatacccatggtggaatccaaacagatccctgccttacaattggaacatttccagaacttaatccatgagcattggatattgaaaagaaaaccgaaacaaaaccagacccagccctacactttggtttgtcatggtgtcagcgcagcagcctacaactaagttcctaaacgccactttggactaatttaaaaaagaatcccagtttttacttttactggatggtgaaattggttgctcttgtattttatgaaaaaaaatgatttttttaaccttcatacatagaagcaaaaatactttaactgctgtaaaccttcaaaagttaatagaagtgagatcatactggtttgtttcttattttgattggagaaaaattaaattgctgcatttcgcagtgacccatttacatggcattctcagcttagactgcgtaagaagaaatatatgtggtgaaatgttggaaccatttctctcttggtctctgtttaatgttgaaagggtgagctaataggaggcactttcaacttcactccctcacgctaccccgtccccctccagactggcagtttcaaggatgcaaattgcattgcaaaatcaaactgactcatgaagcatttgggccagtgcactgtttacttccatctgtttgcagacacatttgtgcccggcgtttgggagccctttgtatcaatgttctgacaagggtccctataaccttaacctactcgaaaccggtttgggatggatatgatggggcttctgtgctattgctgggattgggagaaataaaacatgcaatttaagtggaagcgaagaaatttaaagaggattttattttgcttgggtcaatccttgttaaaagggaggtggatgtgttttccttgtgttggatggcatgagattatgtgaatgttttgatttattaaaatgaactgcaaggtttttcacaggaacgacagacatgtatgactgcatgtaattataaactcctgacctcctggtggggttggagcatctgtttcaaatgtgggacttacaagcacttctcacatgagaaattaggggcgggtgggaagggatgggacacagcttctggcaccatggatttaagaccatgttggatccaaaagttggcctgaaaccctgaagctgatgcttcacagctgggctgtaagtcagacttgaacccagctgatatgcaaggtcatggcgtgcccagggtggtgacagttgaacaaagtgtatagtacgtgcccagtggtagcgatggaaaaaagtataccaaatggactttgaaggaccaaaggttttaaaagtcaattggtatcacctccacactgactagggtagtggggtgcatttggttttcaaattgggtacttttaacactttagtgcctgactgctgttctttactgacttgattcagtcactcgtagctttattggtctgaaccagctccttgttcccaggttacagacctgcctatcgttccaataatcctgtttcacttgaatgaagggagtatgtcttaaatgtaaagtttctggttctcacactgtactctgaggtccaaatactgtctgtcaatgtgtaacctgatgtctcaaccccctgtgagaagagtccattatttggtgttcaccaacgtgggagacttcaccggaacaggcttttttgctttgggctctgctatttgtttgcagaacacccaagagcgagcaaacatgctctcttcacagcagtaccttagggttttgccattgtaaatgggtctgatgtgatatgacaagaccagagaaattggatgtaaatttacatttttgaatatgcttgttgtttcacatgatacatttagggtatgcagctccttttgtagtttttatttttactatttaagtttggaaatgatgccaaatttttgtatttctttaatcaatgtgttctcttcggtgatatatattgcattatatattgatgtgtgtatcaatatatattgatatgtattacacttacacatacaaacacatataagagggggtgaaaaccgtagcctttgcattctctatagcctctgcagagagatactaagcagcaaaatcttggtgttgtgatgtacagaaatggagaagagtattaaaccatatttaagaatatactttgtgtgcttgagattttttaggactggtctagaaaggcctgaactgtggagacagttctccaaggcatacctcagattagtcacggccaatagcatttcagccttgggtttgagttgtgtttactacatttgtctatggaaaggtatatgcaaagtttttctgaggtcatgatcccagagttatgctagaagaagaaggttcaggttgctggggccaaactaatttgtattctcccccattctatatgcatgccaaagggaatcttgcttttttttttttttaaggtatgttaagtatattatcccataacccagcatcccatggaggtagatggtgtacccaattttacaggtgatgaaacagaacaaaagaaggttaagtagcagctctttagtgataacaccaaaattttatcccaggccttattccaaagttctctctgtatctgtctttgagtcctataatagaatggtccagatggaatagcagaaactaggcctgggccctctctctctcccacgctccttcatcttacataccttacactgggtaggagagtagtagcccacccaaaagcaggtcaggggctggtccagaggagcagggctcctaggccaggttcagagcagaagaggatttgttttctttgttttcccccaaggttgaggtgcttaaagagcctctttggtagtttaggaagcctagttgaggagccaaggtggtgcatggtttgctttctccaggtttgagaaaactgttttaagtaaaattgaccagtaatggcacttggcgtacttttcacccattttcttacctgatctaggtgatagctctgacgacgaaactcaattaccagctgggaaggggcgaacatgcctgtgctggtggaagtgtaattttccctcctaatgcgtgtctaggtgctgttcttgaagacaaaattgttggaaggcagcacagtggtgcaggatatatgggctgtggtccttgcctgtctgggcctgcagcacttgccatcttttgttctctggctccaagacgcatgccatgacactcccagacaggcacggtggatttagggctgagagccaaggtggaatttaagtttcatgccagcttctcctttgttgccagcttgagtgaatgccaggggattcctgcctgccaagtccagccctgatgggactgggtctcaggggacctaggaactgaacagccaagtggtgtgggagcatccgattagagctagggaagcagggcacagttacttgcttgttttgtggcagtttgggtgctgcaagttgctgaggatgtggctgaatagcaggcactagaaataacaggtgaaaacaattcaccacctaaagggttctctgtaaatcaagtctaaaaccctgtctggtgaattctgtttcagatacagccatctccaggagtccttccctgaaactggcaggcttacctggggcttagctaagagcccaaaaccaaacaagggagtcaagaaaagctctggttctgctgggcaccatggctcacgcctgtaaacccaacacttcaggaggccaaggcaggtggatcacccgaggtcaggagttcaagaccagcctgaccaacatggtgaaaccccgtctctactgaaattacaaaaactagccgaacaggtggtgggcgcctgtaatcccagctactcaggaggctgaggcacaagaattgcttgaacctgggaggcagaggttgcagtgagacgagatggcaccactgcactccagcctgggcgacagagagactgtctcgaaaaaaagaaaaaaaggctctggctctgcagttaactgggtttgtgacttcacagtatcaggcagtccctgaatctgaagtgccgtgccagccagcttcccaggaagctatcaggagagtgcagtaggaagcaggatctctgaggtctgaggtagaaatcctggcgccacctgagaggctggcaaattattcc

SEQ ID NO: 12414 - DNA, 94830 bp, Human
tctccaaacctcttttcccagagccccaaatacattgtgtacattttctgcatttgaagatatcagggaaaagttttaccaaatattttgttactgtttaacataacttgccatttttctaacttcttctaacagattcctcactattgcctgcccatccttgaagccaatgtgtttctcaggattttgttttatgcaccctagctcagattttgctattctgtcaaacaactgcaatctcttagggcttacaataacagatatttatttcttgcccatgctgcttaggcactatgggtcagctgtggctctggttggttctgaggggctcagctaaccgtcaaacattttcttattttctgggatccaggctaaagggacatgttcttattttggaaagcaaggactgctataaaggcaaaacatgcaaacacattttaaacatactcttggacatggcctacactgcattgacttacattccattggcaaaaggcagtcacatgtccaaacctaaagtcaatggatgggggctatactttgcctacagagaaatatgacaagtatgagtaggggacaaataagtattaacaaaaataaaatctaccaattcaattcactcgtaagtgtatggtagaagaaagacctggtaactttattaagttcctatgaattctacattccttcccttcaacatggctctttcataatcctgattattggtattattttctgactccagtggatagttaacattctgtgggttccagctttcatttcctcctcttcttttgataattaccaactaattgagtgtctcctgaagtcattggggaagcacatagctggaatggtggaggcagaaaacccaggcaagtgaccacgaggaaagccattattagaacaagcaaaatacaagagggtggagaaggagtggcaatatgaccactttaaggagttcatgaatgaaagatagtaagttggtaggaagtgtatggcttttaattcattaaaaacatagttctagagtgagacgaatactgcggtagactttaagactttgaacaagatatttgacatctttgaactttattttcattgcctgccaaatgaagacaatagctaaaagatagtattatgtgaaaatgcatattaaattgttaagtgtcttgcttattgatacttacctgtaccataacaggtggcagcaatgttttatatatatgcaattggtaatcagcaaatgttatttatatctaaatttttatgtggtgactgtctgtgagtatcctctttacaattatgcaggagtctcataatttcatttaggtatgactaaagacaaatcaatataaaacaaaaaaggagaaacttaaaacaacgtaggtaagatctgtaaataaaatacagcttccagtttcattgtgtttccttacaaaaactatatttgaatcagttgtggactagttaaaagcaacctatttttcaaagcagacataaaaatcaaaattagggcaaataagtaaatgtgtaatattaatttaagtactgtatatattatgccattatagtggtattatatcaacttaatataattaaggaattataattttttctgcaatccttatcctaattctatagcctatgtttatgtttttttgacatgtgtcttttatcacatatttggaattatgctatcatacaggtttatatcactatttttaaactaaaaattatataataaatacttccctttgtattatggagctttcctaatcattatttaatgtatatataatagtttatcaagtgaatgacagtaatatatgcaaccgcttctcagagttggcatttagattagttttcccatattatgattactcaagtgagctaggggaaggggtcatagaatcctgagactagctgacaaagtgttgagtgacaaagagatagatggaactaagtatgttcaggattctaaaaagagcaatggttcacaaggaaacttctgcctcaggtggggagaggagtccatagatcagggaaacttatgtcttggtgaaatggaagaccatgtttctaaacacctgtcgccaggttggttcaccttgctgtggtactgttcttaatcctgcctcagtgatactgtattttttagaaacttaagggattctaacatctttctgaatctcatcattgatatcaggagatcctgtggggttttttttatttgattttttaaaatgggcattttaatataaaagtcagaaaggtattctttggccatgtaatcttcctagaagtatccaggaatttttctttaactcctcttctgtagtgccagttaatgatctaatgctttcaaattgagaaaagaaccaaaacaccagagaatctttggaaactaatgcaaaatggaggatccaaaatctcttaaatataattctgtttttttcctaagttgaaaggtgagaaaagtattattaagtggcttcccagctatgctctaaggaattctaaactttctaggaagaaccagggacaatttcaggagtcaggggatgctgataagtggaattccaggctctctatgatgcttccaaccccataaaccagagtagctggtttgcatagcaggattctgagtaagatttcattcctagaaaggattctgtggctttaaaagctttagaaggagaaaaacaaaaacaaaacgggatatacacacaatgattgttatcatcctcttttactgtagagccatatacgtaatttccctaagccatgactctgggagagaagaaaagactgcacacatggtaacatgtaaaactctcagataaatttttccctaaaggacatgaaaatcatatttaaaagtttgggctgactctccttttcaggaggggagcactgttcagcactgttcaggcttcctatgtaagggaagaaaaaaataattttctttctatattttctgagttcttagctgtgaccccagtaactaagtgcagattaacaagagaaaaacaaaaagaagtttattaaagtatgtacatcattatacttgtgagatacccagaaaaatgagtaaatctcaaggaggtggatttgaattcaggctttaataccattgtccactgataaaaagaaagaagagtgtaggaagggccagttatgtggagatgcctagaaaaagcatataaacaatgataaggtttgttacacagattaagtccatgccttctcttttggtaagtctctagttatttagttgttcttctcttcctggtgcagagagggagacaccactaaaaatagaaatttcctttatagatataaatttcccttacaaaaagggtgacttaactttcagagcttctcctgtgtctgctggttctcaaaataatcagctcaaagtaatccttatgctaaagaggcatattttggggtggcatattccggtcttctgtaaacactagataatatctataagcacggatcgatttctctttcctcaagtatgatagaaatttagctacaaggagaaaatcattagaaaaaaagataagaaaattttatatttaatatgaacagaagtacaactcacaaccaagtaaacatgtaaggaaatatatttatatttgcatactaaagttttgtatttcaacatttttgtatttgcaagtttttaatagaaacataagatttactcattatataatatttaaagatttcaaaatatataaatcatacatggtcactttccaaaggcataatttgtatagatatgtaaatatatgtacattatctcactaaaggaagaagctgaggaaaaattaatatacatagaaagtttatttggaccaagcttgcggattgcagctctggagcatcgattcagttgccccgaatatacactccaattagtggcagtctacaagtggatttttaaaagaagagggggttcttgagttgtttacaaaaaaaattacattaaaataacatcagctattgattggctatatgttgtttttgtttgtttgttttgtgtgacaaactccagaacatgaagataatggatgaagcagctagtcaagaacaaaattactttgaacaattgcctccaccatgggtggggaagaggggctgggctgactgaagtctcatactcatgtctctctgggcctgataaattttggatacctcatgttgctcagattgctctgagctagttttcttttctcaacctaagtagtctttctgtgtatacaatttaaaataattatattctgttctacatcttacttttttcatttattacacttttaacaacattttagctgtataagtgcatgtaaatctgcctattcattttatagttatatgatattaacactttttatgaatgtacaatttatacattttctaatgactttcagtttgccacagtgataaatgatgttgccctggacatcatgtgtctttgcatacctgtgcaattgtgcctacaagaaaaacatctttgtagtgcagttgcttggttaatggcttttataaatgagtcaccactactactatactagtttcctggggcagtcgtagcaaactactacaaacttggtggcttaaaacaatagaactatattcttacatttctagacatcaaggtgaagaaccacattccttaaaaaggttctatgggagactctgttccatgcctcttctagcttctggtggcagttggcattccttggcttgtggtcacatcactttctgctgggcctccatcctcacatcacatctctctctgcgtcttcctttctgtgtgtgtgtctctgaactccctctggctctttttgttataaggatacatgtgattgcatttagggcccacctgggtaatccagggtaagattctctctcaacagccttaatttatacactcttttgccatataaggtaatattacaagttctggggatccagacatggacatagctggcattcaccctattataactttttacacacaattctgccgtttgagtatatcttgtccgaaatgcttgaaaccaggtcagctgtggaatttgtcacttgtgatgtcaaataggcactcaaaaagttttggattttgaagcataatttttctgatttttggatttggggatgttcaacctgtattagaaatcaggggaattgttttgtatgggaggtgtacttccaattcttcatagataattatatactggtttatattatttttttctaacttgcccattataaagcatttttagttagtttgacccttattgccagttagcattctcaaagtcatttaaccaccgcaatagtgtagtctaaaaacaggttttgtgttactgacattttgtggtctatgagctattgatatctctcttgtctagatgtcaaagtaaattagtcaataggatttaagagatggttcactctgaagaataaaatagcctctcgggattagagtccaattttaatttaattacatgttgggaaagaaaagatttggttcaatttaatttctgttgtaaaattgggtgagttgtcacctaaacttaaacactgtacattaatttgatgttgctatatccttttgtataaaaaaagaaaatagccaaaaaaccagacaattattctttgagaacaaattaattcatttaggtgaaaacataatataatataacttataaacactttataagtaggatgtagagaaaaactcatgctttaactgtagggcttctagaggaatttatagtgaaaccaatagtctaagaactattgattattttgggacttagtttgctgagtacattatttctaaactgtattttgaaatataaacttctggatagcatggaatattggtaagacttcatagaatggaggcatgctggtttaggtttcaaaagttgaagaaagattattcacaaaataaataaaggaacattctaatattttatgtgactgaaagagtcttgaataaaatattatagtctagccatggatcatcactaatagtttcattactcctatgtgttacatatttttctccatagtttaatcaacccgtattgattctaaaagaaaaggcaaagttattgggcttcagtccatcccaccacataaattgttgaaaaacacctgaaggtcactcttgtaaacagtgatattatattggagcctatacactcaaaaacattatggacagcacaggtgtaaataagctggaaagatgatgaatttcaaaagactttgaaggatagttgtagtttttgaattccaaagataagaatataaattctgatgaacaagaccatcagaatggacatgcgcaagaactgaaatctggaaattcccagaggaataaaatcgaaggagtataattttatgcagaaaaagttagctttcatgttgtgttatagtggaatcagcaacaaaagccctaatgaaaaaaaatactagttgtggtagcaatttggtcacctactagacattatacttaaaaaagtcactttgcaattctgatcctttatgccctcatctatgaaacgtgattcaaaataccagttccttggagttcatgggattatgaaaataaattatttgtatttttagaaaaataaaaagctctaaaacattgtttatttttatgcaccctattacaagtaaagccaatcataaatcatatggcatgtgtgtgattactaaggatcaaaattagcagatgacaaagcccaacttctggctataataattaaagctacttttgtagggggaataagctttatgcctacttggacttcaggaagcagtcctctaaataatggtttttccaaattgaaggaaagccttctcactggcttaaggattgttggttttctacaggctttgtagtcagacacacaaactctaaaacactacctttttaaaaaaacttttaaaccactttaatggggtatgatttacatacaaaaagctgtctataatgtatacaacctggttagtttggagataagtgtacacccatgaaaccgtcactgcaatatatgccttaaatatatccacatccaaaagtttgctcctgccttctttattattgttacattttgaaaagaacacaacataagatctaccctcattccacatggtttaagtgtacaatacagtattgttaactacagataatatgctgtacagtagatctctaagatctattcatcttgcataattttatctttgtttctttgactaattcctctccattttcctcttctagtcacctggaaacaactatactattctctgcttctatgtttcctcatctttaatgtttccactaaaacactacctttcatttttaaaactaaagattagtaaatgcattgtataaatatatctgcataagtgtatatgaaatatatgatagttaatatatgtaaagaaaaggatgtaacatagattaatatagatataactgtcaagcagagtcttcctggattatttacccatttgttgaaaggaactctggatgtgagttagtctttctggaagaaaatgggtcaattatgttaaggtgctgtgaaatttcacagaaatgttggtgagcatatataatttggacttgtcaagatctcttttatctggtccctaagctggcctgtataaattatattaatttttttttctattttcttggagggctgccacatggagcctgtataaattatgagtgtaattaagcacatagactgaaagatcaaaacctaatttttagatatgccttaggctgtcttctgaggctttgccttgaagccagggaagttctccctgccagaggaaatagatagaaaatacatttcctcaaaatataaaggttttctacctttggatgagctggttacttgtggtgggatggagctgctgttctcgaattacccagctttaaaaagccaccgatgggtccgaagcctcctggtaggaccagagctgatgtatgagcctcttctcactgctctaatcccaggcccaggagacccatttagtgtgaactcttcattcctaccacaagttagacctttagttccatccttatgaatttctcatatccctgacttttaagcctctttactcatagtcttcctagtccccaccctccatttctcatggacttggcatgcagatcacacttgcttcatcctctcatagaaacgtcatttgacctggtggctgtgttgcctttgttcagcactttagaataggtggccctggatataaggcagacactggttatttaattcaaagtattgacattttcttagttttgatctaggcaaagaaagccttggtccaaacaaaacaaactcttaggtactaaattttatatattcagcaccatatttaaattgaaacaaagatattggatggattagagatttagcatatttttctgtcgccccgatttgattaggaagtgtgaattctaaatcagaagatctctaaaataatttttgtttccttcctaaaacccagtctgtcttattataagccatgtatattactgacagtatttctaatacttatattttaattttttattttcattgtcagtggatatttaatttatttaattgaattttagagaaaattatttaaatgagtataggtaattatttaagtgacagatagtgaatgccaataagaattttctttcttataataataggcttgtaatctactgtttttttcaacaaaacctaatttttttaatcttatactttttattttaattttttctcatgcgcatgtttggtcattttagtcatatcttagttctattattatattgacgaagatatattcaattttgctaattattaaaagatgttcaaaatttattgaggtgatttaaaggcagtggctctaattaggcttattgaattcaaatatgcatgtaacaatttgttttctatttctttagataatccaaaatctactctacatcttttcctttgtattgccttcaaatatcactcttcaaagtttagtgactaggcttaaagattccacatataatccaaagaaatctgttcaagtggacatctatcaacacgtaaaactatacttttaactctgtttttcttggctgtgcttacaagctgtgcttgttaaaagaaataagacacaacagatataaattgtatgaaaatgttacagaattgggcataggaaaaaaaggcatgaagccagagtgtgtatgacttgaatcttgacaattggtcaactcaagagtcactaatgaggaagaggtgacagtgttggaattggaatttttggaattgattggttctgggtctcttttctaatggatcagttaagagatcataagatgtcattttatatgaagaaaaacaaaataagtagtagataagaaaatgaagaagtatgtgagtggcgccttgcaccctggaacccatagttatcattcaaatcaaggaaatatgctgaaaacagaaagtaaaatttcatataaatgagaaataaattgatgaactatggaaaaacaagtaatacaaaacagaaaagattaaggagaaaaaacgcttaatcatatgttttttatttaaaggcaaggaaacttttgaaaggaatgatttgtgtagcatctgagaaaatagcttcacttttataacaaagcaggaacaatttaagtagttgacaattcagagaactaacatacagtacattagaaaaacatgaatttaatagggaatataaatcagaattcctaggtgatattccttcaggccagaatgtagagaaatgtgaaacagttgattatctatggaaggctgatgtgcaggtcacttattgtcattcagaaccattaacgaaagaacacttgtgcattaaaatatgtctggggatatgattgatacttagaggaggatatgtagttgtgtgtatgcatgtgcacacgcacgtgggtgcacatgtgtatgtgagtttgagatagaaaaatgggaagagttgaaggaaaaggctggtagtatatgctattactatccatttttacttctttccgtttttctgatgcttccatttttagtccttttctgaatttggatggtggcctcatcatttacttgtatatactgtagtcaagatatatttagcaaatattcctttcctttacttttcatttaggatgttatctaaagccaacctcgtctcaggcacttatactataattgctaccagcatttgccttgatattgctgcccctgtctagaaaagactgttaaaaaaaaaaaaagtctgcctcaaacaaacatatatgggcctaacattttattttggtttatttctgtttatctttgttacaaaacaaaacctgaaacttcatacttacagagataaaatgacagcagatggcataatgggtgaaatgttttctttttccaatttcaaatatttatagctatttattgatcaatttatcttttatttaccctattatatgctaataactatactgagaacttggggtacaataattgacttgttatcttagactctgatgggaaagatgggtagtaaataaatcagtagaaatgttatttgaaggcaacaatattgtagatgtttccaaattattcattgggagaatcaggaatttggagcaaaaatctatgttttcctacgattcaaattgaaatcagaactataagaaaagtacttattacaatagcttataatattgagataagaatctaaacagtcctgaatttttatgaaataatttatagaatattaactagggaaatattgttaaaactgattatgcaactatttatgattttaaagaaatccaaataaatgagatattcaaatcttagaactgtacttctatatagcacatttttattaaatttatatacataaatatatacacacattgaatatacatatatacaggtaaatatttactgcatttgttgtttcttcaattctaagaagcacatatttcacattttaacatctttgaaatgaagatgtcttacactggatggcatcttatgatcattgttgctaaggtggcaggaatggcagagtcatggcctatgcctattaattgtttctgatcatgattgtacagtttcagtcttttgatatttcagtcaataaaccgtttgtggaccattagaggaaggaatataagttccgttgttcactgaatatcttctgttgatattttctggtaagatgaagaacatcagtgtcaaaatttaaaatggcataagcagcttgaaagaaattcctagagacagtaatggagtactctgtagaaatgccaaaccatggatgctctttataggccagaggaggatattgtgtaagaaaacacagctattgcaaactgtgattcaaaaagtgattcagaagaatcataatccgattgtgaaaatatttagcaatacctaatgagttagaagttgttttcttttagtacatatttatacacgtaattttgatataacttaaaattgttgtcattttcaattggataaaatgtattatgtaaacatgtataactgaagctatagcagagtattcaccagtatgtttacatagtttactctagtgttaggattgtgggtgatttgcatgtttttctttacgtatttttttatttttaaaattttaaattactaattagtatttatatctttggcaaatgataaatagttattgattttaatctttaagtgaaaatttattttaaatgtgtagggtaattactgaagtataaatatgatgcctaaacttccaaattttagaaggacaagttggaagcttttttcctttggtgtaagcataactagtaaaataaaagaactgatatttaaagaacagaatggctctaactacatgaaaagatactcaaaattattagtaatcacagaatgcaaattaaaactacaatgaattttttcatgtctactgcattagaaaaaatttaaaaattatgcattggtcaggatatgtgacaaggagaactcttatgcactgctggtttcagtgtaaatttctacaataaatcttctataattcctgtccagtatctctgaagaattatttgcacaaatgccccaagagaggaaagtacaggaatgttcataggagtataatgacatctaactggagacagtccaaatctctatacatagttatgggttacatatagatatagatacatacacatgtatattcagaaatgacatatggtcaatccttattatgagtggttccatatttgtaaatttgcatatccacagaaatttgtgattcacagcacttttgcaatcatttgctgacatgcacagaacagcaaaaaaatttgttatgcaacacttacattcccagctgaagtcaaacaaggcaagaccctgccttctggttttagttttctctcatactgtaaaccagtattctttttatagtctaataccatgtttttcacattttgtgctttttgctggtgatcttgctgtttaaaatggtccctaagagtaatgctgaagtgctttctagcattcctcagtacaagaaaactgtgaagtgttttatagaaaaaatacttgtgttagataagcttcatccagacatgagttacagcgctattcgctgtaagttcaatgtcagtgaatcagcaatatgtattaagtaaggtgtctttaaacagaaacacacataaaacaaggttttgtattgattggttgatgaaaatgtgatcagagtctcacagaaacctatccttgtttttctactatgtgcagcggttcagcatttggtaattcagtgttcatggtgactttacagaacacagcttccatgaataatgagaatcaactgtactctgtgacatcagatttataagtctatgtgcatcatgtctgaatctaaaattataatattaaatttaaaaactgtttccaagattatatatgtcatatgcatattattacatgcatataatatagaaaatttaatatatatttgaaatattaataattgtattaaataattatttaattattaattattaagaatttaattttgactctttgatctatatatattttaggtaatgcaaattttatataaaatgtaatatatttagtttatgtattacatataaatttaggaacacatacacatatacatatacacacgtacatatatggtaaaagtataaataaaattaagttaaaagccatcatacaattcgggatagttgttgccttttggtagagaaagagtgatgtggtcagagaggaacacacagaggtgtttagattaaaaatggctattgctattttctgaagatcctaaaattatttcatatttttagagaaactctggaggatttcacattcagccccaactatgacttattgaacacttaactatgtacagatgactaatctgaggcaagcatacattatttcatttaattcttatattactcttgtgaggtaggtactccatgcaatttttttcgacgctcaagatgagatcgtcatgcaaagttcactttaagatttggcttttaaaagttatagcttctacattaaatgtaataaaagacatgtaatttggaaagccacatatatattttttctcttcaaaaatgtaattttaagatcttcactcatcttcattttatgtataattttaagaaaaattaggatgataggtaaatttgtctagtacgtattagtcatgccatttacatgtagtcttctgtcaatgctcttaattaccttgtaaactaaatatagttattaacctgtttttacagatgaaaccacagactcagttttattactttactaagtgttacagagtaaatgatggagccagtattcgtagcatttgaagctcttatgcttaattttcatgccacaagatgaaaccatgtaaaggaaaataggcttaaatttacaatttcataataaactagaattttagaaaatagaattgtgtatatgtgtgtgtgtgtgtacattctgtcttctattttattctttgtataggagcaaaccaagtagaatgcttttaaagggtctataagttcaaattattttaatataagagtgatacatttcttaaggggggcatatttaaatgctgggaaaattctaattcatagaatttatactagtgttgacacctatttattgtgtgagtctgcacacacctctttactttcctatgggcatagtttcctgtctgtaaaatggaaatcccatatttataacatgatttgaatattaacaaattataatatttgtattgatgttattattttaaaatatgggtttaagattacttagaaatgttatttatgatctttgaagtgagtgaaaaataaataatccagttgtatttctgaatgtttactatagcagatatgataaaaactacaatagtttaaactcaagaattagtaataaaagatggtttagttttctttatgcaagcaggaaaactgcagagtgaggactttaagccccataactgtttttacacgctgattatacaacaaagagtagtttaccacataaatgtccttcggtatttcctcagtattcttctagggtttctttttttaattttcaagcaataaaataggtactttaaaatatagtaataaaatttagtaatatatagattcagattctttagacaactttcaaagatcatttgctattttcaactggtttcactaatacctacaatatttatttccttttcttttttccttaaatattatacatcttcaaagatactatttccaatgcacatgtgctgtaaactcatcatgttaggttaactgatgaccaaggagaaataaacctatcttccaattaatagatgaatagatagatagaagacagaaaacgtttatgtttctaagaaagcaaaaatgattacaaaagcaagctgtacacatgctgaaaacatacaaaccatctcaaaataattgttgagaggtgtggtatttggggttgattttagcaattttagcatctgcacgacattaacttatagaagtggctttgccccaattactgtgattgactaggatctacattatgtgcattaattgtttgtggttaaagcctttcatttgaccttgtcactatagtttccatgacattttttggtaggcttctaacatacaaatgtgtacctataaaaaatctttcaagttattttattcattttttgaaaagcagatgcctatgaccattttgatcaataaaaagaatactacggatatgcagagaggatgtaataaaaatgccgaggatttttttgcttgcttttttttctccctaaattacatcactcggcagtcttatttctaattctatttatattatctgtagagtcagcagtgattagtgaaatccagtcactgctattactattttacttaggtcaggcttcttaatatctctgaaatttgtcacatttaaaaaatagaaaaaataccttaaaaggcttttattgaaactaaactgaataaatacttactgaaaataaaaagcatttatttagcataataagtacacagtatttattgagtgagatccccttatccatttttgtatacctataagattacattataggttactttgagtatcatgcattaattcaataagataagtaatttgaactcttgaaactattccatcaaattaatgccactgtatccaaagccatattttatatgtgtgtatttagtcaggaataactttaaattttactttattgtaatttcttggaaaaatcaaaagggtttgcctttttcataccatttaacaatttttaaaatttgttttacctacgttgtctaatagaatggtaggtgcatttatcatttatacctctacttcctataaaagagtaatttgagactgctttttaaaaaataaacataaaacatcacattgtaccccataaatatataatagatacaagcaaatatataaaaaagctaattttttgatgtatgagtatgtgaagaagacatgtaaaatatatttataaaaaatgtttaaaaaggagatattttctgtacaaatcattgtggcaattaaaagtcttatttagctattttactttaattaaaaaacattttagggatagggcctgtctctgtcacccaggatggagtgcagtggctccatcagagctcactgcagccttgaactactgggtgagtatagttagtaatactgtatagtatactggtaatttgccaacagaatagatttcaggtgttctgagcacaaaaaagaaaagtggtaactctatgaggcaagggttatgttaattaggttgaccgtagtaatcattttgctatgaatatgtataacaaaacatgttttacaccttaaatatataatttttattttttaaaaatagtgggggctggatgcggtggctcacacccgtaatcccaacacattgggaggctgaggtgggtggatcatctgaggtcaggagttcgagaccagcttggccaacatgacgaaaccccatctctactaaaaacacaaaaattagccgggcatggtggcgcctgcctgtaatcccagttactagggtctgaggcaggaggatcgcttgaacctgggaggcacaggttccagtgagccaatatcatgccactgcactccaacctgggccacagagtgagactctgtctcaaaaaaaaaaaaaaaaaaagaaaaagaaaaaaaaaagaaaaagaaaaaagtgagttagaattatctctacaatcatcaaaaagcgtagacaacagaaagcaataaaaaaagccaatagatcatgtcaaaaggctttgcatccatcatttcgttccttggcttagccttaaacaggaaggaaaaatgagaccaaaagtatcaattaatgaggttaaaacaactggtgattgaagtagaatatgtatcagatctatcttagagctatgactgatgtataatgtaaaatggtacttcagttcagatctaaattcttaacttcactttgagtaatttttgtttcaataatcaaattaaattatttaaatatttagcccacaataatcaaaggtatataacttgcatcaattgtttttgtacattttctggtaattttctgagtataagagtgtgaaaaatattcatgaaaaatcatattgtagttttaactggaaagtactattttagtgactatgaagagtggtaaacaaaaggggaaataaaatttaaactgttatttcattattttaatataggttacttgaatttccactagaggagcagaaatgccaccaatgccaagtgccccacctgtgcatccacctccagatggaggatggggttggattgtggttggagcagcttttatctccattggattttcctatgcattccccaaagctgtcaccgtattcttcaaagaaattcagcaaatattccacactacctacagtgaaatagcatggatttcatccattatgctggctgttatgtacgcaggaggtaagcttcttgcaataaatagaatcctgaattaagaaaataattcctccatgtcacaatgttttacatggagtgtcttggtatattaaaaccctgtttttatgttatagtcacttaaaaccaatcaaaagtataattagaactgaaatttcaatgattttagtgattcagcatcttaagctatttgcttcgaattgagtcttaatggaggatttgtttgaataagaatttgtaagcacaaagcaagatttactaaattatggaatttctaagtgaggctacttcatttagtttgaaataaagtccacaacatattgctgatgtcatttttcacaatcgctacctctggtagaaatgctttcttctgaatgagaagaaaatttaagttgctgacagtttataagcccagaaagtacatcactttaagctgcaaaaatgaagggttaacatgtacattctagacccattcaaatttgtgtgactgaaataattatttatctctataaggctcattaaataggacatctttttaacttaaattgttgcttggaaattatcttattacattctatgttcaaatgagggtattagtcatgaaggataatgaagaaatcaaagtaccatcccacttctaaatgttgcaaatttggaattattggtgccttattatgtcatctattttctgtaaatcaatctcaatagcagaccagactctcttgtagaattttttgaaagtcattacttaaaatatgtcttttagcgtttttatttttcaagtggatatttgactttaagggatagatatagactcagactatagtcatttaaagaaattatatcaattatcttctgtgatttcttatttttcaagtaaggataatatggctcttagtcatgaaaatataacattagtataatatccagtatttagtaatatttactttcacccaaggcctaagtacttaatatgtgtgatatgacttaatcctcttaatgatccgtgaaataagtattatcttctctttattccatagctaaggaaatatatacaatagctctcccaagtcaaacaacttgttagtagtaaacagagactgtaactcctagcatttaacacctgtggtctctgactttctcataactttctctttacatctagagagtgacaaagccagatctggcccaggccttctataaacctgattcaattctttctacttcagctcagtggcttgtgtaccacctccaccaatgtcatttgttcagtgacataataattattctttaggacattatctttttgttgtactacgaaggtaaacagttgatcctgaaataattccctgtgtgtgtgtgtgtgtgtgtgtgtttatgtgtgttggtgttggaatgtgttttatactttttatatatagtgactttatattaatacagcatatgtttcccttattcatttggttaggttaaacatgcatttttcttccagtatcaaaaggtatcctttaaatactatttgggcgtgtcaatggaaaattctacttctaacacacattctatgaatctcctttggacagttgctttatagattgtaagaatgttatttcttgtgaccatagaaacagtaggtattgtagagtagatattcctgtatcctgtgggacaggtgttgtttaataatgttttgctagagcagcacacagtcatcttgatttcagctccaaaacgtgctaatattaagatatgtagagggttttcttgcctcttaaatacaattgaaacagtctcttctagtgaattaatataagtccattgaatttgaacttcaggtcttacatagtcataattccttattgagcagatagttgactaactcatcagtaggacaaaattttatatactgttttaattaagccaaatcttaatttacattctctgttagttttcagacctcagagtcttgatgacttaaaacaatacaggttatttctttctgaagcaatgtttcaaaaagtggctattccatcacccaaggctttgtatgttgttccctaaatctgctccatctgttggacaaatagtaaaggcagacagcatggaagatcatatggactattttagggggtatgcctgggaggaataaacattatttctgtacatattctattgatcagaactcttatactgccctacccagagttaggggccatggatgctgggaaatacagccttcccaaaggaagaaacagaactacataacatctagccagtcctagtcagagcctggtatctcaatattctccattgaacaaaagaagcatgtgtttatagacttgcctatgacagccctccaccctctggctggatctaaaaggaacattagaatgaacaatggcataattaactttctcaaaccactaaatctcaatatgaaattataaaaagtaaatatactatatttactacaaataaatgtttttattttattcatacttatttttctattttaatatatatggtataattttttaaaagcacaaaagaactcttctgaaattcatgaagaaaatggtagtttgttaaaatagttataaatttggaaaaagctgccttaaaatttttagggtgatagatgaataaaatatgtctaagttaaatattaacagggattttatatatgcttgttttgtgaaagcagtgctagatacatacaaattcttggtatttagtaattgatgaaggcaatatctaggtgagatccaagtaagtacctggaatattgcctaaagtcctccattatcggggctaaaacatgcaaatgtttcatctctggccatagagaaaagtcaggaattgcagaaattctgctcacctttggtccttcttttaaaactggaaacacaattctaggcccattgtctagtggatgaaaatgcttttacctgccatgtccactgttgaatatagatcttacacgtttacatagtttgttggaaataacatctatgtcttatcctgataattagtttctaatcttttaaccaaaaataattggcacatttaaaattataatctaatgtggaaataattttcttaatgtggatgcagataattttttttcagaaacatagtaactatttagaacaaaaagtctgatatagtcagttaatctaagacacaggtattagtcctgttactcacattgcagtctttcttcaactgtggtctacagaatgcttagcttctgagtcatgagtcttgttaaaaatgaagtcctaggccttatcccaaatccccttttatcaggatttctgttgttagagttcagaaacttgcattttaacaagcatctctgaaaacaacttcactttatatacaacacaggggttcactgttgtagaagaaaatcactatttgattttaaaatacttaaattttcttacactatgtgaaatatatttataggagccttttaggttgatgattataaaaaaaatttggagagcaaaggtgaaaagacatagtttactgtgaagtataatgagtctctctagcaagtagctgaaatattctgttcaacacaatgctaattgcattagcctagagaacacctaagatctgacacattcattagggcttagcagtcaacctattaatcactactgtggggtcactgagtaagatggagcatgttcagaggcctggcctgtgatgtcaggactggagtctcttgtagtaattagttggtatctgggctttggtagcaaggtattatcttcccttctgatgtctgaattaaaaatgaaactaatgaaaggttcgcaggaaggatggaaaagaatgcaaattatgtttataccttacttcatccttagaataatggcatcacattacagcaatccatctggatgtccatatgttctcctggagatctagcaaattttagcaaataggtcaaacagtgtggtcaccccattaataaagcactaagtagaggtagaaaacataatttaaactttctacactgtttagaaggacatagggttttattttgtaaatagtgattacataggattatcttttagtgcaatatttgtttttgtattctattgaatgataatctatacatggttacctctacagttactggcgacagatttggactgccagtttctgtgagtactttatatgacttttctggtaaaaatctattctgacttggaagaatcagccattctggagagaagaattggctttgtctccatggtaacttatttttctgttttatgtgaatagtgacggccaattgtgctaaagtaagggtgatagttttgtgatgaactactttacatggggattgaacattagaacactgagcttattttactggaggccgagaagcaaaaggctttaacatagcaggttggtggtcataatatacaatatgtatttttctattctcttaaaattttaaataagctcaatatattattctacattgtgccctaatattttgcagaatgagggaggctattaaaataattcatgctgtgcaatatcttagcagcaataaaaaaagaaagtcattccattcctgtgtttgagataggtagagctttcatcttagatttataaaaagcaaaaagtaccaggtacactttgacagccctgtgcaagtaggctgtggactttttatatctatgccatgttagactctttttttcatctgtaggcataaatattactaaagctttctatgaaatatggtacagtgtggcagaaactattatgctcaccgtgcatccatgcactcctctatatttcccagctttcctccccttaggctgaggccaagtgactagttctgaccaattaaatataagcggaaggacatctgtccctctggacacctcctggacaaggtggtttgatctggcatgcatcttccctttctctacagttatatagactatactgatcattacaaacatgagggcttggtttattgtgtaacaacaatataagttatataaattattacatgggatgagaacacactatgagatagccttagtcaatttagcttatattatatcatgaaatgtacaagtgctactctatcagatctctgttagagaagaggtatcctttggtagcctagagaacacctaagatctgacacattcattagggcttagcagtcaacctattaatcactactgtggggtcactgagtaagacagagcgtgttcagagcatgttcatttttctcaaatgaaaaagaagttgtgagtggatattatcattgccagtcttcatggaataaaagtgagaggcaaggacttcaaaacacaaagtaggaatggaatcatggccctggagctttctatgatgaaatctgtgtgtctcttccaaaacagggatgaaaggggacagaggtcaacaacagattggaagtgtgcttagagcctttgaaattattccaggacacactttccctacagagggctgataatctagtacaaataatatcagatagttactaaatgttattttcaacagaaattctaagaacctttattgaaatcttttctgactgatatatgtgcctcagacagtgaacctttcacttactgatgtataaaaagaacctatttattaatttatgacctgacaagaataagactatctttcctgatttttggcttaaaaattttcaaaaatatgttattatatcattactcactttatgcagatgtgtttttgttgtaaatgacagaaacctgatacagataccctaaagcctaaagagaaatgttcatgtatacaaatcagaggagaagcagagacaccaatgtcttccagctcaactagcaccagtaattctgtttgtccagcatgttacactctctcttctctcttctgtttcttccagagggcagctttgtttatttatgttgatattcttcccctggcacaaggaagatgtctaccaacacttcagcctcatatttcagctcaaatttgacactaggaagactgccactattccctaagttatactttgacaaattctaaggaagattgctaggacatggcctactttgcatttgccctgcaggcagtgggtgaatgagggactaacattggcagcctgagtggaactatgtatctgagataggaaacgagcagttccgtaatggaagggcactactgttcccagaagaaggaaggattctgaagagacaaagtattaacaataagcacttactactttagtctttttaaagagattaatatgttatgtttcaagaataaaaatgtgttgggttttactagtcactcatggggaattttgcatgtagatactttatagctagctagcaagctgcatagataggttacatgtcaaaatgcatatatcatatttggaaactattgcctaatgaaatataatgcttagtagccatgaaatataatgcttagtagccacccagaggactcaattgcattttgttaaaatttgaaacagggtcactctgttgcccaagctgagtgtagtggtgtgatcatggctcactacagccttgacttcctgggctcaagcaattctcctgcctcagcctcctgaatattctgggactacagaggtgcaccaccatgcccagctaatttctggttttttgtacagacgaggttttactagtctcaaacatctggactcaagccatactcccaccttggcttccaaaagggctggacttacagatgtgagccaccacacccacccagccctaattgcatcttatgtgagttggtgcctagagtggaacatagatatggaaggtactgggatctcaaaatggattattaattatgtaattgtgcaatgagaagcagaagagcattatagttggagagtgagctccaaaatattaatagcagatatgaaattgagactttgctacttggtcattcagcctatttgccattttaccttggacacagtttccttatctgtaaaaatcacacaagaatatatacatttatgagtgcatatgtgagtgtgtgtgtatgtataatgtacactctcctgctcagagtcattattagtaataaacaccaaatacgatacttaggaaattgtagtttttgattcactgcagttgttgctgctgttgttcttgatattctccattatgcagtgaaactgcagataaggaacaaagaagatagtaagtctgactcaagcaatctgtgccaataacatttaaaaacgactggaaatgcaagaaataaatagggtcaataatcatttctaaaagaaatctatgccctttacccatattttccgtggcatttctcttgtgcctcctatgatttgaatagtggacaagacattggtcattctttttgggccatcctatattgaaaaatccttctatgtttagggaattcccaacatcaccattttctgactccccaagggaaaagacagaaatatactttctcagagtttattacacttaagggcacaggcatgtgacccagtctccgtcaacccggtgtagaaaggcccgttttcattcagaaactactgatgtgtagaagcagattcctcaagaaaaacattcagatgaggtggttataggtaattaataatccattcacgcaaaactagtgtcagtgtttagggtcaatgggacttgcagtgtaaactatgtggtcattggtggcagctgtgatgtccccactggagcaatcagttttgtcatgtgatttggtcagcatcatagcttggtttttttaatcccccctcatattctctgacattctttcatgtccttattgaatgccttcttctttaactaggatatatgatagatacatgtggttaagttccccaaaggtcctagtgaggtctagcatgaaatgctctcgtgaactaactggttattctgaaaactttctatggatgttttcttttcttttcttttctttttttttcttttcttttcttttttgagatgtagtctcgctctgttgcccaggttggagtgcactggcacagtatcggctcacttcaacctctgcctccagagttcaagtaattctccctcctcagcctcttgagtagctgggattacaggcacccacgaccacacccagctaatttttgtatttttgatagagacagggtttcaccatgttggccagtctggtctcaagctcccaacctcaggtgttccacccatctaggcctcccaaagtgctgagattacaggcatgagccaccgcacccagctgaatgtttcctttaaaagaaggacctttcctactctttcccagctcttcctcaacaacatattaggattgaagaatttaccgcagttctttttaattaactattttaaagggctctgtaaaaattgaaattaatttttatattttcatatgctgtgggtgacttaagtttgatggattatgtcacaaaatgcaaagtaaatacacattgaatattttttcattataatagtagtgactttggcagagtaaatgcattgttccaaagggatttttaaatggttaatctagatggctctccttgagttagaatttgctcagctggctggaagtatatgcttcaggagtgtggttcatagatttgaccctaaggggacgccctggcaatggcagacactagccttgcacaatcattgcctgaggattcatttgtagtcaccagaggtagggatgtccaggtaatccagcatcacaattaagaagaaaactatacataatttcactcattcatttattccatagatacacactgagcatcttaaatgtgcaaaacactggtgtggcattggaaaaaccacagcgagccaacagacacaggctatgctttcagaatattaaatagccatttacacttttccttatttcattacagttatgataaatgttagtaaagaggcacagtgggtgccatgcaacagcagaaaatggaaatcgatctcataattgagtgatcaggcaatatttcttggagctgaatttgaaggataaggaggcagcgttagtcaagggagaggaagtgtttgaggcagaggaaacagtatttgtgaaagccgtggaagagtcatggagagttctagtagcccagaggaggtgaatgtgattgatctatggtgaaaagatggagaaagttgtgtttgacagtctaaaacctactggaaatgatcctgggccacatattgtatccatataaacaaaagagaagaggatcagaggataggcatctatgctaccatgttagtctgctctagctgccataaaataatatcacagactgagtggattaaacaatggaaatttatttctcacagctgtggaggcaggaagttcaaaatcaaggtgccagtagggctggtttctggtggggcctctctcttcggcttgttagatggctgcctcctagttgtgtcctcacatggtcttttctttgcatgtgcacccacccctggtgtctttctctctctctctctctttttttttttccttttgagatggagtcttgctctgccgcccaggctggagtgcagtggcacgatctaggctcactgcaacctccgcctcccaggtccaagtgattctcctgtctcagcctctcgagtagctgggattacaggtgcccaccaccatgcccagcaaatttttgtatttttagtagatatggggtttcgccacattggcaagactggtcttgaactcctgacctcaggtgatccacccgcctcggcctcccaaagtgctgggattacaggcatgagccaacatgcccggcctctctctcttcttataaggaaactagtcatagtggattatggcccaacttaatatttcttatgaccttatttaaccttaattacctcctcaatggtcttaactccacagacagatacattaagtgttagggcttcaacatgaattttggagggatataatttagttcgtaacaggtactaggatcataactctgagtactctcctcccttttaatcaattttaagagcaaatgcataatccagaatgtgttaaaatacaggtggttgtcattatttgtggtagttatgctctataaagttgccacaaacactgaatgaaaaaataccaaattgctgcttctaggggagatttagggttacaggcccctgaacctctgatcataaaattttaattcaccaagcaatccatgactttgttttctatgtgtttccatttaaagacattgtattcaatatatttcactgactgacattgaattttggccaaaggtgctataatttattcctgaattaagcttattaaacacatacctttcctccataagtcatatcacagccgtcttgtgcctaggaacaccaaacagcacttcagcattatgctttgaggccattttaaacagaagaattaccaactaaaagcacaaaaatgcagaaaatgtggtattatatagaccctgaaaaggacagttgtttacactctgggagctggaccaagaaagcagttcatcatcttgtttgacctccgctgggaaggtgagggcacacaatgcatgtcaggtgatccaaatttttcaccactctgcacatagccaccagtgactgcaaaagaactgagagtattgattttaaggttacaaatcaattttagtaagtagataaatatgtaaatatagaatctgcaaataatgaaggttgaatatacctattccctttctctggtgaaattaccgcatttcttatactttataaaggtgtttgtaattacccaatgtttttattacagtttgtttatctgttgtttataagaattggataagcctgcacaaccacaaagctaatttacattagcgtttttgtaggtaggcattggttatcatcctggagtttactgaagttctttttaaaggaacacaactttcttaagctataaaagcaataataattacacttagaatagtactaatcactagaagggtgttaagtgtaaagctttggaaagcttctgtggaagctttgatggatttttgaaaactgatgaacaactgaagatccacagccttgaattattctgattagaatgtgctgtgcatgactgtagcattctgttgggtggtggtttcctgctttggccttgcatctcatgcagtcaatgattggattagcggcagcctgtggaagcaacctgtatatattctcagcaccccaggaaatgagtgtgcattcttggaaggctgaaatggaataaaaccgttaaatagaactccgatctacgtcagattcatctcttcttcttatatgatgagtaaagagcatctgtaaataggactatgagagaaatctgggtagtgaacaaaggggagcaaaaggagaaatatgatgtgtgtgcaggcgatttggaatttcttttaaattttccaatcttctcccagataatcctgagttcatgtatatgacttacactgatacagaaatacaagaatcagctgggtgcagtggctcatgcctgtaatcccagaactttgagaggccaaggcagggggatcacttgagtacagaagttcaagaccagcctggacaacatggtgaaaccctgcctctacccaaaatacaaacaattactggggtatggtggtgtgtgctgtgtcccagctactcaggaggctgaagtgggaggataacttgagcccaggaggggaagttgctgtgagctgagatggcaccacttcactccagcctggacaacagagcaagactctgtctcacaataaataaaaataaataaataaaagaattatctataaatcaaaagcatttaaagtatctttttggttctattaggaaaaaatcgtatagtaagttcaaaacatttaggcttttatctcagctggtgtaagcggctgtgatattggtgcaaagatgaaatgataggtgttttggcaacggcagctgtaaaatctacgtagcaaacaacagatggttgcttatttgacttttgggcaagaactgggatatagaaattgctgttgaaataggtctttctcaatgtttcagatttctatcatcttccaaagagtgagcatggatctagagactgagaaaatttttaaagcttccctttgtattcttagtctcttgttatgtgggacaaattttccccacttccatcagaaatatgcaaagggttgaattttaataaccttagttacagtgttcttgaatacacagaggttgtcattaactttccaaatgcctcttgggcgccaggagtatttcatgattagtttaaaatgtatgtaaaatatctacacagagttagtttggcacttgcagataaagaaaaacaagtttaatcagatgaccctgataaaatgaactgtaagtccttctcatgaacactgcttctcacgagaaatattaagtacctctgttgtggcaaaaatattacttaatggtattccttaaatcgaacatgatatgttttagaagctagatacaacttttcaaaggcaacataacctctgccccttagagttggctcccaaattagatcaaacacaactgaactagaaacctgaggcaattcatgcatgcttctgaaactgtttccctaacaaaatagtctcacctctgtgccctataaacactccaaaatacaaatgtgggagaaaaaaaggaaaggtttttattcacttcatattttaagtttatatttgtaatctcttgtttatttgagtgattttattctctttggcttattaaatgaaacagcagtgaatgttgaacaattatatttagattttttttctacctatttgtgaagaaacaaaattggacacagaaatgccttttgaaagatatattttctgcagacattcatgctcccttaggaggggcagtaatagtgtcagaaaaatacatctcacaaagtatctaaatttctgtttggttccagacagttctctttttattgctttagctaagtcataaatatttattaaccatagaataaatttaataaggtcaaaattaaattagctatatatacaagtactagttatagcttcaatggtacttatgtaatattccaaatataactctttatttgttgtggtgatttttttctaagaggtcttcctttttccactggcaatcttgtttatttattcctttggagtgcttaatcattgattttaagtaaagagcctgcatacaatcttgtttcaaagcataccaaaagctttcagagatgaataactcatcgtttttactaaatatctaaacaattttttgccttttttgtttctaagaggcattgacatagtggaatagtggtagggcatggaggatttggctgtgttcagattccagtgctgcttcctactaattggaattttgggaagatactcgatacctctctgcttcaattccttatgtataaaatgcccatggtttatttgtatgaactaatatttctgaactctactgattagctcatatctcataattaaatacaataagaaagaataacgtggctatctgggtgaagatgtcttaccttctcaacatgtttatgttaaggttatgttataacattgagcttatttaagctgttttgaaaattcaaaattatccaaagatgtggacagcttctgcagcatgggaactagggaaaatggataagaaggaaataagtatcacatgataatgcctgctttgccttatatttcaacctaaaagaattgtagacataaggagaaaaagtgattcatctttctgttactctggccatctttagcctatggtacttctagacactatctagattagatgttttaacatttagtccaggctttatgttctatcatctaggacccgattcccccacttcttttgtctttttcaatgcactagagtaagaaaacttgtcacatgtgagaatgtataaattgtaaaatccattttaattacagaggtcattgtgctttccctttgctgtgaatagctgtgtattgtgttcaaacagactataacacaataggtgcacaaaatgagcaccattcttcataacatggcatccagagaaaattaaaaacagagaagctaaaatcttcaaaagcacgtatttgtgaattcatgtttgtttttgaaacagacaatacctgttctagtaagaaagacaaatcagattttatctttacaaggtaaaaatatcaagtctaagaagagatataataaaacaatatgaaatcctgaagagtatgcattatatgaagagatgtgttaattaaattccacaatattggaattgcagtgggaaataagacagaaaaatggggcccaagagaagcttgaaaaagatctattttataacataagggaaaaatatacaaaatgtgtgatcccaaaaaaatgagttaaaccaaattttataacagtttgtaataaataaactttagataaattcattagtgatagctgtaggtttaaagggaaacaaaagtattaaatatatattttatatcaatctgcacttattgaggattgctgtattttgaatttactaagaataaacatgttaatcttctttttttcttggcagcatcataagccttttatttttgtgatctgatttcaaatattcattgagagattttttaccccatccccacctccaccctccaaaaacagagaactggttgcaaattggagcaaatgctgccctagatttgcactttccaggattcttcacagcatgaataaaagctccatggcctcccacggagtggcccaaaatagacaattttccgtggtccactggaaagttggcatttatcagtggtggaaccttagctattataaacatgctaatcttctaagtaaatattggaaacaggatgcatacctgggtctacctgactttgaatctcatgtttttgtaaacttttctggaataggaatgcctcatgactatacctttcttttctaattcttcaggttggtatcatatgcaatagctgtatattccatcagttgattgacgtgttattatgggatcgctgtctaaagaacacaattggaaagataataaatttgttccagtttggaatcttcctaagttattgttaattgttacttatgtatttatagttgactaaaatttattaggtctttttctttttttaagcaccctttcataaatttggtctatgttttcttgaaataggtttttagtcttgtgagaccataattagtacccataacaacagaaatgtatatctttttgtcattgaaaaggaccagtcatagtagggtaaacttcttgtatcactaaaatgaaatagtgaacaaaagcatatatttgatgtcagaccaaggaatgtcctgtttccggtatctccttaagtgtgttatccatcccttctaaattttagtgatttttctacaatataggggaaaattatatatccaatccagacactttgtcataattgagaaaagggaatgaattaagcaatagctatcatcaccattatcatcatccaatctcctccccactccttgtcttccagaagctccccaactcccatgttcacacccttaaacttgtcattatcaatagctttcaaataatctcaatttttaaataacttactcctcaatcaccatgtcgtatcttccaccgcattgttttctagtactgcaactataataatcctttaactccatcagtactgttaagctattgatatactacctcatccatcactgctttccataccattttcaccttccttaccatctaaacttcagattcaattaatttaagtttcttgcatacattcttaacttatctacctaccattaatttttttgtatctcttgatgaaaccagaactctggctaaagccatcagcttagttcctttgagtctccatggcagaatgtaaaccacactctaggatttactaatctctttaattgatgatcgataatcttaggtgggcccgaaatgctgcttggtaaccatattttatattatattactctagtccagtctctctctctcgctatatgagatgattatttgtcatttaatccatattccccaaagccactgtcttccctcctttcttcatcccagaaggtaacttcaattcctacttcattcagaaagtttacgttatcagtagaacttccacatacttctactaccacattctcctgcctgtttacatccagatctgacatactttaccttctttcctgtatcagtatctatcctaactaaggccaactatacacttcctttctcaccccctcaactattaatgggtattactgtggacaaaattgtatcttctctctccattagcaatattccctctcacaactgggtcattcctgtagcttataaccatgatattctaacctccaacttgggaaaaaaacaaaacaaatggaaaatgttatttagaccaatgttacctgtcagccacaaccatacttatgtccttccctttaagcaaaacttcttgaaagtgttgctccagtttctctcttccccttctttttgcccccactccaatcagaatttttcttgtacccctcatctgaaattgctctttccaagtttctcaggacttcaatgctaccaatgtagtggtcatttcttagtccccattgtaattgacctttctggagcatttgatacagtacttaatcaccctcggtcttccatacaacacattcttgattttacttataaaatattacacttaaatattttcttttgatgccattagccacatcttttcagtatctatttttggttcttcctttccccttaaattctcaatgttcaaaagtttggctcttggatctcctttccatatatacttgctccataaatgaccttgcaccttctcatgactgtagctcatatttataggctgatgcctcctaaatttatatcttcagtttcaacttctcctgaactctagacctatatataaaccctcttttcagtatttccactcaaatgcttaacaggcatctctgacttcgcatacctaaaattcatcttctgaaattctcctccaaacctgttgatcaggtcaaaaacattggagccatgctttgacttttcctctctcttctttcagctgcataactttctattagcaaatttattggttctgccttctaaataaatccaacacttaatcacttctcatcacctctgctgctgttacctggcccaaggtattattatttatagtctagattatctttgtagtctatgatttggtgttcctgtttctgaatatacctaccaatgaaatcctgtcataacctaagttcaatcatgtccgagcctacctaagacttcccaactcactctaattatctactctccctgctatctccctgaacctgtcttctgttatcctcccttttgctcactctgctttagctatactatctacctactcttcctagaatataccagccatgctctcacctcagggaattgcacccattctttcctttacctggaatgattttcccttggatttaaaaatgccctcatttctttcaggcctttactcaaaaatcacctctcatagaggtcttctaggtgtactctgtctaaaatttcaacaacacgtcacacggttctatccatcttcattggttatgtttttttctccataacacttatcagtattatttgcttttcatttgaatagtagtgtcctatagaactttctgtggtgatagaaatgttctataaatctgattgtctaatatatgttatccactagtcacatgtagctattaaacacttgaagctagtctgagaaaggaactgaatttttattgtattttactttaatttaaattttaaaaacctcccttggcaaatggttaccatactggacaatgtgtgtttagaatgtaaactttcagtcccccactggaatataaatatcatgagagcagagattttttttccttctgctttgttcattgctttattcctagacataccctggcatatagtagacaatatttttgaaggaatgaacaaactgatcattataaaaattattataataatgatcaaataagacattgaaagacaatcctagtccttgccctgccactcaataatgtggtgatttttcagaagttacttactttcttggaacccaagttccttcattcatatttttctctttcatttaataaacatgtattgagatcctcctgtgtgccaggaattatggtagatattgatgtacaaaggtgacaaagatgtagtgctaacaaagatttaattaggaataaagagaagtaaaatttattaaagcttcatgatacttttaaagacggagatgtgaattgctatgggagaagacagaagaaataaaagacagccttaatggtcaagggaataattgatgaaagggaaaatgcaagactttcttgaagataaaaaaggtttgaaatgtttagaaagaaacagcattttagtataaaggcaacatacagtatattcaaaattcactccttcctataacatgaaatgtggaaatgtgggatatttaggcataaggcattgcacaatgactctgtgtgctattattaggtcacagtgtaaatatgcacaaatactcttataagatctgaaaatccttcagctattttctattacaaaattctaaaacaatacgtatttgttttctactgttgttcccgtttatattgctttttttgtttccattgcctttttttcttccatgtgagaagtatattcccacttatagttagtgaatattttaccaattttcatcttttcattcttaaacaggcatgcaagttataaaaactcaaaatgaaaaatgtaattgtggcttaaaaaatatgtataatgtcgttggcctaccgattgatatatgtatagtatatgattttaatattttagatacctcaccagctccataatcagtcagatacactttccaagaaactttaaagcagagaagcctgaaggctgtgcaagtgcagagcagcttctgttagatcttcagcagaatacaggttttgtgtgtgtgtctcattctactgctgaggattaagtgacagtggaataaaaattactggtaatgtgataaagcagggcaacttttcacctttcacaccagccaaaggacatattgggtatctcccctgaaagctaagcttgttgtcatagtttaatacaacttttcaggtgtatactaaagaaagaagaaaataaattagtctgtaggtttttatgtcaatatagataataaaaaagaatgataattgaacttgctaatctgctgtattacttcaaagtaaaaacatgttgcaacatatatttctaagtaaatacatgttgcaaagtgcaaagtgcaacatgtatttacttggaagtaataccacagattagcaaattcaattataattctaagtaactattactacaggacttgctggaaccagttgggtgcttatgtatgagatatttgccaagctgcataaaagaaaagggctagagtttaaaacataaatgtgactttgtatttaattttacagagcatgattaactagtttatgatgtcactcggaatattatcattaaaattagatttaaagaaatggagggtttttatgtattttaagaataactttttaaaaattaggatgtatatggaatttctgcatttaagaggatgacattaaaagcaagtctctataaattctttatccttgaaatgaaggtaataatagaaaatttttggtttgtgaaaataccaataaattagatgaattatgcaaagtgtagtgtatttcctgccacgtaatgcatgctcaaaaatgatacctattgatattctttaccaaggaataatagtataattccaaaaatattgttgcatgaatgctttccctcaagaacacatccaaatttaatcacagagatactggaaatcattcattgctatgttcataactaaaagtatagaatactatttttgatgcgttcttaatgccattctacaggtatggtttgtcgttaaacagctagattccactttcaactccatagaacttaatattatctaaagaaatatttaccactttgaatcactattgtatgaattcatagatctttacaaagtgagggaaacttttctctactgctttactttacagattaagaaagttaggagttttctgaatgccattcagggagtgtcagtgcgaggtaggatgagggtgtctgcttccaacttccaggattttgtggcaccttctatcattcttttagaattatttatccttgttaggtcagtctccatttccctattaaaaatggttcatcagtttctttcattagaaataacttttctctgccaaattatttcatcacaaaaatagtattttatagattttaaatgacttctttactgcttaataacactctaagatagatgagatgtattttgaaaactatgctaaagaaaatgttgtatagtgttatcattattatcctacctggtgaataataaatgcttttacttttcaatatgtttgagcctttcaaaaaatatgaagttattccatcactgtccttagtattctttggccatgctactcatttttgttctcttaatcaccgctcataaattagttccttaggcttcagacatttcacttgtcttttcttgaacagcctcctacatgttcttattattgtaatttagtttttgagtgttgacagtttacttggcactgtttacagcataacatctttttttcagaggtgactaaaattgccacattgtgtttagtgtgttctcaggaagtcacagactgaactttaagtggactaagccattctaatcttgtatggaatatgaagaagcaatcaaaattcagtcagtggttagatttcagaagcattttttagtctcaatctcgtttctcctccaaccacgtttaaagctattttagttaaagtgatcagtgagtacacatctaatttaatttgtcttagacctgtaaattatcagaatgctactctgaattccagtggcgttcacactgaaattaaaagtgacgtgagactcttttgagaagggtcttgggaatataaagaatggctatttttaggtagccaaaatgtatgtttttaaagaatcaatatttttaaatctattgaaagcacagaataaagtttttagttgtagattagtggaaatattaagtgtatggctttcaagtagatcttccactttaaaaatagaaaaaaaatgaaggatagggtaaaagagaaagaaggggaagattggattgatttcaggtactatgacagacagctttgtttgtttcatacaatcttcgttttcttactgctcttggatattgaattatgtggtctaaaatcttattaaccagtttctgatccactagattataatgattgtgttagttgtgagcaagttagtaaataacattaaaaattaaaagggtacagaaccaaggaccaggagatctgatttctagtcttggattctccgtcttgggctgtcagagatgctggctgtggtgtttcaggtcacgtttttccttaccttcctgtcctgagacgttgcaacctcaactaagcccctccagaaactcaccacccagtaatcattatatacataatctgaaaaaaattaggaattgtatgggaaacaatacttgaaaatcagattgtctagagatttatgctttatgatcaatacataatagatcagaatagagatatgcaaagtcacctcagaaaattttaaaagcatctagattacaatagtaataatactaaattcatttacttatctaaagaaggatgacaatcaaaaggagtgatcatgaggcaaaacttgtcagtatctatccaaacactgaccggtgttggaggaactttagccaactgatattgagtattacaattctgtcagcaagatcattaaaaatatgagatggatatatatatatatattatatatatatatataatatatatatatgttgtatttagaaggagtaaaactacatattcagatagagtgaggtatttagtcatgaaaagatgagttagtccctggtgatgacgttaacagtttcatcataggctgacaatggagcagtggctacttatgaacagaggatagaggaaaaggtgtacaaaatctcagatactgtggaaagccaaattactagaaaattattttgcagcattgggacactgttgagattacatttgaagtttgatatcatgaaatttaaaggcaccagttagtatggttttgtgatctaatccagcaattttcaggtctttagtagagatgcacttgagatcatcctgggttaggtattttccagatacacatcatgaagagaggagtaaataattcagaaatgctttcaaaggagttgttgtaagaattagccatctaatttaagttctataacaaaggaacaaaaagtagggtaacttgataaataccggaggtttgagtgaagtaatagcatttgcatattgggaatcttggagaggctaaaaaactgttaatagtgagagtatttgagcaagtgaaatgaactgacagtagtttaagttggtgagggcgatgtttacattttaattgtgttggggggaggtagtgtcatattggttaatgacaaattttagtttatgaccatgcagtatgtaataaggtggaatatgacaaaaaagagagagacaaaaggtcaggggaaatttaaaaatgttgagaaacttaagaagccacatgtatactgatgtcactatgaaagatgattggaaatggaacagagatagagtcttagccataagccagtatgaagaggtgagtagagacccaggttccaatagataataacaacaaggaggttggagagggtgctatgagttgatggaaatagcttcaaaacatacagtaaaaaggcagaaattataaagcagagtattacatggtgggtttaatacagcaacctgaatgtttaaaaaaatcacttctgggggtgattaggatgaccatggatttgggacataatgggtctgggccaggtggaagagcatgggcactcactcactgctaattctctgagttcaaacacttcctttagtgacatcctggcatccagtgcatattctcttagctacacactggagtgaggccctattggctgtgagcagctctttaagcaagtaacaatttgcagataaatgataatgtcttgaactaagatggcaaatgatcaatatgagtttgcccctgggagatggatatgctttcagattactaacaaaaatagtattggagctttcaagtacaagaacctatcgtcatccaggtgtggtggctcatgcttgtaatcccagcactttggaagccaattagctgagcgtggtggagcatggctatagtcctagctactcaggaggctgaagtgggaggatcacttgagcccaggagtttgagtctgcagtaagctaagattgtgccactgcactccagcctggatgacagaacaagatcttttctcttaaaaaataaataagaaactatcatcaagcaatgtttagataatgaatgccattatgtgacacctatgggatgacaatcagctgttatttccccatgaaaagacatacacttttatactttgtagcgtactttttttcctagtagaggaaaataggaacctagaaattctgaaagtttattaacttcttaagtgggaaatatcaaataattaggtgtcctacctagatacttgtctgagatgatttttccaatttgtctcaactttcatgttgtaattcatttttgtcaatgaaaaattgcaaaataccttttcacttcaggttattagtggtgccattaagttgggtgaaagttgtgtcatctatatgatgtcactggatactcaacacattcttattaatcatatttatgtgtggtttgcataattgagttaataagtatgcacttttccttttagtcatttattcttcgtattaaggttactgttaaggcctatacaatttacacaatttcacagaatccataaacatcgaaggaatctattggtattataactcatcatgcggattaccatgctgcccaggtgggcattgtctttgcctttcctatcatctccttttgacttcatgcttcatgtaaatcttccgggacaaaagtagaaagtagcatgtctctctgtttcggtttccctgcctctctctctttattctgtctttattaaatgcctcattctaattcccaaatcattattttttgacattttcattcctatcatttggttataattttatagcttttaatcctttcattgcacctgtgtaaactaaagccttttatggttcatctttctctacaagaagcccaaccctttccctccccaccccttaattctagtataagttgcatagataggtgattttgtggttcttaaaaagattacatagcaaagggatggatcctcatcatgtaaacataatagtttcattaatttttggcttaaaataggtcttcatttgtcacttaaaattgacctatcaaaagtaagcatctgaatgtggaatgacgagttcaggaaaagctaaacacactgttcaatagcacaatgtggcttgctgacaatttagctgaccctacacctggaaagtgctatccagtcatgtgcctttgtggaaaagctaaaagtaagtttaggaagggattcattctttcaaataattaaaacttaatgagcatctcttattcttctactgagtagtctgcaagctttcacatttgcaagatagttctgtgtctacaaagaggtcagttatggccataccacttgtggaaatctagatttgaaatttcaggactcaggttcttcccaaaaattagttcaggatctaccaggaattattggagccttagcttgcaggtgtccacatcagttattgctaacatatttcctcactgtttgcagggttctttaggattcccaatacaaaagaaaaaaaaaaacacttctgactcatatttaggcacctctccgttagcactgtctaccaaaaataacttaattttctactcccgtccacatggatagtcttatgtccactctaaaagggtatgcttcctaaaattaaaaaaaaaaaaacagacaacacacctcctaaaatgatgacctactggaatttccaaaatggcacctatttcctatgttagtatattaatataactgtgggatatatgttagcatatgagtattaagttattgttacatagtatagttgcagctgagtacaaatattggtaaagcaaataataataataataataacgctatgtaatgaacaaaggaaatcaccgaaagacattgggattgacttagctaaggaggacaaggtaggtgaccatatgacagaggacattttatctgagtatctatgcaaagttcatatatttttctttttattttcctagtttattttgagagtcattcagatgccaaatggcatttgtatgctcaaaaactctttcttgaaatacttgcatttcagaatggaatggcccagtactattttcctccactaaagtattactttgttattagatttaagaaagtttcatggtctctgagagacttgctctcaagtctcttcaccacttgtgattatgtatagcagtgtttatcccgagacccatcaagatctttgcactaccgagtcaattggaaacaaaatgggggaggttgtcactctataaaataaattatcatgaaaatctaaagcatacatgtttgtttattaaatttctgccaagacaggtcctcaatgtgtttatgccaagtatcttttttttggtctggtataattccttttacctaataaatggtaaatattgtatactgctaataaaattaaatgtaaaatattcaagcttaaatatgtatatactttttaactttattcaaatgtttgttcaaaatttatgaatcaaataagaaactgctcttaagaccttttaagaaaatcatgagttaagtggtagaaaacagtgacattttacatttgtatggcattgtaaagtttatagcatccttttacatgtgttacctcatttgaatttcaaacaatttatcagttagagaaggatatgatcatcattttccaaattatagaaatgaagtacaaaaaggttaaatggtgaaagatcacaggactagttcctaggaaagcaagcctggtagccccaagctcagtgctttgaagtgcttgatagtaggataagaatcccagatagccctcccattaacttttctctgtatagcttcaattaattgagtttgctggctaagaactttgaatttaaaataaaaagaccaaattccagtcttcgttattttctagccatgtgattcttattcaaatgatgtaaactctctgagcctgacttctgtatctgcaacatggttatagtgcagctcctggatcttccacatagagctcatttggcccacaccaacaaggaaaaatgctctgaaaatgactgaatgccttttaaaaacataaacaaatattgtttcataccatcatggcattttgtaatgaggatttaacccagaggcaaaagatatagggtcaaacctcaactctaccactagaagctgtgtgactccagacaagtccttgaacctgtgtgagaatttgttttgttcacggtaaaataaggatttttgagtgatatttaagtcatttaaatagtgatatttatcaatgacaaattgctgtgagtggttgaatgggataaacaaaagtgtgaaggtctttatacaatgaaaaggagctatgcatatatattatatatatatttccatatatatagagaaaagcattatttgcatatagtatacttaaaaatgctaatttttggctgggcacagtggcgcatgcctgtaatcccagcactttgggaggccgaggtgggcagatcacctgaggtcagagttcgagaccagcctgaccaatatgaagaaaccctatctctactaaaaaaaaacacaaaattagcctggcatggtggcacatgcctgaaatcccagctacttgggaggctgaggcagaagaattgcttgaacctgggaggtggaggttgaagtgagccgagatcgcgccactgcactccagcctgggcgacaagagcaaaactccgtctcaaggggaaaaaaatgctatagttttagtactatgtcagaaaacataatggctcctgaatctttttggcttctaaaggaaatatgccaaagtaggtatatgagagggtgctgtgcacagaagatcatatgtgactgaagcctaatttgtgacttgtaactcactcatcttcacacttttgcctttctcagggagtttcaaactcctttcttcctgtattacttaaatttctcaaatacccaatgttcttaatttttgtaccacattctgagggacttcataagagttgaactgacattccatatagactcttcctttcatgcgtagttattcaccccactcatttattaaattgacagctttcttgagctaggtatagctagaggcctccttatcctctcactgccaacactaattttgcaaaagagaaggtgttatatgaagcgctgactgctatgaattgacagacaagatcacttttaaatgtctttatgggaagagtatgtaattcattctcattgatatgtgggggtaaaaaaaatccctgaagttgcaaacacacccaaaagggctcttgggaggtgagcaaacacatttaagtggtaactttacactctcaatgtgcaactcaacaaatatgagttgtcttaatacacactggatcttctgccctatagaggaaatcaacaggaagatttgggttagggtcatggcatccttaggggtgtcgcttcaccagcccaaaacctctgtgaccagcggcgcctttgtccaagttttgttcaagcctgctgggctcattcagcctacttggcccagtaggttgtgctcggcttgtgggatctgcccagatcccatacctgccaagggtgagcaaggtgcaaagcggcgaggggtgtgtgagtgagcactggggtctggccactgcacacagccaggcatgccggctgcagcagggtgggcagctccaggcgctggcaaaggcactggctttttgtggggtgggcagctccaggcgctggcaaaggcaccggctttgtgtgaggctgctggctggaccgggcataccacaaacggcttctactgtgggcactggggaatgcagtggtgcctggaagcttggcgatgccaggagacacagagccccaaagggtgtcacagccctggctcagggatcctagacctaagggcttcccaaagggccacagctcctctctccttctcatcacctgaacatggcaatcccggagtgtttcagccctggttatgttacaactgtttcagtcccgccattcagcaggtcccaagctcccatctcacctccaggaagaatgaagcacatggacaaccggagagcgagcaaggcagagaggagcttcactgagcaacataacaactcttaggagagccacagtgggcaccttctttctgcaggcaggtcgtcctgactagctgaggagacccaaagtgggtatctccttcccacagctggtaatcctgacgtctgtgtgagtctggcagagtctggggtttttaaggggtcagaagggaggaagtgcatgctgattggtctgtgggcagccatgggtgggcctggaaaaagctccataagttctcactttggtctacagactacccagaactgacagtctgacccccaggcctcaggctgtctctggattaaaggtggggtttcaccaaggatccacccctttctgcccaggaatctgtctgcctcccaccatcaacatgccctccatggcacccaggtaggggcacctgcagactcacactgagctgccctcagctcccctgccccagcctccctcccagagctcattgatgcacagagtttcagaggggttccaggcaggattggcatgtcaacactgccccaagcaggtgcatatggccagatcacaacagcacccaggctcggcttcaactttaaccttaaatctgggcaggcaccaggagtggggaaaggccagggagcaggagcaggcacttctgagcctgcaggggcaggggggcttcctgggccccagagagtgcagggatgtccaggtctggagccatggctaggcagcagcagcagcagctgcacctgcactgggaagtgtgggtctccaacccctttaacttggtagggggcggggctgccacctgttcctggcccctgccggctttgcacagtgtggggccctggccacacctgccccactgcagcatctgcctttgcagaggccacttcaggcagcctctgctgccattaggaccaaaaatagtaaaattcctctgagattatagttgagtggatttggggactttgatgatatacatcattgtcattctctatttcatttgtaactagatattattcagatgttaaattcaaaaaaatataaataacacattaaaagagtagtttcattaggtatatagctatattctttaaaatctcatccattgctataaattcatgcatttatgcattactctctagtttcttaacattcagcttgacatttccttttctattgacaccaataaagcccaatgcattttctgtataactaaatcatcttgaaaagagtttaaaacatgatacaaaaatgaaattgaaattgtcttttatagcttatgaataaattttgaatattccctttgtgctttgtgatttaggtgctgaacggctaaggtataaatagtacaccactactaggttcctaaaaagccgctttgatttgagatatatttaacttctacctcgaagacatagtttttatattggaagaaaatgttttttgctcctaggaaacttcagtattattctcatcacaagcttaacatgctatatctttcccaaagttggtgtatttcattgaatcattttaatgtgctctgactgaagaatatcaatatcactcttcagatgaaaggtggttccagtaatgcctgatgtctcagcatcatttgtaatacaaatgatggggagcctgtggcttaatggccactaatttattttgaatttatgatgcattgcagccattagtagtaagctgctttacatcagttcatggcgaataagagttctgtttgtggtaggttttatttcttgatgtcagatgagaaaatatgactatttcaaaaggaaaataaacccagtcctaaagtggaatcaggtcagaagtctaccagttctgtgtaacaatatatcatgcacttcactgtgccttatcataggtaactgtggggtatttttaaatgaaaaactgtagccctgctgcttttgcattatattaaaacataaatttaatatgcaatttccactggggttttttgaacactttattaatatatatttatcatgaaattttgcagaataagtaatatattataaattttatgttatgaagattgccatatatttaaaaacataccaacattagaataaaactaacctttcaaatggcccctaacagatataaattctctatgactttgataggaaaaaaggagaagcggaatgcatcattcaccctttaaagagatcaccatctacttgaggtaacaagattttggtagaaacattattttaatgtatggttttaataagaactcagggatatagttggtgagacaccatacaactgtgagagatttattcccatatctgagaataaaaggtatcagtggttggaaatatgagagcaagcctccagggacagaagcatcatggacatggctgagtttgagctggatcttaaagaaagagcaaaatattagcagaaacaacatgcacacaaagcacaatggaggcaaaataataaaaattgctagagagtgggtgttaaatcaaatggtttatctgagagaagagatttcataaatatgaaataatagaaaatagggagggcttgagtgaaatgctttaaatgaacaccaaaaacaaacaaaaacaaagtttttctaaaactaattttaaacaccatatccaaattactaactccagcagccactaaggtccattgtagggtgagttcttgtcttgagctaattttcactttggtcaggcatcactccaaggctggattggttcaggaggctacacttggtgactttccccactatcagctgctgcagatgctgtatttcccaccactgcagttaaatcattccttctaaacaacagactgggcagatgccactttaggaccctatcaaaataacttgaccacagatgaccagcctcgttggaactcactgcctaattctgcctagaaattaagacctcatcttaattatttagttcttcatctctttctagcctttgttactaaacaagtcctgatcatctgtcctccttatgcataacttcctccacatgctgaccaatgattctccaatgatttctagtcttgcattagcatgccttccaatccctcccactgagccctctgaaactgcttttccaagatatttcctgtcatctgttctctacaccctcagcctccatttcactgaacaattcctctgtttgcttatcctaagcaagccctgaggtcttctctgactgacttccaatatgcatattggagattgcatgttgttccacagcttttcaatggtgagtcacagacaccggctctcaagactcagataacatctgtgcttgtgctgtgaggcacagttgcagatggggaagggatctgcaaatgaggtacaaaggacatttagggtcagcatcaaacaggacatacaactcacctaatcctctccatgaggttatcttctttgagagaattttggcacacacctaaaagcctagataataataataaagaggctactcattatcttatgaaatcattgatgaattaaaattgaagatttataataagttaaaaatgccagtgtttgggttgattgcattgttgagaaagaggaatttcagaccagtttattagaattctaaggagtgatttttgcttagtaatggaccttttaaaatagtcagtccaatctctaaaacctctttcctcttgaaacatcattaaataattttactttaaactatgtcctcttaggcatttgattactaacaaaatgtttatgctccttaactgctttgactgcaataaaaagggagctgacttcctgagtaactgggtaaattgataggactttttctagattttctaatgtttaataccattgcttttatttgaaaagactggacttttggggggatgacttggactccctgtctttagattgtcctgactctagcctgtccctgttacacaattttccctagctctgaaccagtgttcctggccctagaagcacagttaaattaactgatacttggggtatggtcctgtttttatcctgtcaactcttataccaacccaacaaatggaatagttcctttcttctccaatggtttagcatatcagcttgcgcctgtaggtcactggtctaaactagagtacaccacacaaagagcttgtggattgcagagactgatactgctttgcctatacagtatgagataatgatccattctcctgttttatttcattatttggttgtttataagatttatattaaattatatccttaaagatctctaggctatgcattctcatggtgctttatcacagagatattgtacttataaaaaatgtattcacatcaactccacagcagatgtctggtctaaactattttgcccagcacgtataccacattggatttgggtggtttcagttttgatttggagaattgctttagcagtctatgtcacaccatcacaagaatgaaatctttctgccaaggaattattttatccataaaatatgcaactatactataagatttccaagatagaatacctcctaacaaaaacataattcttcaaagcgtatgtgtgaatgattgtgaaatacaagtacaaatctaaacttgtttccatatcaaactgagggctgggctgctatttctcgtggaccaataacaagatgcagatgaactggggaggaagagagtttttattttctgcaactggttatgggagaaggcctgtctattctgacatagaccaagtctctgtccttgtttccaaaatataaagtatttttcattcatcctaccctttgctggcatttcaacattttgcttgtcactaattttgactctttatcttaacaagggtttatggcagggaatagtattgacccacagatgagctttgcctcagagaaagaaaatgctaatgactgctcataggtgaaagactatgagcacacagattagctctcaggaaatttaacacttaggtacaaaagaatctcttgaggatactgatccttattaagagcagatttttgttttctatcctcaaagattctttttttttttagtttacatttttattaaggtcttcatgtttataaactattgctatttttaaatttatatcacttacccatttatctatggagaacttacagttctccaaatcaatttgtgcatggaatattatatattaggatgcaaactatttcactatggagctgggtgtaaatttttttttcatttatttatttatttattttattattattatactttaagttttagggtacatgtgcacaatgtgcaggtttagttacatgtgtatacctgtgccatgctggtgtgctgcacccattaactcgtcatttagcattaggtatatctcctaaagctatccctcccccctccccccaccccacaacagtccccagagtgtgatgttccccttcctgtgtccatgtgttctcattgttcaattcccacctatgagtgagaatatgcggtgtttggttttttgttcttgagatagtttactgagaatgatgatttccaatttcatccatgtccctacaaaggacatgaactcatcattttttatggctgcatagtattctatggtgtatatgtgccacattttctgaatccagtctatcattgttggacatttgggttggttccaagtctttgctattgtgaatagtgctgcaataaatatacgtgtgcatgtgtctttatagcagcatgatttatagtcctttgggtatatacccagtaatcggatggctgggtcaaatggtatttctagttctagatccctgaggaatcgccacactgtcttccacaatggttgaactagtttacagtcccaccaacagtgtagaagtgtttctatttctccacatcctctccagcacctgttgtttcctgactttttaatgattgccattctaactggtgtgagatggtatctcattgtggttttgatttgcatttctctgatgaccagtgatggtgagcattttttcatgtgttttttggctgcataaatgtcttcttttgagaattgtctgttcatgtccttcacccactttttgatggggttgtttgtttttctcttgtatatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtgaattttggcttctgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtccaagatcagatagttgtagatatgcggcgttatttctgagggctctgttctgttccattgatctatatctctgttttggtaccagtaccatgctgttttggtgactgtagccttgtagtatagtttgaagtcaggtagcagatgcagaaaaggcctttgacaaaattcaacaatgcttcatgctaaaaactctcaataaattaggtattgatgggacgtatctcaaaataataagagctatctatgacaaacccacagccaatatcatactgaatgggcaaaaactggaagcattctctttgaaaactggcacaagacagggatgccctctctcaccactcctattcaacatagtgttggaagttctggccagggcaatcaggcaggagaaggaaataaagggtattcagttaggaaaagaggaaatcaaattgtccctgtttgcagatgacatgattgtatatctagaaaaccccaatgtctcagcccaaaatctccttaagctgataagcaacttcagcaaagtctcaggatacaaaatcaatgtacaaaaatcacaagcattcttatacaccaataacagacaaacagagagccaaatcatgtgtgaactccctttcacaattgcttcaaagaaaataaaatacctaggaatccaatttacaagggacgtgaaggacctcttcaaggagaactacaaaccactgctcaatgaaataaaagaggatacaaagaaatggaagaacattccatgctcatggttaggaagaatcaatatcatgaaaatggccatactgcccaaggtaatttatagattcaatgccatccccatcaagctaccgatgactttcttcacagaattggaaaaaactactttaaagttcatatggaacccaaaaagagcccgcatcgccaagtcaatcctaagcctatcctcaaagattcttatgcagttggtatcaaagtgccctttataccttggagcactttgagaaaccttacccagtgtgtttgtaaatgtggtgtcaggaggaacaaacttttcacagctgtcctggacagatgccagaaatttccccttctttgctcttagtgctggttagtcttaggaataacaggcttcctagggtttcttgtagatgctcattaaaaatagggcaaaaaatccagagatacagtgacgggttctgctcctttctttcagaaggaaatgaaaagcaagttatcgtagggatagcatgctaatacagtcaccgttttcagttaccaccattcttttcactcaattttagagttctttcaagaagcaaggaaacatcaatttgaatctgaagaaaattcacgggaatctctgaagccagccagtagttaaaagcaagaactttgtgctattggttagttgatttacagcttattttaggacagagaggaaaggagtgtgtgttcaatgttcactttgttgcctgccagtcctcctgttatggtagaagttatctgagttactggtggtgaatccatctgggtctgcagcaacctcaattcctgcctccccagaagaaataatttgactgaggggcataaggcagaaagagactgaggcaagtttcagagcaggagtggacgtttattaaaaagttttacagcaggaaagaacacttaaaagagatcctagcgggtgacttggggtgtttaactgtgatcctaggactttataggctggcatcttgcagccctttcccatgattcttcccttagggtgggctgctcacatgcacagtgccctccttgctcttgggaagtgagcatgagcagtctgtttaggaagttgcacacatgtgcatctgaggctttcttcccttttctggtagagtgcccctggaaagtcatattccaacattttgtctcttaatgctcatgtccaggaacttgcttctccctggcacttgcattctattaacactttaatgttaacagctctggatcatcaggaaattgtctctccctggtggcctaggtggggctgctgaattatcatttttaaagaggcagtgtgataattgtcaaaccaccacctaatattcctagtggatgtgggagaaaagcccactcttgccctgttcatgcctaacaacctgtaacactccacagtgtccctaaatgtcaacctaggaggaaagtgagaaatcacagtggagatgggaaaatcaagtgttctgcagtttaaagagaaattaaaggcaaggaaaaatatcctaatgaaagctgttgaaaatgtatagagaggtttgaaacaatcaggcatctgtagataatggtcctgatctaaaagataaacccaaagaagagaaacacttatcaaaatgaatttctctagagatattttaggctctgctgaaagtaaggatggggaattaatgatattcttgggctacatctttatcaatatctttatcagtcaatatattttgaagattctctttccttcagcatgtttttcctctctgtataaatccatgcacagttaattttcttcataatttcatgttttagtttggttttattactagagctacattattggaagtttaagaaaggatcttcccacccacaagaaattgcatgcatctgtaaattgtcaaaaaaagtagatgactcagtgcacagaaattattctgacaaagaagaaaccactctttcagaacttaattatgtataatgctaggctgcagaagaagcaatgcttgaggtaccagagggaaaatgcatatgaatatcagttactcaagggactcatcatgctgtttcactgataattagtcatactgtttaaaaagagaaatttaggatgccggcactaaagaaagaggctagagtaattactgaggagtcagaacaaaaggcaaactttgtaaattatttacctataaatcaaaacatcgtttttctacattaatatttttggacttaagaaaatacttgtaaaagttatattgacaaaagatcatttaaatgcctttgcatttaaaattcattctgataatttgccatctctaaattagagaaaaggatacaacatcataatcttacatgacatgctttgcatttttagcatttatataaatcctttaaaatataaactccttaaaggcaggcatcataactatcttgttcatcataatccctgcacatagcctgaaagatgctcagtaaatatgtggtgagtaaaggaatgaacaaattttttcacttgtattgttgtaaaaattgtctaaatcaattttcaagtaaattaagactttaacaaatttttattaaacaaattaaatatatttagaagctactacatccaaatattacatttaaatgtgtacaattgatacataaattttccaattacatatcaatttctaattttgaaaatgaggaatttttatactgaacttacaataatcttaagcacataggatttgcaatgaaaaagacttagattcaaagcctggctctgtaatttgttcagtcacaagaacttaacttttccaagcttccatttccaaatctgtagaatatgagttcaactatttaacttacagtcttactgagagaaaatgaaatactgaatgaaagtcacttagtggagtacttgtaattcactaaaactcactgttgaaagttattattaggatgttttctatatgagaaacaaaaaaagattcagtttaaacaaaatgcacatatattatcttgcgtaagattattgatagggactggaggcagggaaattctgagcagaagagggcgagtcccctggcaagtgccccaccctcaagcctggaacagcagcccaaaatgagaacatacatttcttttttcccactggaatgttgccttttccaaaaccacccataaccccccacccagcacccccatcccatacccataaaaaccctaggctctgctggcagagaagaggagaagcagctggacattagagattatggttggacgtcagagagaagcagcttgacttcagagtgacggcttgacaatgttgcttcaaagaggagtccagcggggaaggctggactctgggggaagcttatcttccagttccattccctttgcagctccccttcctgctgaaagccactttcattggcaacaaaatcctccatattcaccaaccctcaattcattcgtgcaacctgatttttcctggatgctaaacaagagctcgggtgccacaggtgcagatgctaaaggctatcacactgaccctctgccctcactggcagagagcacccacctcatgcaaaaaggcagagggcccactgagctataaatacttaagccgtctgtggacggcaaaagctaaaagagtgctgactgtaacacatgccctctgaggcttcggcgatagcaggcacctcctagacactgctgcagggccctggatggagattggtctggccagcacccaaaagcgcttgccccaactcctgtacccactcatctgtgcactccctcttgcgaggggtgaaatgtaatgggtcccagtgagtggagtttgcccctgccagtgctgaagtggccggctacatccagtgcccatgtactctagatccccccatcaaaggtgtcagggaaacttttctgcttcattatgagagcctcatctcattgaattgagaggtagggtagaccctaaggttagttgattctggagttcaaggatgtcatcagaaaccaggtatttacacccctcccctcatctccctcatcaccttcatccttagactgcttctctttatgattataaaatggctgccaggagcaatcagacaatatgctgtctttttcatatctgaagaaaacagaaacaaaatttgtcttccttaccctcaaagccctaaccaagtctattctcgcattttattcactcaaatgagtttaggtctaaccattcccataaagtattagcaaaagaatgaggtcattgtcactggcatagagtcctattgggttgggaatggatgttggagaatcaagcatagtatccactataatgatgataatgacaatggggatgatggataattgccctatgaattgatacaaaagtagtaaaatttcaagttaagatttaaatcaacaaataatagaagaaactctgtacataggcactgaagtagaaattcaatgggttggtcacaaaacacacaatgaatgacaaaaaataattcacattctacctcaggagacagaagtatcagaatcaaagtaacatgccataatatagaactgtggcaattatgatacacgcacacataaaaaaggagatattcttcctggaaggtttagaaggtgtacatagaggttatatttaagattaattttgaaattcttatagacatttcttatgtctgcaaaaaaggcatattcgtcagaattacactgaaagcactggaagactaggaagtttaattatcttttgttcattctgtatcatcagtgcctagagctatgtttaaaacatagtgggtactcaatatttataagaatatgaacaacattcacaaaggtaatcatgaaagaatggaaaacataaagtgaaaaattgtgaagttgaagacaggtcacatgatgaatgggacatgtcttattttaaagtatttagcctttattctggagctaatagtcaattacgggttttaaaaaggagaaccataatcaataatatgctttttgaaagatcactcttggttacttctttgtgtccagtaaaaggtcggatgaacttcaagtaaggaaacagcaacaaggagaaaagaaataactgtcttcgaagtatatttagaaaacagacttgtcagtactttgtaattaatttgatgtcaaatgtgaagcacaaggagtaatctaagatgatgtctggctttcaggcttgattgaatggatagtgatgtctaccaatgaaatcagcaatacaagagccaaagcaaattttatttcagggcatgaattaaacaatatatatgactcagtttattttgaggcatcagtgacatgagcacctgaaaatgctagaaaggtcttgtttgtcttgtcctacaatcagaaaagagttttaatctacaatttttaatttggtacccaccaggtagtcaaagtctaaagaaaacttagaaagtgagatgagaagatggcttcacatttaacgttgagctgagcaaaagtagactctgagttaatgttaactccctcaagaacatctttaatagtaccccagtttggttcaagctatgttagcattccaaataggctgtcctctcatgcatctgaacccagcagaaaattattttatcttttccttcaaagaatattgacaaagtaacagcaacataattaagaaatttatggatgaggatgtccttgcaatatgatccctaccccctcaaagtcagaaaggcaatagtgtgtttttttactgttgtttgtatgtatgtgtttttgcttttgtgacaggatctcactctgtcatgcaggctggagtgtagtgacgatcatagcttgctgcagtctcaaactcttgagctcaggcaatcctcctgcctcagcctaacgggtagctgggactacaggtgtgcacccccatgcctgtctaattattttattttagtagtgacagtgtctcaccgtattgcctaggctagtctctaaatcctgtgctcaagagatcctcctgcctcagactcccaaagagctggaattacaagtgtgagccagtgcacctggcctattgtgttctaaaacaaatgacattttactaccaagaactggacatgcatacatatatgtgtatacatctaatgatatagttatatgaaagaaaggcattaaaaattaagttactatttaagcagaaagttttacaattattagactattataataaagttattatgttgtacatttcaataaaatcattaaataactctaaacaacaacgaaattgttatttaatgcaaaattcaaaatatattgtacagaaaatagtataatgtattaagggtttcaaattaaaaaattataaaatatttttctaattaattgtttttaactcttttctaataaataaacatttgattgtatcattcttttcctgatccccaccacatatctagaacttgtgatcttaacttcttctttcaggccaaatggagggaaacaatccaggaagaggagcacataggaggcaccataagtgaaagggtgcaattgtctagctcacactttttaaagcaaacaatactgtcaaacaggttgaatccatttgcagactctaaccaattatttgagcagttctttctctctagccctagactaggtaatgggtagggtatgggttgtataaccggaagctgtgtaagcagaggcaaccttagtgtaagaagaaaaagtggatcttatttgtttaataattgcaaaactctttcccatatattacttcacttgatcctccaacacggatcctacaacaatctgtgaagtagtctagataccattaatcataaaaacagaatcataggccacgcgctgtggcacacacctgtaattccaatactttgggaggccgaggagggcagatcacctgaggtcaggagtttgagaccagcctggccaatatggtgaaaccccatctctactaaaaatacaaaaattagctgggcatggtggtgggtgcctgtaatcccagctactcggaaggctgaggcaggagaatcgcaagggttaatcgagggattggtagaagtggagaggcgtgggtcaaaggatacaaaattttagctagataggataggattttagctacaaatctattataaaaagttaaattttatcagaacttatgcacaggaacccttacagacgctacaggccaccatccacagtgcagaaaaatgtaaacaaacataaggacacggtataaaatcaagctgcctgaaattaactgtaatacatactgtactactgtaataattttgtagccatctcctgttgctactgtgctgggctaaagtgttgtgtcatgcctaaaacatgtgtgacacttatctctatgtgagcggttctttcctctagtaaattatcacaataaaaaatgggctctcagagttcttgcatattttgtatcatgtttcgtgcaataccataaaccttgaataacaccacgggacccatacaaagttgaattgcttgatatgtaccatagactgaagtcggctactgtagctgcctaccatttcaagataattgaatacagcaaaaatactactgtaagaaaataaaaggaaatttatgaaatttttgttgcagactctgccaacaggtgtgaaaaccttacactttttgcaaactacctttttatcttgtattgaaaatgcagcttttatgtaggttcgggattgctataagacttacctatagatatgcactttaatatgatttgagaacaagcaaatgacaacttaaagtaaaagctaaatgaaatatctaaatccagagtatttaataccagcaaactgtggtttgataattttaagtagagatttggctttaaaaaatgtcacgataacaggagaagcagcttctactgaccaaaaagcagcagatgacttccaagacatcactgaaaaaatcattgagaagaaatgacatctgcctgaacaggtttttaatgcagacaaaagtacactagtttggggaaaaaaatgccacaaaggaaatttattagtaaggaagagaaattagcattgagaatttaaggtaggaagggacaggctaactgtactgttttgagcaaatgcaatttatgattaggactgcccttatctacaaaggcgataactcctgagttttgaagggacaagatcaacaccagctgccagtctttttgctgtacaacaagaaggcctggacaatgagaaccctttttctgtattggtttcattgatgctttgtgcctcaattcaggaagtaccttgccagtaagggctgccatactggcagtttttttgatattggataatgaccttgaccacccaaaaccccacgaattcagtgccaaaggtgtcgaagtggtctacttgcccccatacacaaaatatctcattcagcctctagatcaggaggtgaggtcatagcacctttaaggctcattacacatggtactctatggaaaaaatggtcaacgctgtggaagagaacctctatatagagagtatcatggatgtttggaagaattacacccttgaagatgtcgttattgttatagaaaaagccatgaaagtcgccaagcttgaagcaataaatttctgctagagagaagatgttttgcaagacttcacaagatttatgatagagccaatcaaagaaatcatgaaagagattgtggatgtggcagaaaaggttggaatgtaaaggacttcaagatatggatcttggagaaattcaagagataataaaaatcacaccagagtaattagtagaagctgacttgatggagatgaaagtttccaaaccagcgccagacattgaggaagaacacatagaagaagcagggcaatggggaaagcattccctatttaacaaatggtgtggggaaaactggcaagccatatacagaaaactgaaactggacctcttctttacaccttatacaaaaattaactcaaggtgcattaaagacttaaatataagactttaaaccataaaaaccctaggagaaaacctggacagtaccattcaagacataggcataggcaaagacttcatgactaaaacaccaaaagcaatggaaacaaaagtcaaaattgacaaatgagatctaattaaactaaagagcttctgcacagcaaaagaaactatcatcagagtgaacaggccacctacagaatgggagaaagattttgcaatctatccatccgacaaagggctagtatccagaatctacaaagaatgtaaacaaatttacaagaaaaaaacaaccccatcaaaaagtgagcaaaggatatgaacagacacttctcaaaagaagacatttatgcagccaagaaacatgaaaaaaagctcattatcactggtcattagagaaatgcaaatcaaaaccacaatgagataccatctcatgccagttagaatgacgatcattaaaaagtcaggaaacaacagatgctggagaggatgtggagaaataggaacgcttttacaatgttggtggaagtgtaaattagttcaactgttgtggaagatggtatggcgattcctcaaggatctggaactagaaatacaatttgacccagcaatcccattactgggtatatacccaaaggattataaatcattctactctaaagacacatgcacttgtatgtttactgtagcactgttcacaatagcaaagacttgcaaccaacccaaatgcccatcaatgatagactggataaagaaaatgtggcgcatatacaccatggaatactatgtagccataaaaaaaggatgagttcatgtcctttgcagggacatggatgaagctggaaaccatcaatctcagcaaactaacacaggaacagaaaaccaaacaccacatgttctcactcacaagtgggagttgaacaataagaaaacatggacacagggaggggaacatcacacactgaggcctgtcggggggcggggggctaggggagggacagcattagaagaaatacctggatcgctggagccaagatttgctggagccaaataggaacagctccggtctacagctcccatcgtgagcgacgcagaagacgggtgatttctgcatttccatctgaggtactgggttcatctcactagggagtgccagacagtgggctcaggacagtgggtgcagcgcaccgtgtgcgagccgaagcagggcgaggcattgcctcactcgggaagcgcaaggggtcagggagttccctttcctagtcaaagaaaggtgtgacagaggcacctggaaaatcgggtcactcccaccccaatactgcgcttttccgacgagcttaaaaaacggtgcaccaggagattatatcctgcacctggctcgtagggtcttacgaccatggagccttgctgattgctagcacggcagtctgagatcaaactgcaaggcggcagcgaggctgggggaggtgcgcccgccattgcccaggcttgcttaggtaaacaaagcagccaggaagctccaactgggtggagcccaccacagctcaaggaagcctgcctgcctctgtaggctccacctctgggagcagggcacagacaaacaaaaaagacagcagtaacctctgcagacttaaatgtccctgtctgacagctttgaagagagcagtggttctcccagcatgcagctggagatctgagattgggcagactgcctcctcaagtgggtccctgacccctgacccccgagcagcctaactgggaggcaccccgcagttggggcagactgacacctcacacggccgggtactcctcttagacaaaacttccagaggaacgatcagacagcagcattagcggttcacgaaaatccgctgatctgcagccaccagtgctggtacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccataaagatggggaaaaaacagcagaaaaactggaaactctaaaaagcagagcacctctcctcctccaaaggaacgcagctcctcaccagcaatggaacaaagctggacggagaatgactttgacgagttgagagaagaaggattcagacgatcaaaccactctgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaaaaatgcagaaacctcaggagcggatgtgatcaactggaagaaagggtatccgtgatggaagatgaaatgaatgaaatgaagcaagaagggaagtttagagaaaaaagaataaaaagaaaggagcaaagcctccaagaaatatgggactatgtgaaaagaccaaatctatgtctcattggtgtacctgaaagtgacagagagaatggaaccaagttggaaaacactctgcaggatattatccaggagaacttccccaatctagcaaggcaggccaacattcaggttcaggaaatacagagaacgccacaaagatattcctcgagaagagcaactccaagacacataattgtcagattcaccaaagttgaaatgaaggaaaaaatgttaagggcagccagagagaaagatcgggttacccacaaagggaagcccatcagactaacagcggatctctcggcagaaactctacaagccagaagagagtggaggccaatattcaacattcttaaagaaaagaattttcaacccagaatttcatatccagccaaactgagcttcataagtgaaagagaaataaaatactctacagacaagcaaatgctgagagattttgtcaccacaaggcctgccctaaaagacctcctgaaggaagcactaaacctggaaaggaacaaccagtaccagccactgcaaaatcatgccaaattgtaaagtccatcgaggctaggaagaaactgcatcaactaacgagcaaaataaccagctaacatcataatgacaggatcaaattcacacataacagtattaactttaaatgtaaatggactaaatgctccaattaaaagacacagactggcaaattggataaagagtcaagacccatcagtgtgctgtattcaggaaacccatttcatgtgcagagacacacataggctcaaaataaaaggatggaagaagatctaccaagccaatggaaaacaaaaaaaggcaggggttgcattcctagactctgataaaacagactttaaaccaacaaagatcaaaagagacaaagaagaccattacataatggtaaagggatcaattcaacaagaagagctaactatcctaaatatatatgcacccaatacaggagcacccagattcataaagcaagtcctgagtgacatacaaagagacttagactcccacacattaataatgggagactttaacaccccactgtcaacattagacagatcaacgagacagaaagttaacaaggatacccaggaattgaactcagctctgcaacaagcagacctgatagacatctgcagaactctccaccccaaatcaacagaatatacatttttttcagcaccacaccacacctattccaaaattgaccacatacttggaagtaaagctctcctcagcaaatgtaaaagatcagaaattataacaacctgtctctcagaacacagtgcaatcaaactagaactcaggattaagaaactcactcaaaaccactcaactacatggaaactgaacaacctgctcctgaatgactactgggcacataacgaaatgaaggcagaaataaagatgtcctttgaaaccaatgagaacaaagacgcaacataccagaatctctgggacacattcaaagcagtgtgtagagggaaatttatagcactaaatgcccacaagagaaagcaggaaagatcaaaaattgacaccctaacatatcaattaaaagaactagaaaagcaagagcaaatacattcaaaagctaggagaaggcaagaaataactaaaatcagagcagaactgaaggaaatagagaccaaaaaaacccttcaaaaaattaatgaatccaggagccggttttttgaaaggatcaacaaaattgatagactgctagcaagactaataaagaagaaaagagagaagaatcaaatagacgcaataaaaaatgataaaggggatatcaccaccaatcccacagaaatacaaactaccatcagagaatactacaaacacctctacgcaaataactagaaaatcttagagaatgggataattcctcgaacgtacaccctcccaagactaagcagggaagaggtgaggtctgcgaatagaccaatggcaggctgtggaatggtggcaataagcaaaggctggccaaccaaaaagagtccaggaccagatggattcacagccgaattctaccagagggacaaggaggaactggtaccattcttagggaaagtattccaatcaatacaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaacgaatccaccagcacatcaaaaagtttatccaccatgatcaagtgggcttcatccctgggatgcaaggctggttcaatatacgcaaaccaataaatgtaatccagcatataaacagaaccaaagacaaaaaacacatgattatctcaatagatgtagaaaaggcctttgacaaaattcaacaacacttcatgctaaaaactctcaataaattaggtattgatgggacatatctcaaaataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggggaaggaaataaagggtattcaattaggaaaagaggaagttaaattgtccctgtttgcaaatgacatgattgtatacctagaaaaccccattgtctcagcccaaaatctccttaagctgataagcaacttcagcaaagtctcaggatagaaaattaatgtacaaaaatcacaagcattcttatataccaataacagacaaacagagagccaaatcatgagtgaactccctttcacaattgcttcaaagaggaataaaatacctaggaatccaccttacaagggatgagaaggacctcttcaaggagaactacaaaccactgctcaatgaaataaaagaggatacaaagaaatggaagaacattccatgctcatgggtaggaagaatcagtatcatgaaaatggccatactgcccaaggtaatttctagtttcaatgccatccccatcaagctaccaattactttcttcacagaattggaaaaagctactttcaagttcatatggaaccaaaaaggagccctcatcgccaagtcaatcctaagccaaaagaacaaagctggaggcatcacgctacctgacttcaaactatactacaaggctacagtcaccaaaacagcatggtactggtaccaaaacagagatatagatcaatggagcagaacagagccctcagaaataacgctgcatatctacaactatctgatcttggacaaacctgacaaaaacaagcaatggggaaaggattccctatttaataaacggtgctgggaaaactggctagccatatggagaaagctgaaactggatcccttccttacaccttatacaaaaattaattcaagatggattaaagtcttaaacgttagacctaaaaccataaaaagcctagaagaaaatctaggcattaccattcaggacatagtcatgggcaaggacttcatgtctaaaacaccaaagcaatggcaacaaaagccaaaattgacaaatgagatctaattaaactaaagagcttctgcagagcaaaacaaactaccatcagagtgaacaggcaacctacaaaatgggagaaaattttcccaacctactcatctgacaaagggctaatatccagaatctacaatgaactcaaacaaatatacaagagaaaaacaaacaaccccatcaaaaagtggacgaaggacatgaacagacacttctcaaaagaagacatttatgcagccaaaaaacacatgtaaaaatgctcaccatcactggtcatcagagaaatgcaaatcaaaaccacaatgagataccatctcacaccagttagaatggctatcattaaaagtcaggaaacaacaggtgctggagaggatgtggagaaatagaaacacttctacactgttggtgggactgtaaactagttcaaccattgtggaagacagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaaccgaaatgtccaacaatgatagactggattcagaaaatgtggcacatatacaccatagaatactatgcagccataaaaaatgatgagttcatgtcctttgtagggacatggatgaaattggaaatcatcattctcagtaaactatctcaagaacaaaaaaccaaacaccgcatattctcactcataggtgggaattgaacaatgagaacacatggacacaggaaggggaacatcacactctggggactgttgtggggtggggggaggggggagggatagctttaggagatatacctaattctaaatgacgagttaatgggtgcagcacaccagcatggcacatgtatacatatgtaactaacctgcacattgtgcacatgtaccccaaaacttaaagtataataataataaaataaaataaaataaaaaaagaagaaatacctaatgtaggtgacgggttgatgggtgcagcaaaccaccatggcacgtgtatacctatgtaacaaacctgcacattctgcacatgtatcccagaactttaataataataaaaaaagaagacaaagtagttccagaaaacaaattgacattagataatctgacagagggttctaattattcaagactgcttttgatttttttcatgacttgcactcttctatgatacaggcactggaactaaagcaaaatggtggaagaagattagtactctatagaaacatttttagagaaatgaaagtgcaaaaatgtcagacagaaatttctgtgtattttcacaaagttacaccgtgtgcctgcctctcctgcctctcctgcctccccttccacctcctccacctcttccatctctggcacccctgagtcagccagaccaacttctcctcttcctcctcctcctcagcctacttaacatgaagataatgaggattaagacctttttgatagcccacttccactccattaatagtaaatatactttctcttccttatgattttcttaattgcattttctttttgctagcttcagttataagaagacagtatataatacatatacaaaatgtgcgttaatctattatttatgttatcagtaaagcttccagagtcagcagaaggctattagttttttagccattttagctattagttattttttgttaattgacaaataagtattacatacaattcacccttgaacaacacagggtccaacacaagggttagggggaccaatcctccatgcattcaaaactgcatacacagagtgtgttgttcaagggtcaattgtatgtaatttttatttgtcaattaacaaaaaaaaattagaaaaaaactataccatgctttactgtacacttaaaaatttgttgagactagatctcatgttaagtgttcttaccacagtaaaataaatttttcagaaagattttagaaaacttaggaataattattagattttaatttattaaaggatattctatattttccagcagatactgtattttctcatatgctacttcctctacaaaggaagatgggaacaatttacatttaaatgttaaaactttgtttttaatgaaactagcatgaggtatcctcaaaaaggggagtagaatctctacaacagatagcataattattatagggtatttattcaatcataataattcataacacaaatagaataaaatgataatattgatgtaaaaaaataaagcagggagaaacaaaaaaagagatagacccagcagaatgtgaatggaatcataatgattaccagtttatatgtacataatatgtatttgagaagaatgtgtaaaccactgtctcatatgattggcatttctataaatttaacaaatttcttaactatgataattatttattgttgctacagtaccacatgcacatctctgtgccactttgttttaagataagtctgtaattcacagtgaactggttcttgggcatcaatttatgacaaattcattttcatttgtcagatagctttaggataacattattttaatgcgtgtatgtattgtttcatctccaagtcttgttgccatttttaagggctgtcagctgtattacataatttgatatggaaaatattttgggtcaatcattagtcttttttatgagtcttctgtatggactttttttctatttaaggaaagacatgtacattctgaaactggacatatattattaatctactactacatatactaatctaatctgatgactactgagtattttaataataaccatgtaacttggaacttttatccttcagaattatgaaagtaagcatatattttatagtatttagggtagagtgtgacgaagtatctagcatagtagttgagttaaaatcaatccatctttctatgtgcctatctacatagctgcacttttatctgtctgttaaagtctgttctttatataccattggaaacattcgagggtcattaaaataggaccccattttcttgttcactgaataagatttacttcatatttatgggcatttttcttaaaacctcttgacaatagttagggatgcaaagaaacatggtaaattatatccttgaagttcttattttgtcggttatttgccagatacttttaattttatcatttgcctttagaatacagttttttatttacgtcccaatgtttctttacagattactgaactatgaaaaacaatatttatatttcaagaaaagtaacagtcttattaatgaatgtaaatagacatctttcttgtgatttatgttattaaggcacaatagtaaatattttataaaatatttgtaggctgtatttgagataaattcaggggaaaatattttatttcagaatgctctgatgctctgcctctgagatatagaacaatgcagtggtgtgtttaggataacttatgcaatattaaaggctatcttttctgtggaattatttttggtcagttcctataaacaatcttttttcttccttaaattgcacaattaactaatattagcatgacattttaaacctagcaattatgtttttctaatgagatttatgtgtagatcaaaaatagatggcctctgatcttcatggccatagagaaaataaatatgtttcttgtgaacaccctggaattttcccagttttatggatcacattaatttaaaaatctatcatagatcttagtgtctgagaaatacacagaaactatacccgttattacaagaacaaaacaattcaaactcggccttgtgaaactaaaataaatctaaacttgagacttttatgtagagtgcagacaaaaagcattggcatttccaggaataaatctagattttattccctctaaaaattataccatttgggaaaaactgtttgagaaagaaaaatatgaatgttgtcttacctttcaaattttattaagcttatgaccatgtgaacacatctctaggtcctcccaggtccttggaagtgacctataaaagtgcagggctctggagattaagctgcatttcatagtaaactcacaatcgcatattcagtaatctctccttatctgtgggagatatgttctaagaccctcagtgatgacctgaaatcacagataatactcaacactatatgcccttaaaataggcacaagaagagattaacaacaattcataaaaaagaacaataatatactttagtaaaagttacgtgaatgtggtttcttattctcaaaagatcttactgtactatacttgccttttttcttcttgcaatctgttaacctgataactaagagggctgctaagtaactaatgggcaggtaatctatacagcgtgaatacacagggcaaaggaaggattcacatcccaagcaggttgaagcaggacaacacgagattttatcatgctactcagaacagtgcacaatttaaaacttatgaattatttatttctggaattttccatttaatatttttggacctttgttgaccacaggtaactgaaacgctgaaagtgaaaccttgggtaagggggactactgaaataaaaagacatgaagcaaggagcagattggttaatcgtttcattgttgttagtgaaatatatcgtaacattgtgcatggattcttctgttaaatattaaaccacgtgtattttttaaacaactagtcttcaaatactttaaatatttaaaaaatcacgtcttgacaatatgatatttaattgaagaagttactgcaaaatgtacttgtgtttacaggtagaatatttgaaagctttttgatcttcacatccttgaggattcagtgcagctttactcaatcaggatcatgcctaggtacatgaaactgtattgttaaatacttggttgataagatttagatttcttttttcatcttctgttttagaagcatttatattctcttaaagtctgatggttaggtttctaacttttccagtatttggattggtaaatgtactacttaagttacataaatgctttattattggtaatggcacatataaaatctcaatgcatttatatgactctctagtaatttgttatacaaagagtacagaaaacagtgatttaccatagactattgtttacatctgaatctatttgttcaactcttttattaccattgccttgtttggctcatataaattttatttaatttttctttctaactaatcacaatgataccaaattgtagtatatagttttatttgtagcatagattgctctctaaaaatatgtaccatgagtacatgtgtaaatcaatgaacatcaacttaaacagtagctatttcatgtgaactacacacattcttgtcaagaaacaggagtaaatggctgaggcccaggcataattccttggaagtgacaatgccaaaatgcccaaggaagctcttggcagggctactcatttgttttcacatatttatctatttgttcccttggtttcaaggctttaaacagaaattcagagcattttcatggtatctgggcatcattacaatatttactaaaagagaagtcctaaacatggtcattttatgggagaaatcagtagcacatggtgtttatgcaatgttatatatgattttactcattatgccaactgtattaaggggattccatctttctttgggccctcatcaggctaccacgatatacaatgagtggtatacttaagctctggctgaattgttctgtaatgtaatctgactcaaggagaacaaatggagagggtctttgtcattctactgtgtcatgtgaattttctctgtttctggagtctaagttgttctgtttttcacctgctatttgagaaattttttacaattttcgtgtcataagccagaatgcaatgggatgaatatggagcctttctttttatacactctcttgaaactcttcatgaaaagctttcttattgaattgtttcattctagcttgaatatcgaaatggaatgtgttacgataaattcataagtacgtttctattattatactatttatatagttatgacacattgtgaattgaatgaaaggtcttataaaattctgaaaagctgtgctgttgcttgtgtattatttatttatatctctaaaattatccactgactgcaaattgtccgtaagggacatattcaatgtaaaacaatcattcccagaactaaaaaaggtctaaaaatttcttttgaattttctttctactacaaatttttgcataagaacagaaacagtaacttctttctaaaacaacaatggaatctcaatatcaaaattagtctggttaagtacagcatgactgtaggcctagctgcttgggaggctgaggtgggaggatcacttgaggctcagagtttgaggctgcagtgtactataatagtgcctaggaacagccactgtacttgaagctggtcagcataatgagaccacatctttctcaaaaaaaaaaaaatctgatgctcagtatcaatcatttaaaaataaatgaatgaatgatcatgggacagaaaaatgataaattctgtattcaatctacatttgaacttatatttttgttacatctctgcaaattattttcatgggtttaagtatttttaattcattttatttttatttgcaaaaacattgcacatacatctaatttttaaaaattttctgggatcataagactacatggttaaaatattctattatacttttatagcagattcaatcaaaataagataattactgaataaaatgtaaacattgactagaaatgtcccttttaatgaaatcaataggcatcctgtatatctatagatgaataatttttagtgctagttaagcagatacaggtttttgtctcaattatatttctttcttggtttttcttggtttttaattgaggtacgtgctgagtaacttgttcacataataaagtagatgacagtggaaagtattttattttcagtattagtcaattatttgaacttgccaaaaatcacataatgatttattatcaaaaattatttgtaatgatctgtggactgacaattcacttgaatcttccctcaatattgtgaagagcagaaaattggaaaccatctgattaacaaaaagattatttctagtcaataaacttagcatttctgagaagtgtctcaaaaacatttaccaaaacttaaaaaatgaaaataactatactgcctttttatcatttagaggcaaaaaatcaaaaaattaaaatacaggtatacttctacttattgcatttcactttattgcactttgcaaatactgcattaattacaaattgaaggtttgtggcaaccctgccttcagaaactctgttggcaccatttttcatgacagcatgtgctgactttgtgtcttgtgtcacattttggtaattctcacagtatttcaaactcttattgttattatatctgttatggttatctttgatgttgctattataattgtttttgggtgccatgaactgtgcccatataagagggtaagtttaatgttgtgtgcattatcactactccatagaccagctgttctgctatctctccccctctcctagggcctctctactgtctgagatacaacagtattgaaattaggccacttaataaacctacagtggcttctaagtgttcaagtgaaaggaagagttgcaagtctctcatttgaaatcaaaagctagaaatgattcaccttaatgagaaaggtgctgaaagcacaggctgaaagctaggtgtctagcactaaggttagccaagttgtgaatgcaaaggaaaagtgaagaaagttttagaagtttggatacaagatcaaaccacccacaacattccctaagccagagcctaatccagagcagggccctaactgtcttcaattctactgaaggtaaggaatctgcagaagagaagtttgaagctagtacatttttttgtttttgttttttattattattatactttaagttttagagtacatgtgcacaacgtgcaggtttgttacatatgtatacatgtgccatgttggtgtgctgcgcccattaactcgtcatttagcattaggtatatctcctaatgctatccctcccccctccccctccaccacaacagtccccggtgtgtgatgttccccttcctgtgtccatgtgttctcattgttcaattcccacctatgagtgagaacacgtggtgtttggttttttgtccttgcgatagtttgctgagaacgatggtttccagcttcatccatgtccctacaaaagacatgaactcatcattttctgtggctgtataatattccatggtgtatatgtgccatattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggattgctgggtcaaatggtatttctagttctagatccctgaggaatcgccacactgtcttccacaatggttgaactagtttacagtcccaccaacagtgtgaaagtgtttctgtttctccacatcctctccagcacctgttgtttcctgacttttaatgatagccattctaactggtgtgagatggtatctcattgtggttttgatttgcatttctctgatggccagtgatgaagagcattttttcatgtgttttttggctgcataaatgtcttcttttgagaagtgtctattcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctgatggtagtttgttttgctgtgcagaagctctttagtttaattagatctcatttgtcaattttggcttttgttgccgttgcttttggtgttttacacatgaagtccttgcccatgcctatgtcctgaatggtaatgcctaggttttcttctagggtttttatggttttaggtctaacatgtaagtctttaatatatcttgaattaatttttgtataagatgtaaggaagggatccagtttcagctttctacatatggctagccagttttcccagcaccatttattaaatagggaatcctttccccatttcttgattttgtcagttttgtcaaagatcagatagttgtagatatgtggcattatttctgagggctctgttctgttccgttggtctatatctctgttttggtaccagtatcatgccgttttggtgactgtagccttgtagtatagtttgaagtcaggtagcgtgatgcctcacagctgtgttcttttgacttaagattgacttggcaatgcgggctcttttttcgttccatatgaactttaaagtagttttttccaattctgtgaagaaagtaattggtagcttgatggggatggcattgaatctataaattaccttgggcagtatgcccattttcatgatattgatcttcctacccgtgagcatggaatgttcttccatttgtttgtatcctcttttatttccttgagcagtggtttgtagttctccttgaagaggtccttctcatcccttgtaagttggattcctaggtattttaattctctttgaagcaattgtgaatggaagttcactcatgatttagctctctgtttgttattggtgtataggaatgcttgtgatttttgcacattgattttgtatcctgagactttgctgaagttgcttatcagcttaaggagattttgggctgagacattggggttttctagatatacaatcatgtcatctgcaaacagggacaatttgacttcctcttttcctaattgaatgccgtttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgagatatgtcccatcaatacctaatttattgagagattttagcatgaaggattgttgaattttgtcaaaggccttttctgcatctattgagataatcatgtggtttttgtctttggttctgtttatatgctggattatgtttattggtttttgtatgttgacccagccttgcatcccaggcatgaagcccacttgatcatggtggataagctttttgatgtgctgctggattcgttttgccagtattttattgaggatttttgcatcaatgttcatcaaggatattggtctaaaattctcttttttggttgtgtctctgccaggctttggtatcaggatgatgctggcctcataaaatgagttagggaggattccctctttttctattgattggaatagcttcagaaggaatggtaccagttcctccttgtacctctggtagaattcagctgtgaatccatctggtcctgggctttttttggttggtaagctattaattattgcctcaaattcagagcctgttattgatctattcagagattcaacttcttcctggtttagtcttgcgagggtgtatgtgttgcggaatttatccatttcttctagattttctagtttattagcgagattgcttctttccttaaacgtcatgaatcaacatttactagcttctagtatgcaaataaactagaagctagtaaatgttgattcatgaggtttaaggaaagaagccatcttgctaacataaaagtgaaaggtgaagcaagaaatgctgattagaaactgcagcaagttatcctgaagatctagctaagatcattgataaaggtgactacactgaacaacagattgtcagtgttgatgaaatagccttctattggaagtagatgctatctaggactttcattggtagatagcagaagccaatgcttgtcttcaaagcttcaaaggacaagctgactctcttgttagggcccaatgaagctggtgactttaagttgaagcaaagctcatttactattctgcaaaatctgtggcccttaataattatgccaaatctgttctgcctgtgttttataaatggaatagcaaagtctgtataatagtacatttgtttacagcgtagtttgctgaatattttaagcccactgttgagacctgctgctaagaaaaaaagttcctttcaaaatattactgcttattgacaatgcacctgggtcacccaggagctctgatagagatgtacaaggaggttaatattgttttcatgcctgctaatacaacattcattctgcagctcatggatcaaggagtcatttcaagtttcaatttcagcaaactatcgcaaggacaaaaaaccaatcaccgcatgttctcactcataggtgggaattgaacaatgagaacacttggacacaggaaggggaacatcacacactggggcctgtcgtggggtggggggaggggggagggatagcattaggagatatacctaatgtaaatgaggagttaatggatgcagcacaccaacatggcccatgtatacatatgtaacaaacctgcacgttgtgcacatgtaccctagaacttaaagcataataaaaaaatttaaatacattttgtaagcttacagctgccgtacataatgactcctctgatgaatctgggaaaaggagatggaaaatcttctggaaaggatttgctattctagataacatcacgatcattcactgttatgggaggaggtcaaaataccaacattaacagaagtttggaagaagtttatttcaatcctcatgggtgactttaagaggctcaggacttcagtgaagtaagtaactgcagatgtggtagaaatagcaagagaactagaattagaagtggagcctgaaggtgtgactagattgctgcaatcttataaaacttgaatcaaggagagttgcttcttatggatgagccaagaaagtggtttcttgaaatataatttacttctgatgaaaatgctgtatatattgttgatataactacaaaagtttagaatagtacataaacttagttgataaagcagtggaaaggtttgagagaattgactccagtttagaaagaagttctactgtgggtaaaatgctgtcaaatgacatcgcatgctacaaagaaatctagcatgaaaggaagaatcaactgatgcaacaaacttgtttgtcttattttaagcaattgccagccaggtgcaatggctcacacttataatcccagcatttagggaggctgaggtggtagtatcacttgagcccaggaattcaagaccagcctgggcaacatagcaaggccccgtctctatgaaaaaaattaaaaagaatagccaggcatggtggcacacacctgtggtcccagctactagggagacttagttgggaggatctcgagtctagggggtcaaggcttcagtgagctatgatcgatccactgcactccagcctgggtgacagagcaagactctgtctcaacaacaacaacaaaagattgccatagctaccccagcctttagcaactgccaaccctgatcagtcagcagccatcaacatcaaaacaggaccctccaccagcaaaaagactgaaaatcactgaaggctgagatgatcattaacattttttagcaataaaatatttttaattgttatgcacactttttagatataattcaatgcacacttaatatagtgtgtaaagtgtaaacgtaacttttatatgcactgagaaaccaaaaaatttgtgactcactttattgcaatattcactttatcaaggttctctggaacctcacctgcagtgtctctgaggtatgtcttatataatatgtgttatatatattctccacgtgtataatttattttcttcagctcttcaggtgaactttaccatgttagggacagaattatattctttttatacaacttgtacaattttcttttagttcttccctccaaaccctgttgtttttatagagcattctttcatgtggcctttttaaagttttatgttgcttgctattataaatgcaaacttttgtattctgtgtttgagttatctctttctgaaattgtgttattaccaatattctttcaaaagatattgtggagttaatagtattaggcactgaagtttaattttaaatttttttgcagaataaaaataataattatatttgtataaaaggatatgagtgcattgataagtgaatctcaatgtgttttatatatgatccatgtaaaaattctcaaatacaatacacttggaaattcttaataccatagtattagctgaaaaattatgttttttaggccaaatattggattgaaaattctgacctaacctagtatttatttcctccaaatagtgtccctagtttcagatgaaatacaattttaatttaagaatgaaatatgaaagcaagccatttatacattgacaagtcccataaagtactatggaatttaatcaagtctaagatagtctcaattgttaagttacactgttattttatagtacaccaagaaagaaaataatgctgtcactgaagtaaaacacagtttcttaacatttagaatttttataactactaaaagaacttttttagacttaaatgcagattattttaataattttaatcacttgtgaatattttatgtatatacacacacagacatacattggaaaatatacattaaaaaattggtaaggcattcctaaaccttcttccctttcactaccggactcttctaaattactttggagtctgagttttcaacattcacatctcacacctaagcttattctgtcagtgtgcaatatattttaacagagagatccaccatttttccagtgatttcatctaaagagctacacccaatctttaagttttgatgttgctatttactccaccttactagaacgtgtcaacagaagattttcctgtcaaaaatcaggatttatatttatattcatttttcaaatgctccttaaaaggttctactgaaatgtgattaagcattgtccaatcaagccacaggaaataataaccaaattcagacatgcatagtccatgataacaacattactacctatgactgcctcttgatgaacctatattggaaaaagtcattaggtgtaagacatcctttatgctaatatgataggatgtgaaaacaataggtgtcttagaatcaataaattatagtattaaagaaaaatcactgttgaagataattttaaaaaacaatttcagctctaattaatggcatatgtatgtgaatacagacacattattctagaaaataaaattttaacagacaagtcatttatgtaattcctagatttttttgttacataaatttacttgcatcttttaagatgttttggatattttaggtatgttctattgaaaaacttttccatcaagatttgaatgattatggttacaacgaaatatatgttcaacacttctaatttattatttcatgtgcttttatacatatgactgaaaataacctgtcaaactgatcatttgtgaagtattgaaaagttctcattatgtttcatgtgaactagtatttctcctctgaccattaaaatgtgctttcttgcctttccaaatgattggatgttaaagataaacaaataaatgacaagagcaactgagtatttctttatctcctctctgctgtaggtcctgtaagtagtgttttggtgaataaatacggcagccggccggtggtgatagcaggaggcttattatgctgtcttggaatggtgttggcctcctttagtagcagcgtggtacagctgtacctcactatgggattcattacaggtaagccatttagtcttcagcttattcttaactcttctgttattttcaaagctctatgagaagaatgaacaacagaaaattcttattttctttgaatttatttttttataaacaatgcagttttaaagtattttcatctagtacattgaaattcaagctatataatgggcaaacatttcatttttaaaaaaataaaaaattatcagacaagttacatgttatcatataaatttaaaaagaaaacagctttagtttgctttttttccttttttgcttttttctcttcagccaatggagatggtgttgttggacacagactttctgatgtaaataaataccttcgttattataaaacttattttcatgacttatctgcatttgcagtatctgactttccactcataatatgttaaaacgatgccagagagatattttctggatgcactgatttagctttaacaataaaattattgttacttgttctgattagtggtagagctcattaaccgtgttccttctttttcttactgaaatgatcctgtttaaaagctcagtgagccacactttcttctaacacaaatattaaaaatgacctactgtcacttgatgatagttgtttctcatgcacatatctattgactcaaaatgaccacaatatgtacacccggaaagcactatttttattagtctaaataaaaaattgcattacaaatttatattcaacatattaggaaaaattggacttcaatatataaagagactgaatcttttctttctgcccagagataaaaaggcaaacatatttacactcatgtaatcttacactcatgcatcatttgatgaaaaacatgtattgaagcttacagtaatagtgatgttaaaatctttctctttacaatctatccacatctctctccttttttgatataacaaaatgcatttaatattgtaaatgaaaaccgtcttatatgtaagcattatcatagtgaagagagtgccttttcttttgtgtagagaaattgactactgcatttgactgtagaagtcgggatgcgcctacaagtagggaaaagatgattttgttatttccttcactacagatatcaatggcattattggtgtttcaacttagaattgtattcctttggctcttaaatactttgatgcccccaaattcaattattaagtccatctatgagggatttactttaaatcattatcagcaaatactttgactttggtttccaaaagtagacagatctagcatttaaacttgacacatatgatctgtgtgatcatgggtacgttaacctccttatactttcgttgtctataaaattagataaataatagctctttttaaaggagttattagaaaaatgtaaaaaatgaatacgtagtactttagagtacccagaattttgatgatcataaataaatatttgcaaataatcataataccatttatataatatcttacagttctaaaacttactttattttggcaaaatctttttgtgttgttaggtgaagtcaagctcaggaagtctaagtgttttgcccagtaatataaaataggtacctatttggagtagatcagttctattgatttcaagcctatgtttgtttaaccatgccagaatgagaaagagatggcaactatttccaaatgaaaatatggattaagatttgaaggcaaaagttccaggcgacagaatggggaaaatgattgatataagattaaaaaaaaaaaaaccttaagctctgaaacataatacctggattttaatttgggttcttctacttacaagctacttgaccataggctggtcagttttgttatttataaatcggatttaattacactcattctgcatatctcacaggtatggctgaggtatagcgttagagaacatgctgtcctgttactctccaaagcatgttcttgttccttcttgtcagcttttaggggtcctcttacttatagaaaatgtctgtattaaagggttggagtatttgtacacagacctgtgtatttcacaactggaatacttaaccaccttacagaactgtttcaatctaggtaaattagttaatatagaagaactcttacctctctagcccctaaaataaatatagagtaattcctagtttaagggaaaacaagagatagtttatataagcccaattttatataaaccaatgtactttttttttttttgagacagaatcttgctctgtcgccaggctggagtgcagtggcatgatctcggctcactgcaatctccgcctcctcagtccaagcgattctcttgcctcagcctaccaagtagctgggattacaggcatgtgccaccacacccggctaatttttgtatttttagtagagacggggtttcaccatgttggccaggatggtctcgatctcctgacctcatgatccatctgccctggcctcccaaagtgctgggattacaggcatgaaccaccactcccggcctaaatcaatgtactttttaaaggatcttatttattacaattgctcagtagtgccttagtgagctacaagaggtaatttattttccaaaggtgatactcaacactgccaaggaactccctagacagtgggactttggctcatataaacaatcagtgttaatccctgaattaaaactatgtttcaagcaaaaacctcctttttacttagcacacaagtgcatctatatacattaaatgtggactgtgagggatgtacagcatgaaatttttgttatttgcatagtattgaaacaaatgtttgtggggagacataagattgttacaaattacgacctttttagtctgtttataattcttcaatgccgaaaggaaagtattcatttttatattgccctcttgctcacaaggaagaaatctattctatatatgtgtatataagtatatgtcaagaggaaaggatctgaggaattaaatgattttaattgagaactaataattttgtcctagtttcaacctattgtacgactgttgatatatcagtagaaattctcaatttcatttttgtgctttaaaattaaaggaattaaacttgaaatgaaactgtcgtttcaagtgttcagttatgaaaaccttattgttttgtgcaattacatttataataatcaaaatgtactatatgatattgcgtttttaattctgcctttcccacttgaatgtacattttgaggagtaatttcttttgtgagtgccataatgtgtttgtgttttcccccacttttgttttgttctttttaggtttaggtttagccttcaacctgcaacccgccttaaccataattggcaaatacttctataggaagcgacccatggcaaatggattggccatggcaggaagtcctgttttcttaagttcattggctcctttcaatcagtacctttttaatacttttggctggaaaggaagcttcctgattttgggaagtctacttttgaatgcctgtgtggctggttccctcatgagaccccttggacccaatcaaaccacttctaagtctaaaaataagactggcaaaacagaagatgattcaagcccaaagaaaatcaaaacgaagaaatcaacttgggaaaaagttaataagtatttagatttctccctttttaagcatagaggatttctgatatatctgtctggaaatgtcattatgttcctaggtttttttgcccccattatattcttggctccatatgctaaagaccaaggaattgatgagtactcggcagcttttctgctatctgttatggctttcgttgatatgtttgctaggccttctgtaggattaattgcaaactccaaatatattcgacctcgaattcagtacttcttcagttttgcaatcatgttcaatggagtgtgtcacctcttgtgcccactggcacaggactacacaagcctggtattatatgctgtattttttggccttggatttgggagtgttagcagtgttctctttgaaactctcatggacctcgtgggtgcaccaagattttccagtgccgtcggacttgtcacaattgtggagtgtggcccagttcttcttggccctcctcttgcaggtaagaacatttttcatcaaggaaaatgtaaagcataaaattaatatccattaacggagactttatatacagatgtttaaatgtgttttataataatactaatagcctgaaggaatatgggcaggttaattttaggttttattataaactttaaaatttcataattagtcaattttagaactaaatttgtttcagaacctggacctgtgaacttaagaacttatgttagactgataattagtaacataatcttcaggatttttatctacttcagttgttttggtctcttaaaaatatatcagaaaaaaatgctattttatctttatcattggtgaacagatctctcgtctgtttatattgaaatgagccaaaattgtaaaatattctctcaaaaggtcagaatctattttttagttgagtacattggatatattaatttgaaatttgttacatgctgagaaaatacatttataatatcactgataagaatatattcatgtatctattccatatagagaaagacagggatgaccgaaaatttattcacagtttttttgagggccactcatgttccatgtttataaattggaaagattaccttcagattttaagatctgaaatattttcaaagatgccaataaaagtgtctgtgctaaattattcagtaaaaagatgcagtacatgtttagagcatgaccaaagaataccctcacaaattgagaagctggtctaatacttgagagagagagagagaaatagataaaatgtacattacagaagcattagatttttgttggaattgcttgtggttattttatagtttccttctgaattacagtggtgaatgcttttagaagtaaattatgccttctgaacttatggtttaaagacatgtatcagagcattttgaagttaaaactttgtttagtcttagactttaaatgttataaatattacattctgtttgtgcaccagcctttgccagcaaccaatgtatattgttttggttaataccggacttaagtattcacttagactcttggcctgctctctcatggtcagagtcattgccaggctaaatgtaaatttttccattatttagtcagtttttaaactgttttctacatgacatcaaggaaccattctgaaagtgtgaaaagttatgtttaatttgttaattttaatgacatcattgaccttttgtctcttcatttttttttcacttggttaggaatgtatcagtcggctctaagacctaggtggtgtggttgttgtctttctctgtccaccagggctatcctatggtatctagcacaggtgttttaggtggtatatctctcaatataaatataccatgacatcaaaacaattgtcaaaagagagtgaaagccagtaggtcttgttatttatcaggcagttgattttgttacataagataagcacaattggtccttcttttcatacggaattagtttgatcaactgagttttagagcctattcttatccacacaattcttagtgtaaacagagaagttaccatgcatgaggggatgaaaaaagaatcaagtccaaatacatagtggggatagactctaagaattaaaataaaggaatcttatttggccactcccacctgagcagataatgtgcattaatatttttaaaaaacagtttcaatatttttgaatgcttattgtgttaacattgccaaaccatgtgccactggcagcaaatggcaataattgattttagacctattgttgaaactctcagactgtagccattatatatccattttttcattccatgtctgccatctgctacccgtaatatttcttgacttttagattggcttcttctctatagtatttgattatcgctagaactgctggcccatagtaggcactgagttaatatttttgaatgattgaatattattgctgttacgtcttacatagttgcagcacagcagtgaaaagtagggagtgtgtggtttctatttcatatttgtttttttcagactgaactttcactgctcctctcagaaagaattgaagctttagttctggaaagcatatctggtttcttgatgatgctaaaaaattcttttttttttcttattagaggtattaggctaattattatttaatccttaaaatatttcttttattattttttattttattattattagactttaagttttagggtatatgtgcacaatgtgcaggttagttacatatgtatgcatgtgccatgctggtgtgctgtacccattaactcgtcatttagcattaggtatatctcctaaagctatccctccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccagtttcatccatgtccctacagaggacatgaactcatcattttttatggctgcatagtattccatggtgtatatgtgccccattttcttaatccaatctatcattgttggacatttgggttggttccaagtctttgctattgtgaatagtgccgcaataaaaaattcttaaaacatttagaaagtatgctgatgtggcagcccaaagtggtattaactctgatgggccatggacctaatgcttttatatttagaagtataataatcattgtagaaatagaaatatttgactcaagttaagaaggcaaattaaaattatgccatttttgttatgtttatgactatgtcatgcttacttaaataaacccattataccatctacctgattaaaacagaaaattttgtttaaataggtaatatattacaagtagccaaatttaatgttgagccactgactagattctagggagaatgctatggattctgactaaacagactggtttgaaagttgtatatcagaatcacttggaatgcatatgctaatttatatagatttgtatacactaaattttgctgctgttaataattacgaagaattagatgcctgcataagcaagagacaaaactaaatataagctgacaaaattttaaaagtcaattaaccttcatattaaatggcaccaggctagattttaaatggtctcaataatcaagtggaatagtttttttactgattagtttcaccttaataatttagactcagataaagtgaaaaactaggattagctcaaatagtgacatggcacttaaacaacaggttaggtgaagccattctgcagagtagttaagaatgagtacagacagacctcagttaagagtctagattctaccactaactagctacataaccatgcccagattacttcacagtactccttgtaaggatcaagtgagctattacagataaaattcttaggctagtatggggcatagagaaagcacttagtaaatattagacactgttaggaaccatgtaaaagcctttgggtttctcctaaagaaagtaatttttctctattgaagagaaaaggaagcatggaaagggtgaagcaatcctaacgtgtgctgtaaatagagatatctatattcacatgtatagatataaaaatatacctcactcatgtatgtattaatatatacacacaaaaaatgcctagtttgtcttgtttgtatattttactgagagaaataatttttagtaaatttaatgtactagtaatataatactgtaagtgtctctgcatacctttactaagcatatgtagaagtcataatctagatttttttatttttaaagtcttatttgacattaatttaaataagaggaatatactttgaagaataatttatttgaatttttatcattatatgactgttttattatgccaacttaaaagatgttctttgtcttctaggtaaattggtggatttaactggagaatataaatacatgtacatgtcctgtggggctattgtggtagcagcaagcgtgtggctgctcattggcaatgctatcaactatagattgcttgcaaaggaaaggaaggaggaaaatgcaaggcagaagaccagagaatctgaacccttgagcaaatctaaacattcggaagatgttaacgtcaaagtttcaaatgcacagagtgtaacctcagaaagagaaactaacatttaacaagaatcacatctctgatttcagtgtttatgactttatctaggagtttgtttttcattttgtttttttaaagtattagaaaaggttttagctgaaatgaggagtcacaattaaggatggaggtgatattttcctcaatggcaaattttaaattagtttttaaaaacttacttatttgggtagttaaattttgagattatgcatagaaagaatccatgctataggtttatttccatacctgactctgggtgtggtggttaaaatactaattttaaagtcttccagtgactttcggtcttggttatatggagaattctgaatcccaaacccctggtttaagtaggtagaaggaggatgcctaatcctacaaagtgaccctttatacatttcattttttatttgatattaaagtatgagatagagttgagagacaattaattatcccctcttacacacaaacacacatactcccacatacttacccacatgtacacagagtatctggagaataaaacccaaattcaaaaaaaaaaatgataatttatttttaaggtaaaaataatccatgaagataaaagaaacatatgtctgcgtgctactttacaatgttggttttaaagataagcacatgggtaaaaatgagggtgatccttattcaaaaataacatctgactactataaaaatatttgcatatataagtttgacaaagaaaagaaaatcaatgttaaaccattaaatctgagcactgttagacttgattaatccatgcacatgattttttttgagtagggagcattagtacctggtgctagagaatagaaccctcaaataatttttagaattcttacctaatatgtaaaagtctgcatgactcttaacaatgagtcacatccattgattttacagggattttagttcgtaatccagaaagtaataatcagggattttattttaatcaggcatcaatccagattcactgttatactgaaatatcaaagtaaaatcctagttggcaggattgtaagtagaccgaattctaatttttcccaacacatagtggtaattggaggttactgttatgaatactccatctgactacgactaagagagtgaggggtggttttaatgaaccctctaagctctctcagttccttcccttccacaaaatgcaagagcaaaagcaaactacaaacaggccttgtgctcaaccactggaaatgcctcctgggataagaatggcagcacttgaaaattctgccctctactgatgagacttcctgctgcctttggacataactaagccaggaaactttaaaagccttctagaaatagaggcactgtatgacttgcaatcgtaggtatagtttataacctgatagcaaaaaacttgaaatattgcagcccagtttaattcagcactttcccattttcataactatgtgaaaacatctgggaatttgaatcactcctgaatacagaggcatattctttttaaactataaataccattttgagtgagaaagtacttttaaacaagaaagaaattgtacattatgactaaagttataaatacaatatttatatctataaatctgaagtttaacatgattaatttaaaaagtatttagtgcttgacaaagtagtgtcactcttaagatgtcaaagggaattagccattttttttattgtaataaaggcaggtgctatttttttctggtgagattgcacctggataccaggcttttgtaatagttaacattaaacatttgattcataaagttaattcactgcttaagcatgtggctcatatttaggaagctatataaaattcagtttttcatttaacatttgctcttttgcatatgaagagatatttgtatttttcaaatgttaagtaaaacaagatgtgccaatatcataggtaaataaattagggaaaatgtgggactttatggctgtttttaatttagtttcacccgatcttgattcttgaattagctatgtttatatttttagttcttttttattcaactcagatttgtcaagaaatgtaacctctaaattgtgtagtacctctccaatcataaattttcaaaaaaaaattctactttccaaaaagtgtcttgaattctctgaaaaggcacattaaactaatatgaacatcagataccagggggaaataaatggcaaagtaataatcatgaggttttaggtcaaagactacattatatatattttttattaccttctagtagagacatcctcctgggtgcatttcagtggccttctccagggaggaggtttatttacttactgatgagtttctcgtcacgtcaaaaccagttcacatttgtctggctgctctttggttgtcttcattcgttatttatttctaacactgtattaaattgttagaaaagaaagtaaaacttgcacattcaaagcacatgatttgtacagtcacacctggcagtagcactgcacagttacaaatatgcacacacgttaactgctatgcataa

SEQ ID NO: 12415 - DNA, 363032 bp, Human
  misc_feature (1)...(363032): n = A,T,C or G
atcctgggggaaaggatgtattagttccattcacttctttgatcaatatcttagtaatataaaggaagtagcattcgtttttgaaaattacttgaattaggagttttctagttagatttcatttcaataaggaattattgttgaatataaattagatttgccaaatgcttaagctgccctggaatgaactttagtaccagcctgctgtcctggactaaatgatatgaccatactgtagggccaatgtatactatttaatgtcttcatctacttaattatcagttgccccctggtttccttaaagagctaatgatgcccaactatttctagtgagagcactttgctactgagagagtcaaacaccaaggtgattctctgaacacattatctgtgtgtgctaggtacaacagctaggaagaggtaagatgatggtgagttacttaaagctcttaagaaatgaccctagtagaatatccataggggttaagagatgaaatttatttcttggcttagcattttggaagaaatcacttggcatttgtcattggcaagataaaaagaagctctgatttctgttctccagaagatgtacttggcttcttcctttctcttaatttacccctatggctctcattttgcctcagaatgtgaaagaataggcttactactttgcatttagttaatttggtgagttcactgtactctcatctctgggctattaaatagttcaaaaataaatatcgcatcacttgtggaatatgtagcatggatctcatttgagctgtgttttaaaacaaatggtaattatttaacatttacatcatacttggaaagtatttcagaatagaactttttaataataagtagtcaagcacataactgggatcaatgggcaagagaaaaataaaattttaatgttccattgaaaggtgtaggctcaggaagagagaaaaatacttatgtgtattttgtatactcatgtgtatttgggacaaacacaggttgtggacgacaggattgaaagtcagattaactggatcaaaattcaggctgcgtactgagccagtctaagatttcaccgaaatctgggagctgctcccactccctggacttttgtgcaaagactggaggaagctgtgaacagcctgggctaggagaacattccccctctgggaggagaggctcgcatgagctcatggggctttccaccgcagacccagccttggcagccacaaagtgtccagcagtgaaacctggcccttcagttctcaagggccctttggaacatatttgactctaagcagaggtcactattccaagagtgactcatgtcttggggttaagtggagatgatgggtgggatccatgaacagatccagctcttcccaatgtggggggcaccagagtgcatagcttgggagggttggtcatccgaagagtcactgcgtgggtgcatcccgggcaaaaaggatgagaaggtgatccactggcttccataccctgggaaaggtgtcagaccgtgaggtcacatcaaaaggtatgagtgtgggtacctccttccctcccccgacggtgggggcctcatctctcggccatatcacctctgtgccttgcacacttcctggctcagactcagccctgtccacgttctcttccaccatctgatctgcccccatctcccaaagactacttgtggggactagggaggtttaggggtgtagtcaagccagatgcaccgaggttgctgcggtgggaagagggcgctgggagggaggaggacctggggcgcagccgtggtgggtgcgccctgccaagaagggcgggggcgacggggcgcgcacgcggaggaggaggaggaggagggagacgggagggcgtgtgagcgagtgagacaagaaaagggagcgcgcccgccgccgccgccgccgccgccctcctctggagagagaggctggagtgaggctgtgcgaagcgccgcatttcaatgaggacgggccgaggcacatccctgcactagtggccgcaaccgaggcgccgcgctccagcagctgctgccgcccagcccggccccgccgccgccccccagccctgcagccccgcagccccggccgcgcccagcccggcgaggacagcaccaggaggcggcccccagcgcggccacaaagacccccggcggcgtctctccgcggaccggtgcgtggtttgccttccctggggacgggagctgcggggagggcggccgggggactccgcagagcccgctccgcccgcagccgcggggcgccgagggcagggcgggcgctcagcttggccccgccgccccgcccgcagttcctcgaaaggcggccgccctgccctggccagcctggcccgacccgggggcgttgcgtgcgggcggccccggggctgctggcacctgcctcttttgtttggtgccatggggctttaaacctggagtcaggcgagcgggccctcccaggcttttcgcgttgttagtggagatggagagccagggcggaggagctgggagaggtgcttgtcattgtcagaactggctgcggagcgggaaccaaggaaggagtggccgggcccggcctcttattgtgtgtgtgcttttccgtgtgcccgggccagtgatgtgtgcttgtggatggggtcgattcgtgcgtggtggtggctgcagcgtgggtgttgcaagtacgtttgcagggtctcaagttccttcagggacagcgaggctgcctcatgttcaaattagtacctgcagtgctaaaagcttgcggagaggaaatggcattttttcctcctagtgggagcgcacgcacagccccgcaatgccccacaaaagaggctgcttttgaaaaccaggtttgcgcggaattgctcctggatttggcaaggagatgcttggtcggtgagagagaagatgaaaggtttcattcaaaccggctccctctctgctgcacctgtgagtgtgtccaggcacggtgcacacacgttcagcgaccacactgcaggctgttccgtgaatacattttatgactgttcctaaatatattgcctttcagtgggaaaggaaagtaggacagcgttttaagtatgaaatgtcacatggatgcaggtcagaagggattttttaagagaggtcatatagaggaaaattataaaagatatgcacacaccctgtgatgtctacgtccgtggtggtgcacgggcctggaaggtatgtgtgcgttttatttcatgccagtccacctgaatcctaatcccacggttaaaatatgccttgggacttccaggtccagcatctatttagatgtggtagcatttatgccatttttttcttggtatatatgtgtgtaaatttctgaaacaagaaccatgtgctcatctagagaaggatgaacatagattcctcaaaatggtgagaaatcccaccgagaacaatcagggatgttggtttcttgaaatggcaggatttataggaaaagctctgatgagagccagtggcccttcttacctccagtgtctgtggtcgctgtggctgaggtgctgtggttaccatcctggtgccactgcacatgtgcactcaggcccttggccacctatggtctctgaacattgagctgtgtgttctcgcagccttcctgtgcagaaagtgtaaacctgtggaaggccagtggatcttcagaagctcatgcatggttcaaatgtatgactaagccaaggtgagggaaagaacacctattttgttgccacgaataattaccagcacactagggtgtggagtgtgctccatttagaggtagctgtagccttgaaaatgatttcactctgagtatggtttcttttgtcgacaccattgcccacttttggacagattcagggaagggaagtaaaaggtgtagccctgccctggatgaacctgtgatccagtttgaggaaatatgcaaataaaatgaaacaaagtaaaccttttttctattttaaattgttcttttcttcttttttcatctggtgtgggaattcttggtcctaaaagcccgttcccccagggaattctaactattgccaaattatttggcctttgccaattgtcagtcactgagaattcgatgtgcactctttctggtaacagaactgtgccatccttccctatggccctgcttgttttcttttagtttatatcaatttggaaggaaatccccaaactcctagtgttgggagaatgatcactgcctttaagaataaaacacaaacttcaaaagtgagtttggcctttataatttacaaaatgttgaagaacttagtgagttggtgtgagtactgggagtgtcttccactccacccccaagacacactcccttttagaagacaagagagctcactttaaaaccatataaattaaaaagtaagagcagttaccaatatcctggacaaaaattggttctgtttaacaactaatgcctacaggactggatatcaagggatcattgttttaaagttatctaacatcaaaatcaatgaaaccagttcagagctgcctatatataactgtttttgaaaaatgcaaattctgactactatgagttattaagaggcaagaaatagttttcatatttggagggaaaaaagtacactgaactcattaacactccaggtttaaatcacacttcatttctccctccccagaccttcagtggggtcagcaatagacccataagcaggtagatagaatcaccaacatcagaggcctgctgaccactgcttcctctgtgtgcagacgaggtctggatcagttatgtggcctgtccaaggtcactgagctagttaggagtgagggcttacaaaatcctgcttctcatgctgaagaggaaccagtttcaaaggagcaagggatggaaaacaccagctttggagttacagtaaatctgggttcaaatctcaacccctcagttataattttgggaccctggataaattccatattcacctgaatattaataatattacctaccttgttggattaatatgaggtttagaagagaatttttagcatattatacaactggttgatgagtaatagtgtcaggtacctcctagaccttcagtaaatattgctttctttcacttcatttctggagtaccaaatctctagtcatgctttcaggtgtgaaattttagccactctgaatggatcagaggtcagtttactgagggccaaagaaaggttggggagacagtggtgcattggtgagtgttcactgaccttcagaaaggtgatgtccatctaatatggtgggacttggggagtgcttgtaaggttcttgctccaaattttccattttcctgatattctatttcaacatgcctgaaattttgtcattaaagtgtctttcctttgaatgctttggtctttccactttctagattgtcttgttaaaccacagattcccctgcaaggctccacaaacctttatcaaccaacccctcagcaaggatgaactggtcctccagtcagcttgctgtggggaccagggggtacagatgtacctttcaaaaggtcatgagatggagatcaggaagaaagcaggggcctctcttgccagaaaggaaagattctattcctgctagctctttatgtgtcagggccaggaacacaaaaacagattttattaataaaaaaattagtacttatcacatgtcagacactatgataagaacttcatgtgcatgaatttatttaatagttaatactgactgtgaggtaggtactgttctcattcccattttgtggttgaggaaatcaaggcttaaagatgctgagcaagtagatttttcaagcttacacagctagcatggggtcaagtgtaaatcgacatctttaagcctcaatttcttcaatcacaaagatagtcttaatgaaaggaagaaccaagaaatgtacttccaaacattttttcctttcttgttgttcctcttccttctcctccttctcttcctttttcttctttttttaaactcaacttttctgaagtactaaatataagtaaatgaagtatagtgaatttgcttttaaaaatattgaatgtgtgaatatgttggaaaatcttctttaagttggtccaacctacagattgatttaatttgctctccatctggccatggggcacacaaacattatgtaaaacttttacaatctgactgttatgctgcctgccctctctttctgtcccagcccaccatagctacttctctttcactgtatgatgatatgagagcttattttcttcctgctaccaggattagccctctgccctgcaaggagcagtgggctttggagtcagggaaacctggaacagagttgctggtacaagcatttctcaactgtattacttggagcaatttaggggaaatttttctgtgcctcagtttcttcttttgtaaggaaggacaatactttggaaagttgttgtgtctattgggaataatatctgtttgaagcctgatgaaccatgggcaacctaggagctgcttctaacaaatttgtggctgattaataagctgtttccactgggatcggcctcttctgctgacagcgtgcagaggagcctgtgtttattttgtgggaattcacatccctttctctttctgtcccacttgataactcatattaaatgtgtcatcagttaaagcaatatttccacccagctgttctgaagcagaccctttgaaatcatgatctcaaaataacatcatccccaaactttgggaggccaaaggggttggggggcgggggaggatcacttgaggccagggattcaagaccagccaggacaataaaacaagaccctcatcactactactaaaaacaagcaaatgaacaaaaaatgaaggaaattaaccaggcgtggtgcaggcacctgtaacctgtagtagtcccggatactctgggagattgatgcaggaggatcatttgagcccaggagtgtgaggcttcagtgagtacttcagtgagtgccatctcactgcagcccggtgacagagcaggaccctgtccctaacataaaaaaaacaaaaacaaaaaaatatatatatatatataacctacatcaatatgtgtgtctgcttttgtttctggggctcgtaggtcctacttgaagtccatcatgtccttcggcagagacatggagctggagcacttcgacgagcgggataaggcgcagagatacagccgagggtcgcgggtgaacggcctgccgagcccgacgcacagcgcccactgcagcttctaccgcacccgcacgctgcagacgctcagctccgagaagaaggccaagaaagttcgtttctatcgaaacggagatcgatacttcaaagggattgtgtatgccatctccccagaccggttccgatcttttgaggccctgctggctgatttgacccgaactctgtcggataacgtgaatttgccccagggagtgagaacaatctacaccattgatgggctcaagaagatttccagcctggaccaactggtggaaggtgagcgctgtgagataacccccacgtgaccctacaggttccaggctcagatttccagtgttgtagccgattcgcatttgccctctgacagttgacattcagccttatggctgtgatccttatagtttcagacatacgaatgtgctattgtgtagagtaaaaaggaaaaaaaattaatggtattgtcaggtagcttataataatgtgctaagggaaaaagtccctaattctacagcattctctattttctttctcatacccatgctgcattaattttaaaagtccattttatctcttcaatctcatagtttatattcgtttctaaatgcaaattaaacttttgctatcacgatatccgaaagtacttgaattgaaaatgacaaatggatcatgaaattttagagttgaaaggaaccttagatagctatcaaacccattaattttatctttggagtctaaggaccagaaaattcaaatgacatgtcggtggttacgtggtaagatagtgatgaccctggaccaaaacaggttttctgacagctcgttccactgcgatgcttccttttgagtttaaaggattattgtctttctctgatttttgaggatatgcagggactaatctgttcagtttaattttttaagtccaatttaggttaatagtcattatctgttttagacatttaatgtggaaataggactgtttgcgtccacggatgcagcctggtatcttatgcaagcagagaaggtcaccgactctgggctacacttgcctcaggactgaccctgtttgaacagggcataaagcctgtcattgccttagaaatcatcgccaattaaaatgagttggagaaaaaagactgggattaaatgtataccaaggtgcaaaaaaagctagcagatcctttttggagggttgatttttctgaaattgagatctcaaggccctgatgatgaagaagtagatggcacaaaagaatctgggaaagggaggttggatggagtgttggaagagcttgatttcaccttgagttcatttttactccagaactatttgctcaggccgtgtaactcaactgggtccaggagggatgccatataatccctccctctcttgtgcaggtagcaggaagcacccgttgcagccccgttggagttgggggctgctctcccctgaccgcacactgacagagccctcttgtcctgctttgtaaccagtgtatgtatgtgattcaaggctggggacttctccctttttgcttcccttcatcccttggcagaaatgccagcctgatcacagtgtgactggccttgagagcgtgcagaggagcctgtgtttattttgtgggaattcacatcccttttcggtgacttgacatgctgccaacatgcctgtggacttggcctttttccttctattcagagggtggaacttccagtaaattaaaggagaagaattaacatgaaattttactgtttcagctttaatttctgtgccctgtcctttgcatgacctttggaaatccaaggttaaatgaaacatttggtggtatagtctaggggatctggataaaagttatacgcaaagtcaggtgcatgaccagtcaacaagccgtccctctgagggccggtagtactgtagggaaaaatatggcaagatctcaaagcacatcctaagacagccatgggttgacacctcactctgttccagagtcacttgtgtagcatctatgggggttggggtacttcaatcagtttcccacccagaaatgatctttacttagaagtggccgaagatactccaatgactcccatccaccaaggagagggtctgggaggtggtagatgacagtactcccttcacatctagggaccagcaaaattatggcatgcttgtcaccatcttctttgtcttttactgcaaaataatgctttctctgagggactgatgtcttgactgaaggtaataatgatagctctcagttattgagcatgtgccaggcactggccaaatccctgcatatatgaatacatttaattctcacaatgatcctaggaggtgggaactgttatccttatattaaggtgagaaaaggaaggtacagtgtggttaaatgatctgctcaaactcacaaagaaagaaatggtagagttaggatttgaacccaggaaggctagtgccaaagcttgagctcataactacctctaagatgctgtgtgctatgaattcaactactatattgagtttttcccctcaatcaatgtgaagtaactgccgactgaatattctgatgtttaaaaatgacttttttgggaaaaaaaaattatctgattgaatgaatggtaactttggtacagtgtgtgagttcaccatgttggctgcatttattttttgaattttcatttaaacagattttttttctaattcataacactgacaattagcatgcagctgcacttagtgtttaaatagctggaaattcatttagattcgcctctttgtcaattacattttttgcttagtctgttaaaatgcaaaccgttggttcatattcatcattaggctcatatctctgactttacatactaattttatgtaaacgtcagtgcatgttattagcttttcatttccccttccaatatgatgatgtttgagttttaaattaaatccttttagtgggtgcagtggcaagtgtattggacttatagttattttcttgctctttctcacttgctctcagactaaaaattctgaattacaatatttgtgaatttctttatctatgacagtcttgtggtcactgtcactgttttgtttttatctatggattattatgcctaagtgtggtttaagcatgttggtagagctagctgtatgtatttagctgagccaaaatcatatagtcagtgtgaatgtgtgtgtctatgattgtatgtgtgtcacctatgcacatatgtatgtatatacacacatattcacacacatacacttaagagcattccaaaggtgacactcttgtttgctttcaaaatggccttaatatgtttttttaaaaaaatcatgatgcttaataaggaaagttgaattgcaggcctatttccgcaagtgattcatcttgagacttggcctcatttcccccaattttgcaccatctatattctactgtaggtaggtaaatgttgtgatgataaataaaggtgtcacatttaaagcctttgaactcttaggagaaagatgtaatgtaaacctggagcattgatggattgactgatttgtccttcttttaacatcttatgaaaatgtacatgtgagagggccagaacattttctttaaacattaagataaaaactctgtagatatgtaatcttctggatacaagtaagtgaatttgttcatcagatctgcgctattagagatgagtccctcttcttctttggttctcatgtatgccttggcttttcactaaccctgtatggacgttgcctgactctggagctgcagtttgcataagggctttttccaagtttctatcataatccccctctcaggattaaacccatgcttcaccccacagttagggaatctctttcctaccacagcctctgggttacccatcttttcctattccctaatagagcatcctctactttatttccctatttcactggctttctctatgcctctccttgctataatgaattttttaaaattaatttttgaatagatataaaatttgctcttcctaaaattcctcagaggggaccactttactagtttctttttcttttcttttttctttctttaaaaacaaaagcaaaaacaaaaaacagggttttgccatgtttcccaggctggtctcaaactcctgggctcaagccatccacccacctcagcctcccaaaatgctgggatttcaggcgtgaggcactgtgcccagcctactagtttcttgagggtcctctcagagataccagtgcatgtgaaggacacatatacagcaatgcccccttatcctggaaggaaatacgttctatgacacccagtggttgcctgaaactgcaaatagtactgaaccctgtgtatactgtgctttttttcctgtgaatacatacctatgataaaggtatgtatatgatgcaaggtatatgataaagtttaatttataaattaggcatggcaagaaattaacaacaataacaaatacaatggaacaattataacaatatactataataaaagttatgtgaatgtggcgtctctctcaaaacatccttttgtactgtacttgcccttcttgtgatagagatggaagaagcaagatggcgtgagagttcatcacactactcagaactgcatgcagtttaaaactcctgaattgtctctttctggattttttcatgtaatatttttggacctcagttgactgcaggtaactgaaaccatggataaagtggggcagtactgtaatttgcccagaaggtaactttttatgccaacagttctgcaccttgctttgtgtacttaacaatatatcctgaagacctttccatactggtacatccaaaactactgtgttcttttactgacttcatagtactcctttatacaaagttaccatcattaatttaaccagtcttttatcaatatgcttttaggttgtgttcaattatttgttattacagacagttgtgtgatgactatccttggatagatgttttccagtcatgtaggagaatatctttaggataaattcctagaagtaatattgttgggtagagaggtacaagcattaaagttttaagcactatttgcaaaattccccttcataaaagtggattcagtttacactccaaccacttatgtatgaaagtggccgtttctctatcctcaacaagatgttttgaaatcagatgtttcccattaactaacccattaagaaaagaaaactgtatgtcttctcatacagtttttcatataattttcacataattttcatcttttcatgtgtttaaagggcatttgtatttcattttctgtgcattgcctctccatcatttatgatcattttcctatcaggttagggtttttattaacttgtagaattttttttcttttaaatatattaactctttgtaataatgattgagagggcagtcatgtgtcatttaatagtgtggatatgttctgagaaatgtgttgttaggcaattttgccattgtgggaacatcatagagtgtacttacacaaacatagatggtgtagcctcctccacacctaggctatatggtatagcctattgttcctaggctacaaacctgtacagcttgttactgtactaaatactgtagacaattataacacaatggtatttgtgtatctaaacatctctagacatagaaaaggtacaataaaaatatggtgttataatcttataaccaaatattgtggcacatgactctattttttccagatttctctttagtgacttcatttattgtgttttttgccgtgtagatgtacaaaacaattatataatcaaatgtgttattctttatttatagcttgattttcatgcctcttgggtcctttgtacactgagatcataaagccatttttcctcattttcttgtggtatgtttatgttttcacttaaaaaatattttaatggaagtcatattgttataatatgtgagacagggattcagtttaaccttttcttcccccaggctatttgcttcatttctttaacattatattttcagattaatttggacttatacaagtatcacagagataggaagttcctgtttacccttcacccatcttcctgtaatggaacagcacacacaatcatggtgcaatgaacaaaactaagaagttaactttggtacaatacagtagttgaactacaggcctcatttggctttccttcgtttccccactgatatccttttttcattccagaatcacacattgcatttagttgttgtgtctgcttctccttgaagctatgacggttcttcagtcttttcttatctttaatgaccttgacagtttgaagaataccagtcagttatcttgtagaatgtcccacagtttgggtttgtctgatgattagattgatgttatgcacagaagtcatgttttgtcctcagtacatcatttcagggggtacatgatgttgatatgtcttgttggttacctgtgatcatttggtgaaggcagtgtctgtcaggtatattcactctaaagttataattttcccctttgtaactaatatttcgggaagaaactttgatgctgtgtaaatatcttgtttctccttaagcttttgcccatgaattttggcatttattggtggatcttgcctatagcagttattactatagtgttctaatggtgattttcttttccctctttactttccaaatttctaaacattactgtcctccattttcctgtctttggatcatccactgtgatctcatcaactgacattattttaaccactcttttaaggcctattactcctaaatcagatctttcttctgcactccaactacctggatatatagaactgtttctcttccttagttctttaaagctcaacatgtataattgtggactcattcttttccattttccagaattcattctttctctcatgttccagctcttattaaatagtgttaccacctgctagggtcctaatgtttgggaccccctcaaaattcacatgtaaaggtattaaggggtagggcttttggtaggtgattagtttatgaggctggagcttttatgaatgggattcattgcttcatgaaagaggcctccaaaaattgccttgccccttcaaccctgtgaagatacaatgaaaaggcaccatctgtgaggaagtggggccctcaccaaacactaaatctgctggtgtcttgatcttggacttcccagcctccagaacagtgagaaataaatgtgtgttgtttataagcctccagttgatggtcttttgttatagcagccaaaggactaagacatcacataacttaacatcacccttaacgtctctctctcttaatctctcaaatccaggctatcatcaaattcggttgattctgctaagacatttctccaacttgttttctcttctccattcctatttctgcttgctggaaatctccaactgattggcttctaggaacttcaaatttaatatgtgcaaagtcaacttaatttccttctttactgcctaatccaaacctgttccccttctaattgtatctattgtggtgtatgggaagtaggcccaaagagaattttcagtgtcatcacttcagtgtttttgttgcctcatattccctcggaacccacatccagtcaattgccaattctggctggttgtatctgctaagtactcctcgtaacatccactcctctgtccctagtgtggatacgtaacattcagttcacctcctctcctggtcggctgtgatgactttctaggtgatatctggacttctctctccccatgttcacttcagcccctcattcacactgcagccagtgcaacctgtttatcacccagggctgatcatgtgtaaaactctgaccttgttgcctgatgtggttttatctaactcgtctgtctatggaatcatttttatttcatttttttttgagaaaatgttttaatatatcagagaatatccctttctgtactgtgcaacagagcatattattattttatttttatctggaatgttctcccctctcttttttgtcaatggtaatcttacccttgcttccaaggccagtgtgaattccatttccctttcatagatagcccagtgggaagtgggaagtgacttctttctcctctgaattaggatggcctagaccacttacttagcaattattacttactgccttgtggtggaatcttttcatagacacatcttgctttctaacctatttgaagatagtctcctgacttaggtttctttcccttcccagagtggctaagttaggtcttgcacctatgactcaggatttaggaggttgtttttaatttttaggtttcattgttaatgttgtgtgtgcttgtcacagttttgttatttgttgttttgttattatgcaaaattttttagcaatgagattatgggtataaacattttcgtggctccaagtagttttccatgttactttttaaaatgattattaccattttaatgtctgtaatggtgttttctatttatactttattgtgtgtttatcctttgtcatatattttagcaccttgtattattttgttgctgcaacctcaataccactttattttgattattcttttgttgcaattataataggtacaagagtacatcttaaatctgctttaacttgcatttcttggcttactatttaagcaccctccatgtgttttccatatattctttgttttgtttttatcctttgccatctatttttgtaccctgtatttttgtaaattataataagccatgcttattataataagaaataagtaaaagagtctctacttttcaatttcaaaaagtttagatctctcattttttttttccttaatgttgtttttctgttgctttggatttgagaaggtgacatgtccacaggtctgacatacacattcaagttcattttctataagcttacttttatgttctattgtgttacggaagacttctgcaaaagaatgacccataagcacctttgggaaatattttttcttgcctttaatagctcaatgaaaatcatcctaagccagtgacttccaggtagattatgaaatgttgctgtgcgtatctgagttgcctcataaaatgtaatatccagaaggtactttacgatattctattctgtaaacaatatttcatgtaatttaattcagttcagttgcagaggtttcaatacatatttgagtttttcctagattttgccataactcacaataatgaaatttaattgccagagtttttaatcagaaagtttatcctctggaaaaatgaaatatattacggatatccttcacttaaggatgcttttgactatgccacatattgatcttaaaggaagcctagaggaggtaacaaccagctctagtaatgtgaaggatggagatgaggtcattttcagactgaagttaagtagtatcagaactggaatttactcttagccaatgaaaaaactcccacaataagaggcaaatttgtagaatcccccaatatagagtctcgtggaggaacacttttatagctgacacactgcaggcccagtcacccagggaacaggtaccacattgtcagttttcagtagtgcccagggaaccattttaagtggaaatattctaatttcataatggaagcgaatggcaaagtagaattaacttcacagatttttaaaataataaatcttattagaggaaatgtattgttatgctttgaagaataatggccagtatgatcatttaaaaatacaggccagtcgcggtggctcacgcctataatcccagcactttgggaggctgaggtgggcggatcacttgagggcaggagtttgaggccaggagggccaacatgatgaaatcctgtctctactaaaaatataaaaattcactgggtgtggtggtgcatgcctgtaatcccagctactcaggaggctgaggcaggagaattgcttggactcaggaggcagaggttgcagtgagctgagatcacaccactgcactccagcctgggtgacagagtgagactctgtctcaaaaacataaaaaatgaaacataaaaataaaaatacataggtgattttttacacaggaactcttcagtatcttaaaaataatctagtatgcttacttagatattatttcatcctccaactttctgaaaatactaaaatctttcaggaaagaaattaccatattctgacattttagtattagttggatccaaacataatttcatgcttatttccttacttttaaaaaaactgtcattttctttatctctctctctacttaaaaacaaagattagtttttggccttcattaaatgccacaacaaaattcagccagatgctgcttcagcatcttgctatttgttggagtgtcttagacacccagagtattacatttcaagtgaagaatcagacttatcatagaatccttagggcttgaacaaactgaaaaaacaaacaaacaaacaagaaaaactggttgtatgataaccaaccagaaaatcatgatgtttgcaatttctagtaccaccgctaagagctttgcaatcatgccatccttgttcaagttcacctataggaagtaatgcaaagcttccaaagcaaattttgggctgttttgctcaaaaataccttgtgtttttttatttgtttgtttgtttgtttaagataaattcacttttatttcattgttgcagtagaagttataccaaaagacttcggggtgtggggtggcttagtgtatgtaagaggaagtatactacagtaattgtaagcttactttatcttgttattttgtttgttttttcgtttgttttttaaataaagagagatgggatctcgctttgttgcccaggctggagtgcagtagcacaatcatggctcactgcagcctcatccacccaggctcaagtgattctcccacctcagccccccaagtagctgggactacatatgtgagccaccatgattggccctgtcttgttatttttaaatggcacttaacacacatacctcatgtcaatacttgaatgcactctaaaaatgattattttaacaagattataacttatctcttaactctcagtcacactaaggaagagattgaacactggatatctagagctacttgaccaaatcaaaactatgtattcttcccattcagaacaatcacgtttgttaatttataataatcgatgataattagcccatgaattgaaaagctattttttacaaaatcagaaaatacaaccaactttaatttaactgcattaaggcgggaaccacatctcttgtggcagagagaagttcagtgttatgattactgtaaaaatagttaatacatagatttaaaaagatttaatggaaatttcttttcatgataaaatggaaatgtattagcataaggaaatcaatggaaatttattagcataaggaaatccatctgggcctttcctgaattcctgaatagtgtcacagactctaaatgactgtggtgtgtgatcttggatttggtggcagctccttctccttcctttagctgttgctttcctgttagcacagtatcatctgttactggagtctcacatccttctctaagattctcattccagtctttaaatctgattatccagcagaggagcctcacatttacagctcagattaaacacatatttcttctgatcattgttgcttgaaccaaaccagcaacgccttctcagtgtaactggagaactttcttatgcttttaaacattttcagggtgctttatctaagaagatatttttaaaaagtgtttattttctcttttaacaaactcactccatgttgctatgttctttaaaactgctccctcttctaatttaatatatttttaaagtttttgttgaaatgtaaactgctctctgtatctttgttttgcttttagttattagcttagtatagaaacttataaataatcagacaattgcatatcttcagttagcacagaattctgacagaggctagctttgccagctcagttacatgctgtgtgtctcactggggagtgttagggcattctcacattgacatggacccaacgtggtgtccactggtaactgttcaatataagacctgcttaccgatttctagtaattttgtttttgaatttttctttcaggcttactgcacgattagggtatgtagcctcaggtcattttcactcacatagcaggtttgtatttgagatcactttgatctctatcttctaatttgatcttcagaaaaacctaatgaggttttgttttatagataaataaactaccacccagaaatctgagggacttgtccaaagtcacatgcttggagaggccaggtcttgagcccgaatttccagttctctcttcccactatcatgtgcaggtcatcactccatgaaaactcccaaaacactgctgtttctatagtacccaaatatgcctttctcaggatttaagaaaatatcaaaaatacatataagtttttgatatttacttaaatcctgaggaaggcatagctgagacaagtcatgatctgccaggtgaatagaaatggggttggttaaacttgcactattcatacaacttctagtgaggcataatgtgtatgtatacacattagagaatattttaagaacatctgcaaaacaagtgttcagtaacatgtataactgctctttttaacttttgaaggcctgcttcagttatttttatgtgactacttattctttggccttggatgcttgcactgtgaatttaaaaataatacaaggacttagataaaagtcaatgggctgtgttagattaggcctcggtcattttacctacaattatgaaggtctttcagcatttttacctattcctagttacaaaaacttattaacacagaaaaaaagccattacaaaatctttaatttcaaaaggctttgacctaactttatgaaatatgtatttagaattcgtcattttacaatttgttgtctcttggttcatgtttttcttttttgtgtgtgtgatctacatctacttaatagtctgattattttcattaaaagatttcctgctaaggagtcacttttaataaacatttacttatatttattttagagcccatttttgaagctgtagtttgtatgttgaacacttctaaaacctcttacttatgaacaagtatgaattgaccttatagtatgtgtggatcactgtgattggcactatatagatgagagaaaggaagggtgattatttgcttgcttttggaactttactgggctttacaaaatctttagcatcaactctcatcaaattcgtaaattatatgactattttaagatgctgtattctgattcattcttagtgtttaaattatctcaggtagcaaatggaggtacttccaattttgaaattttctgcagatttaagtatctctaattcccaaagaatattttctattttaaattcactttcacacttctctaaggtcttttcaagtagatcagcatttctatcaccgaccttaagatgaggaaatggaggaataatgttttgttttgtttttccaggatgtggatctgttgctgacagtgccagattagcaatcagaaatctttctttttccctaattattaatcacacttccattgtttgaaaagtcagggctagctcttgcccctaagcagaaaaggcaaaagagaggataagtaggaaaaaagaaatgggcatattttagtataaatttaaatatatttctctcttccttaggagagagttatgtatgtggctccatagagcccttcaagaaactggagtacaccaagaatgtgaaccccaactggtcggtgaacgtcaagaccacctcggcttctcgggcagtgtcttcactggccactgccaaaggaagcccttcagaggtgcgagagaataaggatttcattcggcccaagctggtcaccatcatcagaagtggcgtgaagccacggaaagctgtcaggattctgctgaacaagaaaacggctcattcctttgagcaggtcctcaccgatatcaccgatgccatcaagctggactcgggagtggtgaaacgcctgtacacgttggatgggaaacaggtaagagacatattgtgatgtgactttgactttaaggcaagaaccagggagtcggagggtgtacgtggctaaagcatacattttgctcaagttgttaaagggcctgggtcacttgatcaacaaatatgtacttgctggccctagaacagtcagaagtttgagttgagcaggattattcataggaataaagtaagaaaaaaatgcatatctttgaagattaaataattactcagtgatttctacttgttcatttattatttgcttaacataatgattcttttctgtcatctgttttcagttttctcatagatcttatagcctgaagaatgaatgactgaggtgtgaaagtaaactctgaccagtagggaaaattctaacttatttctttgacctaaatattttatgattttaagtctttgtagtgttcgctagtgagatttacttacattttatagattttaaaatatgtatctaagaaatgacatatttccatctggatagctttaaaggcatatttctagaatagtacgcatcttgtatttttcagtgttaaaatgaaagggaggtttttcagctacagaatgaacatcagttgacttggatgggtggtcattttaatgtgagttggtcagatgaacccaaaggaagcatcaccttttattgtcttgggtggactatttttgtacaggtttgacagaaccttgatggtgagttgaattaaaaaacattgattagggccgggcacggtggctcacgcctgtaatcccagcactttgggaggccgaggcaggcggatcacgaggtcaggagatcgagaccatcctggctaacagggtgaaaccccgtctctactcaaaataaaaaaaaaaaattacctgggtgtggtggtgggcgcctgtagtcccagctactcagggggctgaggcaggagaatggcgtgaacccgggaggcggagcttgcagtgagccgagatcgcaccactgcactccagcctgggtgacagaacaagattccgtctcaaaaaaaaaaaaaaaaaaaaattgattatatgtacagcatgatttgctagtcattcagagtttaccagattatacttttgagcacactatctttgctggaagtttagtttttaatgtggtgctatcaaaatgcttttttaaaaaattttttttgagggataatttgaatgatttgtatgtatagtaaatattaaaattaaaatgatccatgaattaaaagattgatcttattaaatagaagactcctccaagttcttaaaggctagcgcattcaaactttctgaattagaaatagatgctaatcctagaaagagtattagtcatgaaagaatacttcccttagggatccattcagatgctctaaattataaaattcattaggaaagaaggaatatgtgccagttgttcatttgtatttaccatcttttgcttggcttataacccttgccctaagtaatatgcggataaggattctaatggatgagattctctaatgaatgagacttagtcttctatatttaagagtctgtagcctaaatgtcgtaaatctatcaatgaccagaaagttcatgctggcttgtgaattatagtagcaataagatggcaaacttcacctttacacattttgtaagcccttcactggctccatttctaatgagttattcaaacatcttgtagttctgaattttcatatattgaattttctcaagatgggagttcatctattttcataaatatttacctattcaaataaatatttttataaagtgtctcattagagcaaagaatacatatggataaatgttccctctccctgctgcacttcagaattttgggagttccaaaatgctactctgaatctaaaaatcggctttaatgactttagctaaaatttgccatcagctgattatttaattttgtttatttcaggaataaatccctacaataggtatgatgttctcagttgttttcttccttactgaatttgtctagaattaatatttgataatggctagtttactgtggtttacatgtaaataatccaaagtcatgggacggaatccgaggtttaatgtcaaaaaaccaggattcaagtcttggctcagccgtagattccttatgtttttagcaaaacacttaactgagcttcattatcctcatcagtgaaacacagataaaatgattacctgtgttttatagagtgctgtgggtcaactatgatgatacatgcaatagcaattttgaactataatgatgatagctttattgagcattgttcaaagtgctttgcatgtattagcatgcttaatcctcataacaacttgcttattatccccatttaacagattagaacactaaggcacagaactcgttaaaaacatgcacaagaccacacagctacgatttaaactggtcttgctccagagcttgtgctggtaaccactgtaccactttagattatgttaaggcaccaaactgatgtaaatgtattgagaaagaattgtcaagggagtaatttgtccaaagaatatcatctgaaacatttctgctctgtcctttttttccctgcagtcattctgctgactgttgtactcaactgttgttttgtcaagcgttcagtttgctgctgtggcatttcccctagtgttggcatgttctcttcatagcaggatcagtgaaaagctgcagaggaattggatgataaagtggaaagaacataaagacttattcgttgggttcccagtgagaacaaagatgcttcctcatggaccccaggagtctttagaatctttttggctcaaaagagaaatctgtcccataagcagtttgttagagtagaatttttgacaaccctggcagagactgaggcttgataagcctctgagaataaatcagtttcctccacgctgtcctgtggaataacgcttggccatagtggggtggcacctgcactgctaccatcttggcctgcctgtggtggcatcggggtccatatgctgccaacaagatgccaccctaagattacttgtcccacctttttaaaaaatagtttaactgaaccctcacatcaactccataaacaatatgggaattccagtgcccagtaaagaatttcatgtttttgggttgaggaaatagaattgtttaaaaaatgaattgcttgagtgctttgagtaaatgcgtagagaggaagatggttttgtagattgccttggggcagcctacagatgtatccatggcatgaaaactgttgacgctgggattttggacaatggaaccatgaaagccggagcctgctgtttaatatcttacccagaggagacggacaccggagggcacagaccacatgctgttctcacttgtttctaccaccactccttgctcagttgcctctcgggtttgtgttagccctaagcaaagagttcattgaacagtactttttttgatgtttttagactgagataaggaaataaacgttttggaaatgctgcacaatctagaaaagattttgcaggaagctgcaattggccaagatgaccgttgtggttcataagcagcctatgtgtgagcaaaccctttctaatgatttcaactccattctttattcaggggcactgaagcttcagcaaatggttgccccgaccttcctcctcttccttgcaactttcagggtgactgctcaccaggtcatcagtccttttgctggcatggctggcagttcaaggaagcacttaccatgccttaatttcagtgatgcatttttttttttttaaatctgggccttggttaaagacctccaaagaagaaaaagggacattttctagctaacagttaaaatcatgtcccctgaacccatgtccaaggggaggatctgcaggatcttagagtctgagagtctcttcctcttgcccaagtccaagctctggatgttggaactttgctgtgggttattcacttaacctgccaagcagttactcccagaggccatttggagtataactattttttaagtgcttaaaataagactaaaagttaccagatttgctacaaagatacccttgcatatctcctgactccttttatggaaaagcaaatctggctttcttgagctgctaaatctgtggttcttgaatccgtccttagaaacatagaacagctagtgcctaagtaggtgatttatactataaagaacatagatagggcacttcccaatgatccccttcccactgaaatacagcaatgacaaactggattgctctttaagtagaaaataaatgcacatccctatcttatctacttttcaacatcaaagatctgtacaacattgcagcatgctttagtgaagagaaaaaaacccagagatgttatatttttatcttatagacatttcacataggccatgtactttataaaatctaccactgctagtgagtcgagatcgcgccactgcactccagcctgggcgacagagtgagaccccgtctcaaaaaaaaaaaaaaaaaaaaaaaaaatctaccactgctagcatgctagagtgagcaaacaatttattgttttcccaatatggaaaacattaggaattactcagctgaagtatgggtagccataaactgatttcgatggtaagccatgagaaagcatcataactgccattttgaggacatcccagtagctgttgataaattaatccatcattacatcttctctgtatcttttgatcatgaatcctcattgcctgttataaagctcaaaagatgcttgtaaatgagtcaataattgccgccatttattttaggtgtttaatataggagtttacttgattacaggaaatggtaatgatgattaataggaatctattaatcagatatcacaaaatggtctttattttcttctttttggcctttaatatctaattctaatctgaagtaaaaataatttggtcgactcttgggtttagagtgcttaagatatgtcttcctcttacaagttaaaaaagtggtacaaattattattgcatctgaccttggctataggagttgataagcatagaaaatgtggaaactagaggtttccagacaaaatgtaagaaatttagaatctgataggatttatttggaatgggaaaggaggttttctgtagctattagcagcagtggtatttttccttttttattagtagaacttttctgtgacagttctaattaacttctgcaagcatattaaaacccttcattcttggtataaagaatgtgtactattgatttgctacactacctatgtagcaaaagggaatgtaatactttttagttttgtttgcgattggagtaaaaaaacagttgatacaagtaatttagcttacactttaaaatgtcaaattaaaattctctacaaaagctcagagcacatgttaaaccatcctcatgatttattagagctatgaattgatggaaatagatgatttcaaagaaaaagaagtttaagaatcgtaatgacacttcacttacagaattaaagtgttcagaatagaatgtactattttaggtcacatatccttggtcaatatttaggactcatgagctatacctgtccttatgtagatgttagtgcctccaaattgggaagatttaagtccttttttttttcactttgagctcctctgaggatgtgatcaattatgggtacctgcagtgatgtatattttaaggcttagattcattttagcaaaagttagttttctgtaaattgcattctagctcgctgtaaaatgaattctaagttctcttagtgttccactgctgtactgaagataggttttctaaagcccttccatagtgtgctgagagcatttgggggacgtttacaagtctactggctttgtgattgccttctggtggtgagttctcttgcttctatgacagctggagccctgacccggcctgtgagccttttctgtctggcaggagcatgttgggatgatggaaagaacttggactttaaagtcagctggtcagtcagttatccctgcaacaaacaaacaaaaaaattcagctgagcctggactgagatttcagtctggaaaatctagcttgtggtttttcatccaagcctggaaaattaagttagcctacccaacttactgattagttaagtttaaaatttctgtatattgaatttacttataatgaggaaatttgcttatgtatgctataaattaagcatagatatacatgataacatgacagagaggaaaaacattagttccatagaattatagatgagttcaaatctgtcctctactctgggcatagtgaaatttatcctcctattggaaatagttcacaccctgataatcctcagtttcatcatctgtatattgtgaataataataatgataataatgcctgctctataagttgtcatgaggactaaatgaaacaattcacatggcaaatttagcactgtgattggtacccaattgttggtagttgttataatggaaaagctgacacttaacaaattttttttggaaaaaaatcatattttaatgtgccaaagggactcactattttaaattatccttttataatgactaatcatattttcctttgtaaatgtggcttttcacatggaaatgcttcatgatataataaaaagagcatggaattcgaaatgagacacttaactaatacaaagtcaaatcctgacttgaatactcattagtagtgtgacctctggcaaatcagttaaactctctgaatctcaatttcctcttctttaagatggcataataatgcatacctcataatattggggtgataattaattgacaaaatatgtatataaaggccttggcttgacacatggtaggtcctctaaaaatatcagtccttctcccttctgttctcatattccaggctttcttaaaactgtaagacccttgtagttgtataataccatgaatgtagaattggtcattttgcatagtttccattgcaactgatctgctgtacctgaactactaacaactgtatttttatcatcccatttattgtcagtcagttgtgaatgcgatgcagatattttattcactttcttcttcaatggtacaggtcattccttaaaggcatctttctattggcaatccatcccaccgagaaagtaatattattattagtatcatttgttgaataccttctctgtgcctggcattggactcgttgctatatatatttatattgatgattacattgataattgaaggtaatctcactgaaccccagctctgcaaagcaagaacctactcatttctcaagattcagctcaaaggtggccttgtctatgaaatatttcctatcttccccatataaaattgacaactcactctcttggagcctgttcactgtacattgtatgtagccatgcaaatcttcattatgctggtctattgtaatgcctgtctcctcctttcgattttataggatgaggctaagaaaggtgttctattggcctttgagtctccagagcttgacctggtaaatgactgaatgactaagtagctggatgattgaccagtttgctgtggtctatccactcggcattagcatatggctccagtattcagcaaggtccttacgggtcatggccatataggagctgccttggtcaccctgggctgtggtcatgtgtagctgtaaatgatgatggtgccctctgcagcgtggccacacactacattaccatgcacaccgcaccatgatggttgtttctagctagggcttcttcatgaaagactctagtatagaaaataaaaagaacgcatctgccaattttagatcattttcgctattgaaagcactttcattttgtgggggaacaatagatattctgttagaaacatctcgccgtctgagtcaggagaattgctgtaaaccttcctgacattgccttagccatccagtgaataaagagaagaactgatcaatatgtcccatggatataaaaattggtggtgggccaataggagatgcacatgaaaagcatctggcctaattattgcagagacacaaacctgcagtattcaagggtgtctgtggtggcagactataatatgttgcaccagattttcctgattagtttttaaatccttgaaactaaattaaatgaaagaagtctgtttcagaaattaaatggaactttaaaaatccaattttaaataggaactatattgtaaacaacatgccttagaaacaaaaggacagatgggagatttattttttaattggtcttgtcctttgtaagattaatatataatcaatgtaaagaattttgaaggaaatgggaaaatattaagataagttaaaattacccacagtcgcattgagaagatggcccttgctcatatttcggtcttttttcctttgtctttttttttttttttttttaagacaggtgtcttgttctgtctcccaggttggaatgcagtggtgcagtctcagctcagtacaacctctccacctcccaggctcaagtgatttctcctgtctcagcctcccaagtagctgggattacaggcgcgtgccaccacacccagctaatttttgtatttttagtacagacaaggtttcaccatgttggccaggctggtctcgaactcctgacctcaagtgatctgccagcttcagcctcccaaagcgctgggattacaggcgtgagccactgcgcctggccctgtctttttctttaaaaacaaacaaacaaacaacaataacaacaacaacaaaaccccacagatcccactctgtgtgcagtttggctccttgctggcaccttcacatgagtctgcacatttatgtgggaaacgtatcaagccattccctctctaactttgttatttcattgtccagggtcagatcccctgaagccaagtttcccagtgtgctttcctgtcttgtgacttgtctgtagagcctcttttgtctgtcttctgacttacggctgatagtaatcatgttccaaagtcgatcgagaagcaaacagcatgtaaagtagcaattcttgaggtgctattcagtgtaatcagttattggaggttaaaattatctcagactccatctgctttgtctagaatcctcttagaaaaaaagtcacatttttcaaaacgtgtctgattccataagtccagtcttgttttgtacatgccaggtaacaggctttttaggtcaatgggagcacagtcaccatgatctttatgagttcctccctgagggaaaaacacaaggtagttctctttctgtggataatcacttctgctttgccttagaactgtttgtacacctgtgtgagaccaaaatatctgggagaaagaagatagtgctttgttgatttctgtattcacgactaccctcattagatgcttacaatttgttaaatgacatttcttagttttaacttttggctcatcctttaacaagtagattacagggctaggagtgcccctacaagagatctttctattccctttttctctacttggaagaccataaaccaaagttgccttggcagatagtaacataaaattgattttttttattaaaaaaaaaatcttccaggaagaaaataactcaaggtaagcactagcttaaaaaaaaaaaaaaaaagattagactagacattttccttctgatgccttttcagagtgacagtctgggagctagaaactgcttacacaacagaaataagttgtaaagagtcgtgctgtgtgcacaggtgtatgcttcatcagtattcttaaaaacctcactatcggccaggtgcggtggctcatgcctgtaatcccagaattttgggaggctgaggcaggcagatcacttgagatcaggagttcgagaccagcctggccaacacggtgaaaccccatctctaataaaatacaaaaattagctaggtgtggtggtgggtgcctgtaataccagccactcgggaggctgaggcagaagaatcccttgaaacttgaaggcggaggttgcagtgaggctagatggtgccattgcactccagcccagcctgggcgacagagtgagactctgtctcaaaagaaaaaaaaaattaaataaataaaaacctcagtaccaagagtggtcccgggacagcagcagcaaggccaccagggagcaggcagagatgcggaccctcaggctccacacagacctactgagtcagaatgtgatttcaacaagattctcaggctgtgtatattcacatttaagtttcagaagtgctgctcaggagactgaagagtatgaatggaacatcagaattcaaagccctaaagacggcgaaccccggctgttgttgcgtggtagatgcattaaacattagttttagctgatttcgcagttttattagcatcctctcaatgccaatgttgacatcagatggcaagatatgattgccagcagcaattttctggaaagcagccagtgcattagtgtgaaatgtgttctcactgcaatctagcctcagtgggctgcctcacgtggagggtgaatggcttcctgtatggagaataaacgtaggttaaagagtcaggaaggctgaacaaacactgtggaaacacggatcccgaggaagagattaatgccacaaagtgcatgtgcatgctgttagaagttgtctgtatctcccctcaatacgctgcacaaactgaatatgatccctgtgctgcttccgggtgtcttctgtgggaatgaatggaagtcattaactggtcctgagaaccgattttagatcttcaactattatcagatggagtccctacgcatgagacaattcccaacatggacgatgcccggaaagatgtgggctgtttttaaggtgtgcaggaatggaggggtaacttttgaaaataatttccagctataataattttctagacatgcccaaggatttagtggccaacagtcttacgtactgcagacttgactatggaaaacaacaatggatgggataaactggtgtgaaggaaccacctagtgatcagaattagagtgattttcttataacacagcctgggaggttaagagactgagggggtgtcgcctatttaattcagctggcagctggcaggggctgcccatcacttagggcagacagggctttgcaaaaagccatacaatgcccagcgaccccattaacagggccttttttgaatgggaaggtcaattccatttctgaggttatagctctaaattagggaaaaaataataagccctagaaataagtggggtctgtatacaaagaaccagtaaaaggttcgtttctgtcgttggttgatacagtgcccctgggaagagtaaaattactgacatatttctcaggccatttctggaattggtctcctgtgaaaggaatagcgcaggcttattgtattttgtttcctggtaacatcatcatttttgtttgtttgtttgagacaagatctcactctgtcacccaggctagagtacagtggtgtgaccttggctcactgcagcctccacctcctgggcccaagcaattctctgaccacagcctcccaagtagctgggactgcaggtgtccaccaccatgcctggctaattttgtgtgtgtgtggttttttttttttttttttttttttgtagagacagggttttgccctgttgtccaggctggcctcgaacacctggactcaagcaatcctcctgcctcagcctcccaaagtgctgggattacaggtgtgagccaccatgcccggccaatcgttttcttatatagcaaaaattgcttttctctttatttacattgtgtgtcaaattggtagacttagccactgtgtattgagaaaaaaacacatcgattgattaaatccttgctgcatttggcaacagtttataggaaaagggagaatttctgaagatcatgctatgatgcctctgggatacgttcagttggagaaaatctaatctcatgtattattgtattgtacagagtgccaattattgacagtgaccataaaaaacaaagacctgttacaaagcctgttaggtgaacagactattcacggagttgtctttggttttgccaaattggatcaagagtttcacctgggttttattaagatgattgtgctttagctttttaacataaatgtcttttaatgtttaaaatgtgcaagtccttgtagacttgttagatccggaaacatcgattcagcatggattctgtgccaggcattgggaataccttagttttctttcagtgggcagtggaagacttgggagaactcctcacaacagaatcctaagggaagagtcctttcagactcactgcaagtttcattactagagaaacttgcattttcacatttgtatgttcatgggagtatgagatgattgatacagttaatcttatttgaggatgtccttgtactgtttgaaaatgtgactgccgaaacactgtaacattgccttcgtactttaaataactgaaagatgtgttttattttatagttgaattaataacacttctagcacattaagaatccaaataatgctgggcgcggtggctcatgcctgtaatcccagcactttgggaggccgaggcaggctgattgcctgaggtcaggagtttgagaccagcctggccaacgtggtgaaaccccgtctctactaaaaatacaaaaatgagccaggtgtggtggcacgcacctgtaataccagctactcaggaggctgaggcaggagaatcgcttgaacccaggaggcggaggttgcagtgagctttgatcgcgccattgcactccagcctgggcaacaagagcgaaactctctcaaaaaaaaaaaaaaatccaaataatattaaaagcctacttttgtgtaccagcatgctaataaacagatttccattaaaattagtccctgtactctaagcttgtggcatattttagaagcccttaaaataaatactaaatgtcctagccctcagttttatgagcctgcactttcccattaagatgtattgggaatcaggtgtgtaaagttcccattcattttctaccatcagttaacgtgagagggaagttactttcaaaactttacaagattatcaaaatgcacgagaacttgactttggagatgtttacacccacatacctacattttggggcacaagagaaatagaggaagaaccagaggaaatgtggatctattttgaggattggcaactgtgttttctaggtcttaaaattactttttttttgaagacaaaagtgaagctttatgctatgtatttaaataattgcaaatctctctctctcagtgcttctctcacctggaaggaccagtgtgaatgaccccactgtaaatggattctgttcatgtgacttttcgtttgtcctatttgccttataatttggtttgacatcagctgaagaaagtgtgtcagatcagttctgggatagtgcaccagctctgtgccagaaaatgagtgataacaccttgtgtaatgaatcaaaagttggaagacattttctgttacaacagctggaaacattttctccagtttacgtgaagattgctgagtaattggcattccaggaaggtaaaggaccggatctgtccctgggggtgaggctttgtagaaaagaataaaatcatcttgtatgttgaatccagcccagggataatatcaataaatgtagaatagcagctagtgtttcttgaatgtttaccgtatgccaggcactaactaaaatttcgattttttaccccattaacagtattatgggagtagatactattgttatctccatttcacagatgcagaatcagggggaaagtaactggcccaagtgattagtacctggtcaaggcagactgacattcttaaccacagtgtcatatctgacattatatagtgttttccaaatactttaagtatataaaattcatgtgcatctttttttttttggtaagaatgctcacaatttattgctgagctttattggtgtgcctgctggagtttaaaaatacttttcttctgaaattatcaaattcctgtgatttgtcagtctttaaacacattgagattaatatactaccctgttaaaagggttagactgggttgccaaaagacagtaaatgttgagaaagctactgaaatgtcttctttcaatttcttctaagtgtttcttgctattttgattcctatttggattgttaatgattatgaaaataatccatttagagcaattttaaaaacttaagaatcttactttagattattataaaaatttatattcccaatagtggaaaaagaacatttttaatgtaactaacacatcacagagatatacagtacaactattttatagagtgtgaatatcgcaaaatttaaaaacatgtcaactttaaaataaaaaatgattacagctttattaagctataattttcgtactacaaaaagcacccattttaagtatattatttaatgattttaataaatgcatagaatcatgcaaccatcaccacattccagtgttagacactttgaccaagaaagttccttcatctgcatttgcagtcaatctgggctcccacccctagcccagcagccactgatctgcttattagtcacatcagcttttaaatgttgacctcatttttctatctgcttttatagaaaagtctcctttctaccttctaagtcatttgtgtaattatggattcactaagttcatcgcctttaacctgtaactgtagcctccatcctctccagctcggtttgactagctctgggttttattgaggttttataagtaacttattacagaggttatgtagccagtttcagcactgtgagccacttattatctttgcactctttgcacatacggcatttctgagctcactccagacttaggtatccaggagaagaaagctttcatgttcatggcaggatggaataattactgtcttctaagccctagggatgcttccttggggtctattcttctctcctaccttcttggggccccatttggtgacatttgctttgttacagtccaaaataccatttataagctgattaggtttcacatgatattaacatatttcaagctgtgtatatctttttgcatttcatagttaaaatatggcttccatgtgctttgtctgttccttggatgagatccaattatttcataatctctgtcattccctcttcatggtgagtttcccacttgtcctttcatcactttgctattcaagatctttgaggacttttaaaagattacctatttctttcttctcaaggaaagagacttaattgtgcattttaatattctgccgtacagtaaagctgcacctgggggattatgttcactgaaccatcattgaaaatgcctttgtacttcagtgttaagatgctgctggcctttggattccagaaaagattgtgtattcagtgtatacttatcttctttttcttgttcaaggccatctctaaaccaaaaacaaggaccggtctcccctgtgaagcctcttacaagatgggaaagaaaagctggtctctggctgagattcaaaggccttgggcttatatctaggcatagttctgaggttagtgaggaactgagattgcttcccagatttttctccctttctgacctccttcttggtaatctgtctctccaaagaaccaaaggggttttggtggtggttagctacattaaagaaaattacatacaaaaaaccctttcaaaaccaatggaacttgtttatagtttttaaccctctcttttgggggctttattatataggtcttattattaaattgaaattaaataaaatagtgatttagtttgtttattatatggtttattgtaatttcctttagctaaagctgacaacagaaaataatatcaatgaaatggaaaaattcttttaattccaggaatttaagacaaaatcctctatctttaatttagtttttcttattttatctacaacaatggctcttaaattttggggcttgcattcccctttgagaatcttatgactgctatggccatatcctcaagaaagttatgcttctcagatgaggtagcatttaatttttctactatgtttctcagcagtgttcagtctttgactctcatattttgggggaaggggtggtggaatttatatgtccatgatatttacttatccggtgacataaatcaagtcttgttttagatcatctttaattttcttgcattaagtagtggttttttggaaacatttgggagtttgagcccagaaagatatgagagagccgggcacagtggctcacacctggactcccagcattttgggaagttgaggcgggcggattgcctgagctcaggagttcgagaccagcctgaccaccacagtgaaacccgtctctactaaaaatgcaaaatattagctggatgtggtaacacatgcctatagtcccagctactcaggaggctgagacatgagaatcacttgaacctgggaagcggaagttgcagtgagccaagatcacatcacggcactctagcctgggcgacagagtgagattctgtctcaaaaaatacaaaacaaaacaaaacaaaacaaaaaaaacaaaaaaaaaaaacaaagagagagagatagagagatatcagaggatacattctgccacctgtgttcattcatgactgattatcaaaagaaatttctggttcttgacaaaacattttctgttcatagagaaattgttcagttcaactgggcatgggtttgctttctgtcacttgctggaaattctttactggaacaaaaagtctagtgcttgtgcataagggaagacatagacatgtggtccttcctcacacctgcttcctcactcctgcttcctttttgctcctcatttttcttttccatcttaacttttccccatcacttgagccttcagtaagtgtgagataatttcacttttcttctcatgtgattatttcacttacaggaaatcatattcctggcccgaaattgtttcttctttcacagcagatgctctccagggctcttcatcattttgtcctgagcaatacattttcaaaatgtaaagtgcttcccggctgatagctctggagccactagggggtttaggaatgtggtgcagtaacaacatttgtcttaataccctttaaaaactgtaagtaaagtataattattgcttagaaactttttccttaaaaaggaattgattttacagccacagggtgtatagcaactacccatgactggcagttagtggggatcaagtaagagtccgcatttctgagttggtttaataacgcaacagaacaccaacagctgatagctcctggttttgaccattaaattgctttaaattggttttattctaactatctgttgttaattttgtattcataaccattggttaaatataggaggtgaacaaggagcagaatataaatgacgataatgccagcttttataaagcacgttaaggtgtttctagcatttaagaaaataataataaaaagaaaatacaatgataattgaatccaatgtagcttttatttactgagattaaaactgtctgactatgactaaacaagatgatttgtggaggggtgcaaaatttatatcaggtcaaaaaaggcagatttttaaaaaatgctgtaacatattttaatttgtctacattttaatatagacttgactctaatgccaaataaggtctagtcattaaaaaaatttttggctgggtgcctgtagtgccatctactaaggaggatgaggcaggaggatcactggagtccaggagtttgataccatactggacaatatggtgagaccccgtctcaaaataataataataattttttgtgcttaaatcatatatttgccatataaattaaaattacctgaaaatatgtaagacaggttgattgggaagaacaaactttgtctttatattccacaaatactatctaagctctattaatgtatttctaattttaaatattttattttaaataactatcactaaaaaatgtcaaaattattctaaaattccttagggtatttgagaggctaaatagttctgtgaaggaattcctgaaagaaaaaaaaaggactggaaacatagggacatggattgtagtcaggtgattgaatgataatgtgctagcaatgactttgggaatatcgaggtcctcaggggtctctagcatggtactttgctttgaccaggtgcttggtaaatgtttgttcattaaaagaatttatgtatataatatatggtactttaatcacacggtgctgttttcatttaaaaacatggaagtcatggtctactatatggaaacttaagtaggtgatttgtagccaccatgggagcccttggctgggagattcactgtagcaaatatcctttcacagatccaagacctagtagtactgaatgaagtgatggttttacccacatgatgacttatgtcaatcaaaatgaaaaatatacccactttcttattcctaccgacttcttaaataatttgccaatctgttgcaaatatggtacactgccaattttcaaagttagctatgtgagcagtccttcctccaattataggaccagttacataatgaaggtttgatgtagaagtaaggatttcaagaacagtctgatgcttggcatagaagtaaggatttcaagctgcagtctgttaatagttttgaagtattgttattgtttttgtctcttattcgggaaggcctaattatcagtgatgttaacaatactttcctctccaaagccatttttttctttttttttgacttgtcttattttcaagcttctaaaattcagattatacctattttgtgcagcctgggctcttgcctaacatgcaaaggatatttagacggtagaattcatagaatttagtaactgattggatatgggaaggaacaggaagacgtgaagaaaaggaaaaggaaagaaaacgcctctcgcggccgggcgcggtggctcacgcctgtaatcccagcactttgggaggccgaggcgggcggatcacgaggtcaggagatcgagaccatcccagctaaaacggtgaaaccctgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagcctgggcgacagagtgagactctgtctcaaaaaaaaaaaaaaaaaaaagaaaacgcctctcggataagagacatgccttgggcagcagggtagacagtagttatattaaaagttaaataatataataagcataacaactaacagctattcagctatttgccgttgtgctaggaactgtgttaagcacttcatatgcatgataaaatttaatcctcacaccaactctagaaggtaagtactatttttttctcttttacagatgaggaaactgagatttagaagggttatataatatgtgtgatatcacacagctataaaaaaaaaacctcaagagccagaactcttagacattagttgtcttccggtcagaaaaataaagcagatttggagttgtatatggtcaacagtatcatagctgctaagtaatgaaataaaataaggactgtctgacaacagtatcacgtgctgctaagtaattaaataaaataattcatttaataaaatactataaggtattggcaagtagaaaagatgatgagaggacattctaggcaaaataaacaacatagaacattgccctgggctaggaaagcaagacaatttgtccagaatgatgacagctgtattggatttggggaggggttgtgctcagggcataggaactaggaacacagataaatgtgaaaaagtagttagaaaatgatgccagtagtgggggaaatggatagctatcgttgggagtgggagggaggacccagatgaacaagacacacagcagccttcttactgtcaacttcaagtgctttatcatatgacacatatcacgctaggaatggtggctattttctttatctaccttgactcatatatcacatatatttatacctctggggtgtcatgactgaaataaattttctggactaactttataaatgtatagagaagcagacagaagaaagaagcaacttctctgaagtttgggttattttccattttgatggccaaatgtagattaaaagttgaaagtcattcatcacataacaagcccttacgtgccaagtattgaggatatgaagatgggtgagttatggtccctgccctgagacactcagagtacagcccagaagatgagcattttttaaaatttattattttttaaatttttttattttactttaagttctgggatacatgtgcagaacgtgcaggtttgttgcatagtatacatgtgccatcatggtttgctgcacctatcaacctgtcatctaggttttaagccctgcatgactaaaacaccaaaagcaattgcaacaaaagccagaattgacaaatgggatctaatgaaactaaagagcttctgcacagcaaaagaaactagcatcagagtgaacccgcaaccaacagaatgggagaaaatttttacaatctacccatctgacaaaggtctaatatccagaatctacaaggaacttaaacaaatttacaggaaaagaacaaccccatcaaaaagcgggtgaaggacatgaacagacacttctcaaaagaagatgtttatgcagccagcattttaaccagtggtttataatgccatgggctctgtgcccaaggagattgtactgagccatgtgacaacagtgcaggagagggactggctgttgcatggggtggagtggggtagggtgggggctgggacacaagaccaagctcatgatcatgagatcctcattgtgctcccctgctgtttctctgagctttcactgacctcacgagagcattcgcccccgtatccagtgagtcattcagtggctcctccgatctgcccagaaatgttttgggaatccagttacccttctccacgcatgcgttcaagctctcacggtgggcctggacccttgcagaagttccctagctgatctctttgcttcctgtctctttcctctcctacctacgttctgtgctacctccagagagctctttctaagaacagagcttttgtcccagcgtggcgtgtaaaatccttggagatattggcctcttctccctttccagcctcacttcttgccattttcccctgtacaccctaagtcccagttctccaaacagcttgttgcttctaatactaagtgtctgtgccatcccattctgtctgcctggatgccctccagctgatcttttcaatgactcctctaagaagaagggctcctctggggtattttgaaaatatgcctgtgaatagaggatgtgcgtccttatcggactgtaggccttacatttgctgctctgagaattttcatccagaaagatctgaatgtccagacccaaagaaaactatttttctttttgtctttatactttgccagaacaataaatgtcaaataactttcctttccacatcgataagcctacaactgttatgtcaccccactctaaagtaaggcttgctttataatgtattggagggcatgtcgtagtttatgaaggcaaagtgcattaaattttttaaatagtgctaggttattaacctaatgcttattcccacaatgcatgtggcacacttggggaccataggaattgcaaacgcacatctggattactaagatttgttaatcctctccaattgatgtgaaataatgattagtcaccaggagagtaaaaagctttggttccctcatgctgccaaatggagatcaaagtgccatcaacacttcgcattagctattgttggagccactcttgtaccaaaggaaacaagattttgtcttgttttgtatttgaaatattggaggaaaaaaatcaaattagagctagatgttattggtgtgaggcaagattcagtgactcagaaacataaaaggaagttggagaaagtaaatgaccagaactgcctgttgtatatttcttggtgcaaagaaaaaagaagatgcttttgccagagaatggaggtggaaagaagagagtgatgggaaactttaaataaatgggaacactttgcaatggacaacccggagttcctgttcgagggtggtcctgcagagaagtgtcatgagagagtggaatagttgagtgctgcacaggaaagaaacatgggctgaacttggaaccaaggttatgtttccaaaaatagagttatattaactgcacaaagcacatagattgaggaaagcctgtgcttctgttcaggcctagcaggccagcaggtctctaggccatctggcctgtttctcctgggttgcccaacagtttgtaatgtgaggttttctcatcaagtagaggagagcttacatatttattcgcagatatgtgacattgtacagaggaagaatgattcgaaatggggcagaaatcaggcccattgaagacgctagacaaaaaattaaaaccgcttccgaagcattttaatgagtctggcaaaagccattttgaactaatttcagacttttcacctccaacttgaatatagaaattgcaccaatgatgataagtagattgagagaatttttttaaaaaaaagatagaataaaattttgtttcttttattggttattggtatttcatctgttttttaaaaaagtattcagaaaagtttagaatccagaggaccattgaaacagagattagtggtgggaaggagtgaaatgtctgaagaaatggttgtgctacaaaggtaggctaagaatagtgagtgttcttgggttattatgagctaagacataaatggaaatgtggttgtcatggggactatttgcagtagaataaagtattttggtttgtcaagagagatagatctttttctaccactaatgttaaggttccaccctccctggaatctcaaggtacatcgggaaccccggcacgtctcgcagacccactggctggcactgccactccactggtgttctggggcacgaggctgcctgctgtcctgtagggcacatttgccatcttacaacctgctttcccaggatgtagttctctaccctatgccacttctttctcaatacagaaaagagcctgtcctttcatttcccacagcatagctgaggccaaatcctaacatttaagctttccagaaggcttttacataaaggaagaatgagagaacagccttaagactggaccctacatgaggctgctcctgaagtacagaagccagcttcttctctggcactgaaagcgggcagctcacctgctcacaatgggagtgcccttctcatccctcactggactcagccctcagtgcctcctcttcagctgcagagggagttttcctcaaaggatatggtctgcagcaccagccacacctcatctgaaacacactttaattattatgtggacagctcactcctcctagtcatcaacctgctattccagaatccagcagtcacttaacctttgcataaccactaggatgtaaagtattttcccactatacaggagagatcggtttccacaggtggattttagtcttcaatgatgaagaaacaggaaaaccacatgtaacttggccattttcccacatcatggttttaaaaaacattgttgtttagacccagccagagcatcctatgctcatgggcactctagtgctacccaagacttccttaacatttttggtaaaaacaaagccacaggttttgtgcctcttgccctcttcgtctctgaccaccttccctgccttccccttgtttcccaggggtcttagtcttatccttggcttgggagaatagtgtatccacagcaggataggtgtttctagtattgggaatccaactgacctttgcccactcccaatcaaacctgtcccttgttagaagagagtggagaggagggagaagcctccaggagtcttcttggtgggaaaaaggtatggatatcctcagagcatttcctgcatgccagcaatccacatggcctgttttccaatcacatctttgcacgtccaaactgccactaggctgcaaatttctcacagtcacaggatgggtcatttcatgtttctgtgctccacaatgcttgactctaagagatactcagaaattgattaccaaacgaatacctaacactatctcctaactctttgttaattacaacataagcgaaaagatcacagactcctttgcaagggtttatttttccttttagcaatacctgtgcttgaagataaatgccctgttttgttgtgtactttgcagtccacctgtgtagacatgtaaacagtctctatcatgtagagtgtttaaacagctgtccgggcacttctcaaaagaagacattcatgcagccagcaaacatgaaaaaaagctcatcatcactggtcattagagaaatgcagatcaaaaccacaatgagataccatcccatgccagttagaatggcgatcgatcattaaaaagtcaggaaacaacagatgctggagaggatgtggagaaatagcttttacactgttaatgggagtgtaaattacttcaaccattgtggaagacagtgtggcgattcctcaagggtctagaaccagaaataccatttgactcagcaatcccattactgggtgtatacccaaaggattataaatcattctactataaagatgcatgcacacgtatgtttattgcagcactattcgcaatagcaaagacttggaaccaacccaaattcccatcaatgatagactagataaagaaaatgtggcacatatacaccatggaatactgtgcagccataaaaaagagtgagttcatgtcctttgcagggacctagatgaagctggaaaccatcattctcagcaaactaacacaagagcagaaaaccaaacaccgcatgttctcactcataagtgggagttgaacaatgagaatacatggacacagggaggggaacatcacacaccagggccttttaggggcaggggcgaggggagggagagcattaggacaaatacctaatgcatgtggggcttaaaacctagatgacgggttgatgggtgcagcaaaccaccatggcacatgtatacctatgtaacaaactggcacgttctgcgcatgtatcccagaacttaaaatattaaaaaaaaaaaaaaaagctgttgaggaaacattttatttccagctgtagtgccagccagtaatgttgtctgaggctgacttctcttgggactgattctctctcctgtgtgctttgtcctgacacctgagttcagctgaggtgttctggagcccaggggacccctggtggtacagagcagactccagagggctggtgtaggttgtgttttaagtcacagaaacagctcctgacattgacttggtttgtcgaaggagctaattaaataatgctaatagctggcaaacagtgatgtcagatgggtaaacagtgaccctggctgctgagttggatgggggaaggaagaaaatgagagagagggtctaaatgtagccaaggaaggatgagccttttatatctcatgcagattaataataatttttattaaaagtgtctaacgctgtggtgagtgccacaagatttggtttgtggagagacttttctttaaagatttcttcacagaagtaatctattttattattgggtaactaattgaaaataagcaatatgcaatgaaatatttgtctgggggttcctgactgtttattcaaagttgccagaatgccaagaaaggggaatccaaggataggtgaagggagagcttcaggagtcagggggtctcttggtctgcccatgtgtctctctttttgcccttttcaaatcctctccagccttccctcccagggagctcgctatgcttaatggcagactggtattctctcggtctaccccaactataattttgcttgataacattcagggtgttggtagctatttcctcagtcacaaagaatagtgtgtggtaatttagaagcttgatttctgatagaaaaaattagggaaaattactgcaaacatgagcagtcatgggaacctcatggttgaagctttaaagctagttattgatggtcatttttgtctttggggacagtggcacagagctggcttccaaactgtattcaggttagtaatttttatctctactaaagcaatttgcagaatatgtgcagtatagcttttttcataattctaaaaaaacccaacctttggattatatacatttagacaaaggtctggaaaaaaaacacaataaactgataggagatgttacctctgagaaagaaagtgggattggaatctacaaagggtccatttgctttatattatttgaattgtttacagcataaatgtattttaaatataaacattaaagttaaaagaatccagagacaactttcagagcatataggcatttgtttcaaacttctctggggagaaaaaattagtgtatttgatttacataatttggagataaaaataattattttaataatatactaactttgagtttccttgggcatatttatagtacctaaattttctaaagtggatacttaaaacatctgttattagtaatctatctttggccacatggtggtaatgagaaatttgttttccttgagagacaatgtatacatatttatggagtacttttgttttcaaagtctcatcttgatttatataaccacatgatattttttgaaaatggtataacaattttatttctgatgggaaagtacttatataagtctatcctaggaagttaaaaagctaaaatgggtgccatataaccagtagcgaaggccatttgcattggtttgttgttctttcatcagtttttacaaacttgcttggttttgtctgtttctcttaatgtgacatacggatcccttgttggtagtctttctaatagagatttagtgggagtatagataatggcagaatgattgtagctttcacaagtgtaattaacttcttgtaaagtacagttcttcaggacaaatcttgaaatagaatgactatttccagatctgggcttttgtccccctcctttataattcagttcttttcacttctgtgctgtcagtttagtgattcttcaacaagacttcccaaacttcaaatttgtttatatcttttctgtttagctatttctttttatcagattatacataagtgttttttaaatagctgcaaggtttgacccttgtgtgcccggtgattgtacgtcagtcatttgaaaaatcagacgctcagctgtcgtccctgtggtccagtttctaaaaccaagaatcatgaactgtctggggataagggaaatggaagacaaaccgagctactgtctgtctgctgattcttgcatctagtgtttttccttaccttttcattctgccagggcggggaaaaatcattcaaggatgtttactgacatttctgcatgtttttgaatgcctcaggaattatttgacttttcctttgtgataatctaatcctaagtgtctgtttgctccaatgtatttttaatagccaagggacaaatacatttagttttcttccttttgataaaaagttgtttgagaaaggaaagtatcaatttgaccgatttctattatttttctagcacattctaattatgttataaaaatagcaacagcaaagtaacttagagaaatccaggaggaaatgaacctgttgacttggaggatatatattcatatatcactaatcctgtgtttaatagaatgtttcttaaagaaaaagttttctcttcctagcttagaatggaagaccaatggtaggggtagcaagcccctactaagcacctacaccacagtggatgtcacaaagtgggtcttccataaatatttgttgaaatttttaaaaaatgaatgggaaaactcaaggaaaaagattgttcctggaggaattccttggatgatttatttgttatttggcgatatggatcagctggaatgtgaataatacaattgcttgtttcttagaatctattccactttcaatctttttgagtcacatttgtaagatttacagtacctatgttttgatgattgtatgggcaccaataaacagtagaggacttgttttcttatagccatttaaattttaattatcattgtgtagtgaatgccatcccatttgttcgacaggctgatctaccaaagtgggaactggagttgaactgaggagggacctaacagagtaatcgagatgaaagagaagtttcagagacgtgaacacgtaatacagttaaaaacaaactagacatttttagtgtattttagagaacttcctatgaggtcactagaacataaaggctgtgatcagaggcaaaggccagagtttgctacaggccaccatcttgatctgtcaagataacctggtctttttctactttaatatggtgctttcttatagcccaataaagaatagattgtttatactctttgaccctccattccctaaggactttttaaatagcagtttggaatcggtgggtacattgcttaatactgaacaggtgtttggcaaattcaaatgagatttcagattcttatgcacagaagatatttaaagaagcaacttttgtggacagagcccattccctgtaaccataactttgactcaccaggagctgggtttctgaggcaactattgcctttttctaactgcagccatctctttgtatatccccttctctccaccgggagcaaggaagacaaatgaggaatgaagataaagttctaggtagatagctggggctcattcagctcaggtttttgtctaatccagtgggtggatttgagtctttttcatatgaaagtattttagcaacttctagtgctttctacaacttccattttcataagttttacaaactgtgctctctgagggtggtctaagtgaggactgtatcttttcagctgatgttggaggagaggagttggtgacaccttcaggccttcatgatgccgtcagtctgggggaaatgactcatccatccaactctttgttgagaatttaaatgacaaatgacatatcaagtacagttcacccttgaacaacatgggattagaggaatcaacctcccacacagttaaaaatatatgtataactttagacacttccaaaacttaattactaatagcctactgttgaccagaagccttaccgataacataagcagtcaattaacataacacatatttcatgttatatactgtattcttataataaagtaagctagggaaaagaaaatattattaagataaaatataactcctattcgttaagtggaagtggatcaccataaaggtctttatcctcactgccttcaccttgagtaggctgaggaggaggaggaagaggaggtgttggtcttgctgtctcacagatggcagagtcagaagaggtggaggaggtgaaaggggaggcaggagaggcaggcacactcataatttctattgaaaaaaatctgcgtataagttgacttgcacagttcaaacctgtgtttttcaagggtcagccataattgctaaaatagcaaggctggagataaggttatctggagggggtggattgctggcctctccaccctcattagatagtgcatatccaatgccttggtttgcaggatgctaaagttctcttcaaagcattgtggtcttatagcgttgttgttacttactccccttgactatagcaattgaaatgttaaaggaaaacaaaactttctctaaagaatggctgtgtaaatcggtcgctctgttttatctccacaatttttctacttaagttgaataaatgttatttttcccagaagaagttagagagcatattcaagcaatggtttgatgcaatcctttataagttgtgagaccttcatgcgcatgtgtgctggggttgagtgcaggaggtagagatgacagtttccagtcctttctacgtgacacaggttagaattcccgaacaatgaaactttccaagaatgccatttcttggaaataactgctttttaaggccaccttaggcatgacttttaaaatggaacaatgaaaatttgcatttcaaagccatctaattggccctctattcttttgaactatgagtggtctttttaagtagatttcagcatacttaattttttttatatatgtgactttgaatttttttttctgcttcattagattttttataacttggccaaaaagttacttagtgatgcactaagtgatgagattctgtcttcaaacttcacattgtttttgtcagccttcatgatattagacagtatttaatgagatgttaggaaaggaataattttgagggaaatatacttgagtcaaattgaattcttagcttcattatgttaataattatttaattctaatttttttcttttaaaagttgctttcattttaaccatttaattaatgttatgctgaatttttatatgcattgaaatgcttattttgtgatatgaataatgcaaaacttctaccaaacaccgaagtctgtaattattgaaagcggagtttctgaacctgcactattgacattttaggacagataagtctgtactgttggggcctgtcctgtgcaaggcagaatgtttagcagcatctagcaccacccactagatgacagaatgccctactcccttcccccagttgtgacaattaaaatgtttcttaggcattgccaaatgtcctctgggaggcaaaattacccctcaacccctggttgagaaccactgatgtaaagtctaaactctttcttcccaataacagaaagggattcctcatcacagagagtgaaagcagaagccgtgtgtgttgcaaaaataactgtggaaatctgactggaaacattatattgtagatcattgtcctaggttaagtaaaactcaaaatcaaaggcaggctacatattgaaataatgcaagaatcaataaattatttttacatagaatatttcgggaccaaggtggaagtagactgaagtacaatatggagcactacctggagcaaggtagtaattcaatttcagcccactgaaggaaactgacagatcagattcaaaatgctgttgaccttgacgaatatttcccttgaatatgtgtaatatccttgacctatgtaagataacccgacatggaccagaagctttattgagtccctaattcctatattttgatgttttgatttcacaggtatttccagcttgcttttctctctcctttgatcctgcatgatatcgtgttctcttggttttcttgctgcctctttgtctcacctttcggctttcctttcttatgccctccacccgaacactggttatccgcacaagctaggccttgctctcctttctcaccttccttcttcattaactctcagttacctcaaataccagctcagtgctattcccaatctccaaaagctgtagaaacagacatttttttttccataactcctttgttggcaaaacctgacccaaataatatgaagcttttatagtcatcattgatcccacctaatgtgaacatgtgtgtatgtcactgcagaattgttaatatgctgatcaaaggccactgcccagatgtcattggtaaggataagtaatgtgtgatgtatgtgctgcaccatttttctaaagtctgaaaaattcagaatctaacatatttggctccccaagcattgggtaaggtacagctactacttctatgtgcagcatcacaagtcaatagctcttaatgatcccttcattgcttgccttttggatatcttccgctattgatggagcattctttcaatgcttgaaacaatttttttttaaattgtagcaattcgttttccttgctctaagaaacagaatattcctgataatgctgttggtactaagtactctagtcttcagaacttgaggttatctttttctttttaagatggagtctcgcttttgtcccccaggctggagtgcaatggcgcgaacttggctcactgcaccctccgtctcccgggtttaagcaattctcctgcctcagcctcccaagtagctgggattacatgtgcccgccaccatgcccggctaatttttttgtattttaaatagagacagggtttcaccatgttggccaggctggtctcaaactcctgacctgaggcgatcctcccgcctcagcctcccaaagttttgggattataggcatgagctaccgtgtccagcagaggttttcttaatgttccttttctctacttgcccagctcattaaattctcaaggcttctatatcctcatgcacaagtttcttttcatctttgttatcccttgcagtaactttagttttgagctgctggatcagcctccatttgcacatggccagcatatctgttgttttcctctttctatgatctactgtgaccttgcagagtaacattctaggcatttccacaaccgccctgacatggtctcatctctagccatgtagccacaggggcttttctgcaccattgagacacacagcttctttaatgtaaagtgttttgatgccatgtcctgctcattggttgattttctctccctgactgcagagctccttttctgagtatctgtccaccatccccctcggttttctcttctccatacaaccttccctcggtgcagcgagtcacattttagagggggagttgccttccaaagcctagtaaaaatgcaaaattcacaaaaatcagacctattttttttgtaggaaatgattcacattacgtaaaattggaagtgtaaagtgacaaccttttaatgttttatgtcactatttcaaattcacataaaataagaccatttgaaagtctgtctaccaagagctaatctgactttgtcttttcatctgcacttagactgcaactggtggtgtttcaccatccacttgctccagtgctcagatacttcatcttcatttggagatagctcatccctctggacaccctgaaaatgtttcagtatctacaatttgtaaaccactttaaataataatgcattacaatattatggctttctggtagctgaaatgaaagaattgtgggagatttctactcagttgaagaactctacccaactgctacagataacagatcatcaagggcttggaggggcttcagtagcacaccccagactttgactccatgagcattatctagagccacattttagtctgtgtgttggaagaagatgtaagtggtatgcttattgtcttagtctgtttgaggtgctgttctagaatagtatagactgggtggcttaaacagcaaacatatgtttctcatagttctcaaggctgggaagttcaagatcaaggtgctggcagattcagttcttattcaggaccctcttcttggtttgctctgtcctcacatggcgtagagtggaagctctggggtctcttccttgtcttataggagcactaatcccatgatgggggctccaccctcatgattttatctaaacctaatcactccaaaggctccatctccaaataccgtcgtattgggtattagattttaacatacaaattttggaaagacacagatattcagtccagaggactatcttactaaattactggttagtgagaaaatccaatgattatgacacaccaaagttaaggatcagagctcacaaagtcatattaatgttcatgacattgcacattctccatgtatgtccccgacatcagcattggccagggcaatagtttatattctgaattcatggaaaataatgcaggttttgatacagaataagctagccatgtgttatgatttgttaaagcaaccacagaacagggacatgtgtagaaaggtgtatggcccttgggaggtggtgttcttactgcattcccccaagtcatcaatctgtttgctgtgttgactgcatctggctctcctttcatgttcctaccatcacatcttctttgtgctttattatagaaattttctttatatatatattttctgcttgcaagtctttagtgctaatagacttctggctgcctgagaacaaggactgtctattcatctttcctgtctccagctctagcagagtacttggtatttaataccctcttaacaaaaattgccaaactgcctctgtgacccatttccagggggatgctggcaaaccaggtgacatctagaaggggggcaagtagatttctgagaactttttgaatccaaatgacataaggtaacataatgagtagttgatggagctgtgattgtttaggctggaaaataattatgtttgcaaaatatgttgtaatttttggcatacagagcatgggatacagaaaggagataaaatagtggttaagactttatagcagtgtcaccttgggcaagtcttggtgtatccatttgtaaaattgggacagaacagagtgattaccccactgggtagttgagaagcattagtgcttggggaggtattgatagtaagtgctcagtaagtggcacagctttctctattcttctacctatattttctcctcctcctctctttctcctctccctcctcctctccagctttccactgggggcattatcatatctattatatagacaaggaaggtaaggtcagaaaggttacatgatacatttgatatttctttaaaatatgtgaaagaagaaactataatctaagttttggcccattattcttttttggacagaatgtccatcttcaaacatttgggaaagcgttatgtagaagacagaggtgactcagtctacattgcttcagagggcagagccagggcccatgggtagatattacccacatcagtactaggtggcgggtgcaatcggaacttctcttcttccctggcatcaggaacggcactgtgcagatcgtaaggagtccacaaatcattgaattaatagaatttcactactgaaacaaggactagggtcttactatattctgccagggaaaacaagttttgaaaagttcttctgctgttaaaatatgtagagagagagttctcaggagtgatcagaaggacatacaatagcagagatggaaggagaactcaagctcaatcagagctttttcaggaattcagcaaatgactagttgcattaattctcaagttatttttgagaactgagtggtcagcagttttcaggaacagtttttattctgtcaggaagactgggaaaatgaagatgatatttaaaaataaaatccatgataattgtgaaagtgcccataaattcctggtgcaaggaccacctagtcaaggagacaggagaaatagggcatcttttacattattaacatgctgaatgggtaaccttacctcatttggtatttctcctcatacattttttaacataattttctcacagtgaaacactttttgtgcagtgatttctattcattcttttgactcttaagaaaaataatcttgcagatttttttaaagcatgatgagaataagaaatgcaagatatattgaaggaaggatcaagaagacaaaattagcattttttttgagacggagcctgcttccgttgcccaggctggagtgcagtggtgcagtctcagctcactgcatcctcggcctcccaggttcaagtgattctccagcctcagcctcccgagtagctgggactacaggcatgtgccactgtgttcggctaatttttttgtgtgtgtgtttttagcagagatggggtttcaccatgttggccaggatggtctcaaactcctgacctcaggtgatctgcctgcctcggcctcccaaagtgctgggtttacaggcgtgagccaccatgcccggtcaacactagcatttcttagtgctacactgtagctaagctatcatacatatcatctcacttaactcttcttcatttcatgcacattttgcagacaagaatttgaggctcataggttaaataattcaccctaggctctccagtaaagaagtaatgatctatcttaagaggcagtcaatagagagaaatttttcatagaaatagttctttacttctcttttttaaattgtctgggagccctaaattataaggcagttggtggcatctgacatatgctcgatttcccaaaatactcagatgtcgcatacaagtaatatctctgccttatttatttcatcctcattcatattttcccctaactctgtgcttctattaccccctgcgtgataaaaagtgtgttattcaggaagccatagtaattatgtatcagaactaatggaaaagagcctggcaaatatatctacttgttttatacatgagcagagtcaatagaattatccttgtgatctggaaggaatttaaaaccacgcagatgattctgaaaatattcttcaccttcaataacccatctaatttttttgagacacaaatttttgatgctatccctcatttgaatcctaaaaatgtatttgccatcctgctacagaaagatgtggaggtcagggagtaatgtggtctactttaaagattgggtttttccccccttaaacatttagaaataaaatatttgtaccacttcactggcagaaattcagtagcaatggtaagaatagagttaccttctgtgtctagtgttgcctttacagttgctttgtttcatagttttataaattgggctttctggtttccttggaaacccagttgtcgacattggttgctaaggagcagccttggctgcacaaagcataaggagctgcgagtctgctactgagtgacttcattcttggcagtaacaggcagtgggactcttaggacccgcttatggggggcctccatcttgattttcagcctgaaggattactatggctcttcctgatctttattctcctggcagttaccaaagctataggtgtctataggagctgagaattgtgtagcattttagagcatctttgtcctcaactctattttttcagtcacttgctatcaatgatttattcaacaacggataatctgtttctgcaataataagatcccaaataaactgtattgtcttctctgttttttttttttttttttttttttgagacggagtctcgctgtcgcccaggctggagctcactgcaggctccgccccccagggttcacgccattctcctgcctcagcctcctgagtagctgggactacctcgccctgctaattttttgtatttttagtagagatggggtttcactgtgttagccgggaaggtctcgatctcctgacctcgcgatctgcccgcctcggcctcccaaagtgctgggattacaggcgtgagccaccacgcccggccgtcttctctgtttttaagatgggaggtcttccttcttaaatttagcagtgagcaataatgaaagaagctaagaattgttcatccttgcaaatcagtgtggtagcatgacactgataccagactgtgtctgatgtacattttctaatatactggtttgaagaactagagattatagtacatgtaaatgtaccataactaaatggttatccaattaaaacaaaaaacaaagaactgtaacccacattttctgtattggcatacaacagatattatagttcttatagaaatatatccctaacttgagttataccgatttttgaacatgactttataagcttttaggcatagtaattcaggtgcggatctgtctgtggtcatggtccacatgtctgttttgtggatgtatgctgcacgaggaggtcaatgatgtgcaaatctttgagatcataggtagcaaggtcctcatttttcaaataagtgttaaggacatgtgcaagctccatttccatagttcaggtgtgagccagacagagccatcctccttggctgtctggagggctgatttgtgttacagcaggtggtgatggaattaaaccctaacaggacaccattcatcttccttgtttgttttgggtgatagcattgtgcaaattcatggcattgttttatctgtcagatatcttcagatacctgcttttagaggtagtttttttttgttttttgttttttgtttttgtaaacccacatagttaagtgagactcttgtcttaccctctctgaacctcatattcgttatctctagaattgggcaaataatgataccttatggttgttatgggagtgagatagcctatgtgaaatgtttacttaggtatctatcccataagaggcccttaaaaatagtatctgttttctaaaaaggcaaatccataaagacagatagattagtggttgtctggggctggacgtaggaggatagcatgactgcaaacaggcatgaggactctttccaaggtgatgaaagtgttctaaaactgaattgtggtggtggttgccaattgtatgtatttactaaaaatcattgaattatacgattaaaatgagtgaattttatggcatgtaagttatacctcagtagagctgttttaaaaagtagtagctgtaagtggtacagtagagaattaaactttgcttctcgtaggctgttctggataagcgagtaatatcttagatgatttgaggtgagatatcccagaatccatgtagtaatgcgcatgaattataatgagatcttgttgatgttatatattatgatacaacagaaaatgattattctttgtgattaccttatattacataatttccagttctatagaaacttccaactttcatgactgtagtaaaataattactgtggttttgtaatggatttggatgactctttttaacaaggtagggctgctggttgcagggtgtatggctgtgactcttcttttgagactcattggcatctggctggattgtatctattcagtccaacagctttattgatcacttaatatgtgttagtgattttctagaggctgggggtagaagaagagatgtgctcagttttagatgtgataagtttgagatctcttgttagttgtaccagagaagttactgcataggcagttggctacaacgctggaattcaggaaagaagtctggcctgaagatataaatcaggaagacattagcatatagataatatttaaagcaataaaaccggatgagctcaccaaggaaatacgtgtcattagagaagggaagagtttcaatgactgaccttaggttgctccaaaattaagagatgggaaaaagaaagggcacccgtataaagaactgaaaaggagtgactggttagataggaatcaagtcagcagaatggcatgccctgaaagcatatctgggacagagggacacttgtgcatacactgctaatggctcagataagatgagtcctgaaaatgtgatgattgagtagaataacctgggggtgtctgatgatcttgacagaggcagcttggtggaaataggtgagggagctagtttaggaaaacaaattagaggagaaattgatgcaaacatagacaagtctttcaggaagaaatggagaggaagctgggaaggaagtagggtagtaagaatggcttcaatctgatatttgaattattaaaatcgagaatttggtctatatggagtaatttagattttaatttctttggcatgcctctctcaatcaatatatctttactgatatttttccagttttgatttgcaagctctcagcttttacaacaaaattcgacttctgttgtgtttgaattaattaatgtaagatttttccctacaaccaaaaagcaatatagtctagtggtaaggaccatgcactttatgtcaatcaaactggagtgtgagtctgtcttctgctccttgttagctgtgtgaactgggaaaattctttagtgtttcttagccttggttgcctaatttgtaaaatttagatagtagcattcttgccttttagagttattatgagacttaaatgaaataactcaaaatgcctagtccagcatctaacacccatacttcctggtaaagtttagctttcatgatagccactaatttatactttgatatggagtaacatagcatagtagaaagaatgtgggatttggaattagccatacttgagtttctaccccatttcatctctcactatctgtacatattacttaatattgctgaatttgtttcctcatatctgaagtgagtataataatacttaacagaatgaggcttaaatgagatatttataaaatcacatagaaagtgccacacaaatgttaattttatttatttaaaatgaagttgtattttgtagagattacatctcttctattacatgtatatactaagaaaagagaaatcttagtatatttttggagttttaagtgttcaatttcatgggaaatttgggctccaaatagaatgaagcactccagtggcagtgtaacgagatatgttcatattatttctggtcaaaaattctgaagtgttaaaatgctacaagcagaagaatagaaatgtgcattctattatgcaattatataaaaaaatttccttgtagactgactcattttgctccaagtgacctagcttggaggccaagcaagtatctttttctctttcttccagaacaccatgtctcctaggtctctttataaagatgggggccgggcgcggtggctcacgcctgtaatcccagtgctttgggaggctgaggtgggtggattgcctgaggtcaggagttagagagaccatcctggccaacatagtgaaaccccgtttctactaaaaatacaaaaaattagctggacgtggtggcagttgcctgtaatcccagctactcaggaggctgaggcaagagaatcgcttgaacccaggaggcggaggttgcagtgagccgagattgcgccattgcactccagcctgggcaacaaagagcgacactccatctcaaaagaaaaaaaaattaagttaaaaaaataaataaagatgggaaaaaatgatacataacagctggtaaaaaccaaaagtgaaggagaatgtggtcagccaatccttgcagaaactttgcaagtaagaacaacctaatggtaaaaacttgaaattagtgtgaccttgtttgataaatatctaacctaacctaatagaaattctctgaccaaaaactggggtgacttgggtcacttttgagtcctcttggtcaccctttacagaggtagaatagcgaagtccagtactgttactactagtttacgtttatagagtactcagcccttttcaaaagactttcatgggctttgttgcttgtaattctcagaaccatcccgtgagataagttttgaaactcgtattacgtccttgttaaaaagaaacaaatggtttctttggaagatgctgttattgcctctgggtcaggactgggactgcagccactttaggatgtttttggatttaaaaaaccatattttttttcaacttttcaggcattatgcaacaaatgtgaatggtcatattctgagcttccttggagacttaaggattttattttatttttcataacacaagcctcttgcatcaaaattcatttctaacctcactcttcaccagacataaagttggccctcaaagagttctttgttgactggctgattgcactaaaggcaaggcatcctgctggagcacatgtgatcattctagttcaatcctaccgctgatggatgctgttgctctagtgttaattttaaggtatagcaccaagttctgacagttaaaatgtttagattatatgcattgtggttcactatggtgtacacctaacaagttgagtactatcactgctcagagagtaatggggggacatccaaacaagagacatttagaggcaattccaaagcaacacaaaaataaggctgatgttgtgacacaacctgagtgaaggcaaggatccaggtgggaagaggtggcggctctgggaaagatgacctgacttctggagaggagtctaatttgatgggtggaggggatgggaaggaaacataccatgaatataggggagatgaagcaggtcatttcctgtcaccaccctggtgactgaaagttgccttatgagcaagcattgttgctttcaagtggcctgatatgtggagcctcagggtgaaaaacaaaatcaattttaacaaattaagaaatgttctcattgaaggaagaaccatgaatagtggtgtattcttggttttttcacttcttgtctttatttctgttgcatgttggcatagttacttagcttaatttaaacttaatttaatatcgcttggattcaggaagaggactgtgttttaaaagaatccagagcccttgaaacctttttctctagtttaatagagttcagaataatattttccaagcattattttctggactgtacttttccaacaaagctttgtgcctagtttctttcttcatcagtgatcaattcctacaaaacttcagtttcttcatctgacaaatagaaattattgctaagtgtctcatgggattattaagattaaattgctataatgtgatgtgaaaactgtattcactgaaaaatgcgttagactatgctaaagtgacattatattattaaatgtaaagctataacttttatctgactgctatatttaaaaacagtaacaaattttattttatttttccttggtcttggcttaccttcacagtaacctggagttttcaactcatccaaaccagttcagtgtgttttgaaagactacgtactttggagcacccatcatggtcttggaaagaggatttgaaatgccctgtgttgaaactagtgagatgaattatggattttccccctgcattttcttaaagcaatccagaagtttattgtggagaacacatttaatttgagttgtgtgtcttaggccctattgtttcttaggtcatgagaagtatttttcaagctgtctttgttgatcagattaactagttattaaatatagaatttttggaaaagaattatgagaatttgttaaaaaaaaaagactgttctctatcaagattcagccaaagaaaacgtttaaaagtagaatttgttaaatctaaggatttaatttttggcctgtaaaagctatattatacaagttttacatagaagttctccaaagctgagtttaagatttatttagagaggattatattcactgaataccaagcagttctttttactgtggctttgtgtaaagagtttaggattgatttacatggcctcttatttttaacttgagaccaagacagtgtagctagccaaaactatgtacagtgtcaaatgcattttaactagatacagataaatttatctttgttgcccagcatgaaatcagccaggtcatttactgccagaataataggaacagaatgactttacaggcttagcaaatttggctctgttttttgataaccataaattttcaggaatcacaatataaaatgctggaaagatgtcttgtggatttttaaaatattaatcggtgtggtcatagtccatggttatgttcttaatacttaagttttttctttctgtacttgaaaaatttgaacacttatacatgtgcgtttacatcattcctttttgctccctaatatgtagaccagtaactttttgttttccatctaacacagatgtcccctataaaacatctggctgaaaacaaagcagatttgtgttctgtggggggcagcagactcttctcatttagcatagtgattttggagggtgttgcaggaaatgctgcctgctgtgtcagctcctaggggagaagggaatacctccaagaagcagattggaaacctagtggaaagaaccctggcatttcagtggcagcatgattgtcctcaaggaggtagagctgaggtgtggcaccaagatccactctacccagggctgcttaaggccttagtttctgaattatgatgcaaaagaaaggaaaagaggcctgttgttagcacaggttcttttatttttatttttattttttaattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagggtgtgatgttccccttcctgtgtccatgtgttctcattgttcagttcccgcctatgagtgagaacatgtggtggttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaatatacgtgtgcatgtgtctttatagcagcatgatttatagtcctttgggtatatacccagtaatgggatggctgggtcaaatggtatttctagttctagatccctgaggaatcgccacactgacttccacaatggttgagctagtttacagtcccaccaacagtgtaaaagtgttcctatttctccacatcctctccagcacctgttgtttcctgactttttaatgattgccattctaactggtgtgagatggtatctcattgtggttttgatttgcatttctctggtggccagtgatggtgagcattttttcatgtgttttttggctgcataaatgtcttcttttgagaagtgtctgttcatgtccttcgcccacttgttgatggggttgtttgttttttttcttgtaaatttgtttgagttcattgtagattctgcatattagcccttcgtcagatgagtaggttgtgaaaatttcctcccattttgtaggttgcctgttcactctgatggtagtttctttagctgtagcacaggttctttccagacctccccactatgatggaagacgatgtatgtgcctgatttacttgggccatgctaagttcattacagcacctctaagtgaatgaaaaccatagagagaaatgtaccagtgattacttcaaacaatatcttgtttcttactgtaacaaaatctgtttgggaaaatgctgtcatttagactcattttacagcccaggaaagaagtgttgtggccaaggaccaatggggcagctctacccatgaattctaatattccagggccgttctgttccagaccactctcatgagaagaggtggagaagccctgggttgatttctagcctccctccttcctggctgcctaaacatgggaagtgacttgaccctttctctcaggtgcctgatcttgcaggaacgttatgtgctcaacagacttcatagggttatttgaggtgcaaatgacactaagtatattgtagctcttagcatattataaaatgctatttaaattagacacgatgaagttgttgttattctgatatctgggacttgtattttttattgtgtgtttttagaaggtggaaaatatagcatttggtatgaagaagaaaataaaaaaaacagccataattttacaccaagagctttacaattgctgttaccattgccgttgtgtgtaaatgactcagaatgtgcatagatactctactatatatttaattttatatcctctattcttttgttgtaatataatggcataagtattttttccattttacaatatcatgttaatgattatttaactgttggctatttagatttctggacaattttaaaacaatgtgccaaattagccagatgagtctttcctttgcttagtcacctttagtctctagctgaccttattttaggatgtggtgtgacaggtagcatggagaattttggattctcagggttaggttcaattcctatagttctagagataagagggtttaaacctctactatttactctatcaaagtaattcttttgtcagacatatttcttacatttggggtgggatgctggagattgtgatggatattgaaatatatcatatgaaaatatagataggttcttaaaagctaagaggccttggatctccacatcagtctttgaagagttgtcttgctgaattattcttcctttccagttttccttttgatcctataggaagaattacccaaattccaagtcactggaataccagctaacatttacagagtccttattctgtgcccacatgtttaacatcatgtctcatttactcttcacaacaaccctgtaagatgtgtgctgtttctatgcccattttatagatgaataaatggaggcactcagaggttaagtaatttaagatcacatagtatgtggtagaggtgggatttcaattcagatcatttctctgggaaatcctagacattagatggcacagatagctgagaagtccattcattttgtgttcatgctttccatagactgcatattttcttcaactattctcaaatatctgcagtccgtttaaagtcaagaattccaaagaaagcatttttttacagaagagtgcttggagaacatttctagcattgtttaggaatatggttgaattattagtaccattgcctttcattatttaatcatgtttaagaaaaggtaatgaggtcaaagtaatggcatggtgacctgtttttacttgagaataaaatgctaatgataggagataggtacccttattatagaataaatatgaagatttttgcactgaactttcatgtttcattacctttcttcttcttctttttttttttgtacaatagaccctgttattcctggtaaagatgaagttacccatttcctgcttttcccctgactttctttctttttttttttttaatagacggagtctcactctgtcgccaggctggagtgcagtggcgctatctcagctcactgcaacttctgaccccctggttcaagatattctcctgcctcagccttccaagtagctgggattataggcacacgccaccacgcccagctaatttttgtatttttagtagagatggggtttcaccatgttggccaggatggtctcgatctcctgacctcgtgatccgccaacctcagcctcccaaagtactgggattacaggcatgagccgccacgcccacgccaccccctactttcttatggactaaagttaaatggacctttgtcttatctgcaggaaaatggcatttgtgttgcacacgagcaaacttacgatgaacagttcaccatacatatttccttctggacatttgctgcagtgtattcagtgatgcctaaagctttgtgacttctcagattagtggatgcttcattttgcctgatgtgttaaattcaatgaatgcctctaataaaaatcttgtgcatagcaagaaaataacatcacgtgtgaatagtattcatcaaatactgtgaggcgcttcccagtgttcgcttacttttagtgtgagatgtttatcatacctttattacttctcattttacctgattattataggctaattacagttgtcagagtgccaaaacctacccttcaggtcatgttttaaaaatgtattaatctgttttaatggattgtggagatttcttatgacaatcccaactcatcattaatttattcatgtaataaatatttattgcctgcattctctgtgccaagctgagtactaggaactgagtatatgctaattaataaagctgttatttcaaagcattttaaggaggttgaattcctgactagctactaggaaaaatacaccaaatattattgtccaataaaagaacaattctgttcagctcttttcacgttttcttagaaaggtaaaaagaaacaaattctcctattctgaccatttccctaattcccatctagcaaaaaggtgagtggtctggcaggtgtggtcacttctgtaatattgggcatacctgtatacttcttacgtctctttgctcctttcttctgtaactgatgccagacttactccaaaaataagagcctcaaggccttgaagttactgagaagcagagtaactgtgcatatttttttctcttatatattttgaaaatggtcagagtctaactgaagccatgatctagtggcctagcttccttgtgaggcagagaagacattcagagggaagaagttcccacgttctctctggctcttcagcattgttgtcttcatcgcttgtaatatccctgggaccctgggataggagaggaagaactggacctccagaatggtcatctagacttttccaacatatctaaaaggcaaacccaaaggcactttgtggtattctggtgacattggaggagatttctgctaaaagttaataatctttatcatagctgagatgatgaaaatcatgatcaacatcagaatcagttcatttccacatgcacgtgatgctgtattggctccaggcaagttgaattaaacagacacaagtcctgttctcatgaggccactggcagcatgttacatgcaagcaaccaaaggacatcagatacagacatccgcaaacaaatacacaaagaccttgcattatggtcatctcaggaaatatactcattaagtttgcagatgacacttgggtcaggattatcgaccttttgacattagtagacatcatggtgacctgaacatattgtcaagttggattatcaaattggaacgatggcttgtatattcaatgtttatttaaggtagatccagtctagtctggaagaagtttccacaatgacgcctatccgtggtcagttctcttctctcttgctttttaatttgaaacatcacagtttgcatttattaatcactatcaagtcgtcatcctcatagcgattatttggatatctttatgtcaggcagccactttatgtaattatctctaattctcacaaaagctctgctgcaagatgtcattattttcattttaaggatccatcaacaggtttaacttttaaagaggtatattaagtgatagctgggattcaaaccagaaactgcttaggccgagtagccaggtgcctttctgtctagggtaacaggtgggttgttctccacctgttttgtgtttgattgtgaaccttaggttctcaacactgacaataaagcaaaaaccaagacagtaagtccctgcccccatgatgcacattccaggggataccaggcaacatccatatggccttcaggaggcttggacaaagggggatgatttaggagtgtttgattctttatatgtagattattgatgagtgaagttcaaaaacagtctgtaaaccctgagcatctcagagttaaatacagtatttcttgaacatcaaagccactatataaattaatgtaggtgttcctgtttataaaatttataaaatgggaacacccacatttatttatataaaaacccacaagggtgacattttaaaatgacaggaagctcaactgaagtgtgaatcacaaccagaagtcaaacagaattgtacctgacaagcactccaaatttagacagggttctcagagaggtgcttaacagatgaaaagtctgaaaaatgggactttggggtttccaacgagttgtggtgacttcagtggtattttatgaaaaacaacacattgatggtggatattgaaatgtaccatgctgtgatttaatgccagaaaatctctggctgccacttagttttgagtagatgcaaggtaacgctattaaatgtttggttgttttggaatattgatttgttgggctctctgtcaaacactaagttgagccaaattatatttaagttgagccaaattatattcacacttcgtcatttcactcctatctgttgcagtatttaaactagaaactatttttgccatttttccagatatattatttttattaagtgtcatgtggactggtatatactgctagaattatttgtgagtcactctttgggtagaaggagagaaagtaactaaaacaaaagaatccaaatggaaatttgtggagaattgaggctttttaaatgttttgcttacagttttattgccctctcagccatcagaagtgaaaccacttatgtgctttgaacagcagctacctatctaatcttctaattttagaaaagggagtaaatatttgtctttagatactttatttttacttatcataaaaatacatgtgtaatggggtatgtttttcttctcgaatgtgctggggcttacttcaaggctgtaactcgaaattggccatagatgagaagaaatgccagttctcagtttaagaaagccagagtggggttacttcattccctgttgctccaaatgcactgtttttgtgcccggctgattgcagttttaagaattctatccaggctcatggtttcacaactcctccctcaactcccccatcatcgccaccaccacatgcttcctctgagtcttttaaaagatctgtgtgaccccatcccccttacctgagaccaggattgtgttctgatcagttccatatgcttccatcctcatatggctgtgtacagttttgcacacattgttcctaaccaggtgttgcattcatcacatctgacataatgatcactttttcttccagcctatggatcattcctgcagacacggcattctgggggttgttggggcacagaataaatactctatgggtcttcctgtctgcatccttggttgtctgagttatggccacaactgcacagttctttgattggtatcttatctttagcagtttatgttactaaattttttgagagaaagttttgttgcagtctggtttttaaccagacatctttttttattaactcatttaattcattattaactatttgttggttattttgctgctgtatgcacttgcagagtgcatactgaagtatgatgcagcaagatttttaaaaatctctgccagtcaacacacacgctaggacacacaacagcatgtaaatcaaaattaatgattatgtatttatcagtcaagtataatacggaatgtctgtgtttgataaacatctgtacatctatttgcatactcacagaagactccattaatcgttctgatcatgaggctgatataattggaaaaagtatgctttctggccactgtaccactgagaatgggaagttggtatttgaaagacagacaatcagctatgaaagagtgacgtagtactgagtagataatacatgattgaatgaattgttgattaataggcattttgttatactaagaaaatggaatttagaccaaaaacacatgttcatgtatagatagctcatgtgaattgaatattgatattctacttagattatgaaaatttggctgggtgtggtggctcacccctgtaatcccagcaccttgggaggccaaggtgggcagatcacctgaggtcaggagttcaagaccagcctggccaacatggtgaaaccccatctctactaaaaatacaaaattagccgggcttggtggtgttcacctgtaatcccagctacttgggaggctgaggcagaagaatctcttgaactcaggaggtggaggttgcagtgagctgagattgcaccactgcactccggcctgggtgacaagagcaaaactctgtctcaaagaaaaaaaaaaaaaaaagagatttaagtgaagtcatctttgttatgaaaaacatgatatactaatagaaattctccttcaggctttagggtattctgaaaatcagaagggaatagctgggttagaacaatataagcaagaggggttttcttttattccaactacttgtagcatatttgtttaagcacttcctgtggtatttggggttaaggattacactggaaaaccagtcagaccccaccattagttctggctacccactttctatggtgcaagctctctacggtccagagtcaaatccctcaagtcaaagtaagtggttttcttttgtgcttgtatttctttcccctgatgctggcagttggccagtggggtttagtggagaaaatagtctctggagggacaaagatcttgattttatttccaggcccactgtgatgatttcatagaatagtgccttataaactgcttttggcttattgggagaaaggtattatttaaatgccaagtttctagcattaatatttctccatgcagcagtaaagtgtgtgtttatattactatgtgaaggaggtaatggatgagaaagtggagcagtactgtagggaattgaaaagagaaagcttttatcctgatctgacttaaagaaaatacttttatacacaatggcactttcctgaggcgcagacgctaattctgtttgtttctcaatgtaaatgaagctgtatggccaaagcactatgatggatggagcactgtgatgatgagctttgcaaagcatgatttgccatctgatttggagaggtcattctaacaattctcaacccacagagcagtatttttcctataaaggtagcgttttgcaggtggaattttttaagaaaagtattagaatcaattttatttaccttagctactgtctttggccacgaatgtcaattgagaaatccagtagatattctgatcattactaacttattcctgagaaaaataagggatattggatgtcattcctgatctattcagggagttccagctctgaattaatccctactgagcatatactccccactaaattatatgttggcctggatgccaaattcaacataagcaaaatcaaatgctcaatcgagttctcacagtggccttccatatcagtgggggtcttcattcttctgagcctcaaatctttgaaacgactttttctacttctttcccttcagataacccctcaaatagcaaatcctgggtctaattttataatatctttacatctttcctggctgccgcaatcccattttagatgtttcttatagctgtggacctctaagatcctcaccttgttctcagcctatatctagaattgcttcatccttcctcactaagtgccttactccagacttacctctgatgttagcttcacatttcttaatttgccttctaattagatctccctctcagtcctgagtcttgatcctgcccttggcactaatatctggttctcattccctactaaaattcattcttgctcctcacacagcctagcccttggttactctgggaaaagttccctttctcagtccatcaggctctcagaatgctgtcctggcttggacgcttgtggccagtgttacagggaggacaactctgtccagtgaatggcaattgtactcgattttccttcacagagatggatccttaatgtgtgcttgtcaaaattccactcttttttaaaaacccagttctaatcccatctgcttcattatgtctctcagtaccagcagcccacaggtttcctctctcctctgaatgtcctattagagcactgatgaattattctcttgatatttactgttattgttcagaatatggccatgtgcaaagatgaaaaacagtgactgtttatatacaacttgtcttatcccccccaaaatatataagcattttgagggcagaagtcatagtatgcatcctcacattctgtgtggtctttgtcccagaagcatatgtttaatagacaagcattcatgactggccgactttctaaactcttcttaaagcatagtggtcataggaaaaaagataagctcagcctgaatacagagctttgaaatccctctctctacacccccatgtttcattctgcaaactaaaagccatgctggctgcagagcatggctttaatctattccataaatttaatatcctgaatctgaacctcaactgaaccctgcacaggctgaaactacaaataatttttcatgggtgtctcacacaaaacaaggcctgaacaaagacccagatctcttttaaatggtattattaacaagcaaaacttgcagttcatctctctgccctaagaggtttacaatggaatttttattttttgctaatcaacctgattgaataactgattgatgtctgccttaaatagtgctcattcccaaatgtggtgttacatagatttaagtaacagtcgctaatatttttcaagattaagccctctggggcacttaaatcctcacttataccttcaggttttttaaagacaggaaagtagagattggggtgaagttactcctttgaaagaataaatcattttgaagggaaggaaaaggggtgggacgactggtgttgctatccatggttctgatttgttactaaaagacaggattcatctggagaacatatcactgatgtggtttacagagtcatcatcctcatcgtcatcatcatcatcatcaaatgctgagatataactacttttacactataataaaattttaaatattgactatatttcatatgtatgtgtgtgtgtgtatataaactcacatgtgcatgcctacctaagggtgagtccttggtggtagttttaaaacagtatcttctaatcttcaaagtctgtataatataatgccatttgtgtaaaaaaggagaatatatatgtgtgtgtgtgtatatatatatatatatatttttttttttttttttgtcacagtcttgctctgtcgcccaggctggagtgcagtggcacgatctcggctcactgcaagctctgcctcctgggttcaccccattctcctgcctcagcctcccaagtagctgggactacaggtacctgccaccacggagaatatattatatacacacacatgcatacatatttattgttatgcatacatttaacatatacatatattttcattatatggttaatttttttttttgtgtgctctggaatttctttcttttttttttttttttttaaattatactttaagttttagggtacatgtgcacattgtgcaggttagttacatatgtatacatgtgccatgctggtgcgctgcacccactaactcatcatctagcattaggtatatctcccaacgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatcaaaaccactatgagatatcatctcacaccagttagaatggcaatcattatatggttaattttttaaagtttatttttaataaacagttaatttttaaaagtttatgcctttttatatttttaatactgttttaaaaatcctataataaatcagaactgcttaaaaatagaaataaaagacctattactgacctcaacatcagtgcactctggcaagctttaaagaagttagaatgaagttttaaaaatcctgcagtcaacataaagggataaaatgtgacatggatttatgacagtgtggtgtctgaatttgttatatttaatataagtaagaaaaataaattgaacagcagtacagtggtgttctccaggaacccgtcaaaaagaagcactggggaaaatgcggggaggtttccccttattcttctgaaatctccaaaaggaatgaaaaatggaaaatttagtaagagagaatagacactgagttcactccctgtttattgaaagaaagccagctggttaggaatagtcagcacgagacagttcattttctcttgccggtgttttaatagggcccaggggctggggtagaactagagtttatagattaataaaagtcacaacagagggcagaggagcaaagtccatgaatctcaaatcggaggggaagtttcaaaggctattctactaatgcgtccaggttggtatgtcgaaaatcaagtcattatttatccatttacccattctccctccctctcagcccctcatccttgagccctggtttctgggaacggctgttcttctggccatccatgcttaaaggctctgagtcctctctaatctctttatttgccttttcagcgaacccagtgaccagttttgtgaaatctgtctcttgctgtttttcagatctgctccttctcataactcctactgcattctccatagtttgagtgctcattaccccttagagatgagtatatacagaacgcatagtgtggcaggattcatgatgccatggttcatatccccaccgcactactttttatgtagtggcaaatatacaacttgttagttgtgtaactagttgtgtaacaagtccccagcttgttagttgtgtaagctgtgacaaatgcacaactcgttagtgtggacaagacctcagcaagatacacactcctagcttctgtttccttatctcttaaatagacataaccatagcaagcagctgcttcattttatttttcaggtctctgctcacatttacctcctcatagaggcctttcctgatcaccatatctaaaatagcatccccattactctgtccttttatcttactttattgttcatttgtgactacctgacattctatcaagtgtctgtttgtttggttggttgtttctctgtacttcccctacccctctcccaagtagaatggaagtttctcaactcagtgtttagttattagcataataatagcccagctatgttgtgaaggtcctgagatttactttatttgcaagctaaaaagttagactgtcacattttcatggatactggcaaaagatagaaaactcctgggtcagaaatgaaggactttattacagcacagcaggcaacatgagctccatgtttgtactggttttccccatgagtcccatgctggagatgtggagtagcctcggggattcctgggcatatactgatgatgtgtcactgctgagaaattccaagcttagaaagccccctatcttataagggttgctaccaagcctttgccccagccaaggacattatcctggtgatgaaacaaatatgccctttaccctgaaaaaagacattgtctctatcttccaaggctgtttgctcgacccacaaatttgcaaagataatctaagacaaaagctgtcatcagacatgtagaagtgtcatggagaattgctatccaattctgcttttctatcctttatcttccatggcttttacactaatcctgcattacaccaaactgcagcacatgctgtttccctttgtgtcaggtagcttcctctctttatgcctcagtgtgtgcttttcattccagagtctcctgggtaacaccagatctcatcttcaagacctatctcttcccctagatatctgcatagcttgcttattcacttccttaatgtttgtgcttagaagtccccatatgaggtgttcctcttatctgaaatagaaacctgccccccacccggcagcactgtcccctttatcattatcaccctatgacatatatatgtcacaatatataatacatataatttatatatatatatatcgtgatactatatacacacacattgtgaaatatatgtcacacttgtctatgtctcctttctctaaaatctaatctctttggaagtaaagacctcaaatgttagatgtgctgctgtaacctcagtcccccaaacactacctagcacatagtagacggtaaataagtattggttgactctgttaattttgcattttcctttctccatggctatttccagatttactaagtagaaagtgatctctgcatccgctgagcccttgttctacttgacttgtctttctctgtgatgataatcctgttctgccccttattatgaaggtacatacctgccccgctcgctagactgtgagcttcttgtaggcagatttgttctcttattccagtggccgcctagtacctcacacagttctttcatttagtaggcactcaatcaatgtgtgttgcatttcatagtaagtagaaagatcaggcagccttaaatatagcattccttttaatacttgtttacttagcatctttagtaattggaatgcactctctaacagaatttggaggaaataactgatgccaattggttgaagctaagggaaaagagatttcagctaaatacaagggaaaacaaatggaacttcccaaggtagtgactgcctcagagattgtaagcaccccatcctcaaagaagctcagtcataggactcaggctgagagactacttagcagaaggttggcagcagattcaaggacagaatgagtgtttgggtggggagtgtggtttgtctaggggttcatagacgtctctcctacaggctagcttctatgacttctgtgtgcatatgcactcatttacccatccatcacataatgacatggagcagtactttctaagcctagaggtacagttttcttttcatccttttgggttgagctttgattcttttggcttttcaatttcacagcaatttgaatacgtctcctttacttctcatgttttcagtgtttgtttacaagtctgtctttctaagagactatgtaaccccttatgagcaaaattcgtgtcttatttaactacctattcctagtgtttgtcctagagtcttagagctccttggattttcacagaatgaatgaattatcaacctaaggttggtcatttctatatttttattactcagattttgaggctctttgctacctggacttgctgagtgacccaggaatattgcctttctttctcacatgatatcctctctactttgctccttataaaacaaattcttctttgaatttctgtagggtaatgatcttgtcattgctaagagtagtgagatgattttctcgtcatctaatacagttctgttatcatagcaagcaagaaagtgagttattcagtgcccagataaaaggaaacatctcaaaaggcaattactaattgcaccatataagctcagtgatgagagcaagttccgtgatgagatataagttgagtttctcaagtaaaaagaggtttgaatggtgggggatatttttaaaataaagtagcagctattacttgccatctctaaagtgatagtgatgaaagtggagttgtattccaaatcacctggggggctcaggcttcctgtgaatggcagcctttaattctaagaaggtaatttaactttcattaaagatcttttcccttctacatagcatagggcctttttctgaacagattcattcccttctaaggttcttcttttattaatcggtaaacatagctttctagatggctatcactataataaggaaagtattgaagttcagaaagctgctactgagaaaaaaaggggcattgtacttttagtccaaagaaaggtgaggctgaatagtaccttagtgttcattctcaactttactttgatttttcactactgtaaaacaagctaccattcttcgcttaaatcagggtaatttcagagagaaaaccagtgccatgtgttagatgagatttagtgactgaatgaacagaatgaaaagacgagtgaatttcaaaaaaattgtcatggttattaacaaaagagagtgcccatgaacatgagggtaaggattaaaagaccacacagagggttttataatctaaaccagcaagaataaagcaagacaaatgtacttatgtgttgttaaagaaataaaaaaaaattgacttgtacataaaggaaaataatcttttggcatctgaaagtgtgaatatggttgagcagtaaagtgattatgaggctactttttcaagtgagatggctggtgaggtttggtggttgagaagtcatcagtccttttcattatgatgtgttgaaacactgaagagtctccagggaccttgatgaccagataggcaaaaaatgaatccttaaagattatgcaaacatgagctggaaggattagtgtctaagaaggggagatcagaaaaatgttttgattatggtgcttttatcttctcctcatttttaaaatttcttaaatatctattcatttattttgtagtaaataatacgaaaggaaatgggttgtactttggcccttaagcactttagtgtttggggtggagtgaaatgtgttttagcctctgtagcatcacttctcattggctgatgtatcattgttgtgaatggcttgttgacatgtcactgggcttacaggccaagtttaacttttcatgttttttacatgacctactggcactcctcattcctgactggtttctgaactggtccacttgatgaccagagagcaagggatgtccttgagcatctttgaatcctgacacagctcctgatatggagaagacgctcacactcagtaaatagagaaatgaactgaatcaggttaatcacaagggacaccggtggagatggtgtgcactagtgcaaatcctataatttgaaggagaacttgaacctcatgcataatgaaggacgagattaagttaatcctttggtataaagggaaagcacatttaaaaaacgaatgaaataatggggcctaatcctcacatgtcacaactgcctgaatgggtagattttatggcaggataagggaattggcattgggattcttaaaggttgcaaaccaaattaggattttgtgatcttctggtgctggttggcactcaattctccctgaccctctctgttgaatttaatttcagctacatcattgttattgttcaagtccaccaagaatttaacatccatcagcacacactagagtagtacactatggctgtgttaaaaattctgttcaatgattgcttatttaactcatgttggctttcttcaattaactttttagtatatcaagatatttgaggttgactaagaaatatgatttttcctcactccccagagctatttgtgtaaaagatattattaaacatcaactattaataggcccaaagattctaatgatgatagcagttatatgttaaagtattattcagttataaaatgaaagtttaacagtgctttaaacatagtaggctccaactatgtgctggagctggcgtgtaccagctcacttgagctgactgttaaaatttccagaattttctgagccagttgttaaacacttggtagctgtaaattagctatggatgtcatggagggagcatttataccagggaaatcagcagtcattacaaatcagggattccacccacctcagcaaaaagccagttgttaaatatttttcagcactctgctggttttcagtcatatttgtattgaatgattttaacataatatattagagtctttgtattttatttttattctgacaactccactgttattgttacttttgctctctttccatagccaattttataagggtaaggacttatacatattttttaaaatacttgcaaaactgcaaatatgatttcaaagaaaattaaattatgaacttgaatagtggaacagatttattgccatctttgggataaaatttttgagacatttaacaaaagatcatataaaagggtaacagataattaagatagaaaacatgaatttttatctaattttaaaaatagtaattggaaaaggattctgttagaccacatgggacagccaggaaactgtcttagaggacttggaatattggaaaataaaatggacaaagaatgggaaagtttattttagaaaataatactttaatggaagggatctatgcaacaaccagattgccacagtgcattaaatgtctcctgaaagagacatgttagaggctttcagatatgcatttactctttcaggtcattagaatttggggatggattgacacattcttagcaaaaatcagaatatgctcatgtttcttaagcagccacacttacttgatatggtcaggtgcagtactaaacaatctaaaatagtacacaggctcttcaatcctgcatctcataatcaggaggtccagaaaacaaaggcttccttttttctgcaatacttagtttcattttcttgggttttctattgtctttggaaagtgatgtgaaggagaataagatggaaagtgcatggaagtcatgagatagagtttaaagggagaaaaaagaaacagaatgagataagatgaggagataaggtaaatcatcatgggtaggaaattacatgtgaaaccactcccagcctccctccacttccagcccagcaatgctactggatagatttccaaagccaaagctatttccagagtggaaggagccagaatccggagtcctgaggcttttgcagcatttgcccacaggtgctgtgaccccagcttaccaatgctcaagaataatggcagtcgtaaacttgcacactatgcaggatcttgaccatcactgtcaaggaaagagagaagctgactttcccaggagcacacagcttattagtaaagctgaaagtaaagtctcttattttccaatttagtgctgtttctagtgtgttattcttggacatcactgaattgaatgtacagcctcatttgttttaaggtgacaaataacctggaaattattcagttgagtgagacagtctgccaaatggttcagagggactcaggactttaccacactgagggaaacccaagactgagaatatacattctttataatagcggtgtattttgagatcagaaagtttaaatgtaatctgcattccataaacttgcaaaggaaaatataaacagtattactttgtgtaaagaaaaataatattgtctttaggtgcctgtcaatatatataatagttattgatttcctaaacaatataaaagaatatttttatactgttttagttgtttctttcttgggctaacatttaaaatattatcaagaactttatcagaaatgctttgtccctagtgaaaggtttccagttttagcatatatccaatgctaaatatatcagttggctccagcttggcattcacagactactttttaatttttaattgacaaatcagaaattatacttatgatatacaacatgatgttttaatatatgcatacattgtggaatgactaaatctggcaaattaaaatatgcattactttacacccatatcatatttttgtggggagaacacttaaagtttactctcctagcagtttccaagtatacgatatattggtttggggttttttagagacaaggtctcactctgtcgcccacgctggagttcagtggtgcgatcctagctcactgcagcctcaagaactcctggggtcaagtgatcctcgtgcctcagcctcccacagtgctgggattacaggcatgagccaccacacccagccctcaggtatttgatatactattgctcattatagtcactatgatgtacaatagatctcttgaatttatacttctgtcctaactgaaattttgtatcttttaaccaacatattcccaattccctcttccaatctctggtaaccacctttctactctccatttctatgagttcaactactatagattccacatgtaactgagatcatgcagtatttgtctttctgtgcctggcttattcacttagcataatgtcctccaggttcatccatgttgttgctaatgacaggatttccttctttttttaaggctaaataggattccattgtgtacatgcagatatatatactatgtttttaacccatgtatctatccattgattgacacttagattgcttccataccttggctactgtgaataatgctgcagtgaacatggaaagtgcagatctctttgacacactgattcatatcctttgatatatacagaaatgggattcttggatagtagggtggttccatctttaattttttgaggaacctccatactgttttctattaatggctgtactaatttacattcccaccaacagtgtacaaggggttcccttttctccacatcctcgccaaatcttgttatcttttgtctttttgatagtagccattctatcaggtgtgagatatctcattgtagttttaatttgcattttcatgatgactactgatgttgagcatatttttgtatacctgttggccatttgtatgtcactttttgaaaaatgtcttttcaagtgctttgctcgttttttaattggtttatgtgttttcttgcaattgagttgctcgagttcctcttatgccagactatttagaaagagtgaagtgtgatgtaggtcatgaagttcagctgcccaggaaacagctgattttcacttatgcaaacttggttctgacttcactcacttggccaccagtgctggcctttatgtgctgtatctatggctttggagtttcaaatttcaatttcattctgttgttctggtctcattagtcccagtccttctccttgaagttagttatttcatatattttaagtcgagagttactgaaaatgggaaatgaaaaatcattagctttacaggaatggggtcataacacactccgcagagggctctgagtcttggatttatctgtgaagagattggatgcagccactttgtggaatgtcccacttcagtttctttgctattacctattcctcctgtgctctgtgctggcacagccatcagatttcagagcaaagggttaatgaaatttcaaacaaccagtttacttttttggctttcttgagaatgtgatttatggatctagaaagtatcaccaagtcatggaagtattttaaggaatgtgttatatgtgacattgtctgttaaatcacagtcataaaattgttactgttcaggcgctgtttagctgtgtgtgttagtttatgtattaactcagatgctgttggatgattagagacccattaagtactatttcaattacttcagtaatttgcattgtgacatttaagttagtcatataatcttaagtaaatgttaagccacagtagagtgtatgtttgcttctgcaagcttattaagcaaggagagaaattcttattagaaaagaaagtaaaggttcatcctaaccagttctcataactttctttaccaaaataacatttaggttttttttttagatattcttcctgaatcttatcatttaattgtaaacttagggtttgtttaaaaaagcaacactgcaaaatagaagccagtcttctttcctagaattgggtcatgaattaacctaaactgtactaagaaagttaaagtgttgatttacttcaacatacctttactgggaccctttattgagcactgaacttggctctgaggaactttttttttttttcttgacttggagtcttgctctgtctctgaggctggggtacagtggcgctatctcagctcactgcaacctctgcctcccaggttcaagcaatccccctgcctcagcatcctaatgtagctgggactacaggcgttcaccaccacacctggctaatctttgtgtttttagtggatatggggttttaccacgttggccaggctggtcttgaactcctgacctcaagtgatctgccagccttgggctcctaaagtgctgggattataggcgtgagccaccacacccgacctgatgacaaaatttgtaaagctcaaatatgcaaagtcaaattttgactgagaagactatattatattccaatttttaatttgttcaataatttgcttgatttttttgattcttaaaagcttcttctaaaacatttatacatttgctaatgtacttaggggaaagttcactgatgttagcaatttaccttgaaatatatatatatatatatatatatatatatatatatatatatatacacacacacacacatatatagacatatatatattagacgattattatatatatcttctatatatatatatatatagaagatggattttgaatagatagagcatgggtagatggctggatatgtgatgaggtgactatggtaaaatgttaatggcagggtctgagtgttgggtatacaggtgttcactataaacattttttcaactttattgcatgtttgaaaatttccacagtataattttgaaaaaagtcatgaatccttctactcagattaagaaatagaatattattactgcttctgaggtcagtttgattttattataaggtatatatttatttttatttgtagcaaagtaagaaataatgtacttagaaatcaaatagtaccaaagatgtataacaaagcagaggctttacctgtcccatctttccttgaaagtcctgttccctagacttccattttctcaaaaatatcttgggtatttacctccacgtttcttaaaaaaatatgtttattttgttatttcttgatttttcatgtttagatttttaacgtttttgataaaaacttgttatctttctcaatttccctctgtcaccctcctgcatccatatcacgaatttttagtagtcagtagtgtttacattttattgcagagtcaagtagtatactattattatttcatttgctgcaaaatttgctctttttgcttggagttattagttgactcatttttaaaattttgctgagttttctatgtacctatctgtttcttgagatatgttaaacattaatcaatattaatttccatattcttaaatgtatcagatgatctaccaattacacttccttcagaaaattcttttggaagcctacattcccctatgcattaggtagggttgaatgctttgctttctgtacagtcatcatctccacagtacagttttaagaaaaaataaaaactggacttccctttaccattttcatgagtgtgttagtccattttgcattgttataaagcaatatcagagactggggagtttatatggaaaagaggtttatttggctcatgattttgcaggctgtacaagaggcatggcagcagcatctgcttcaggtgaggccacaagaagtttccactcttggcagaaggtgaaggggagcctgcatgtcatatggagagagacagagagcaagagaggggaaggaaattgcagactccttttaacaaccatattgcatgtgaactcattactgcagggagggcaccaagccattcatgatggatctgcccctatcacccaaacaccgcccactaggcccctctccaacatgggggatcagatttcaatatgagatttggaggggacagatatccagactatatcaagagggaacctccttttggcttttactactttctagtttttggggaatgtatctcattttttggaagagtttctctgatggtttcctaacaaaggatacatgtaaaataaaaattgtgagaacttgttcatctgcaatatttgtttttattcaactctcacttatgatgttttatacaatttaagaacttttagcagaatttcaaaggtcttgttgcttccagtgttgcaattataaaatctgatgctattctccctcatatttacttctatattacctatttttatttgtttctttctggcatcccgtaggatctattcattatctctgatattgtgaaataattttgcgaatgatatgtattggtgagaatcttttatcattagtgtactgggcactctttaggcactttaaatctttactgccttgttctgttaatttttcttatattatttcattgataatttctttctctttgttttctcttctttgaaacttgtataagtcagatgttgaacctcctatattgatctttaaagtttgtcatattttctatttcttaatttttttctgacttactgagaaattaattttaccttttaataaagtttttttttaaaatttctaggagctttaaaagttctttattttttggtgtttatttttcagaatactctctttctttttgtggatgtaatgtcttaactctctgaggaaattaacattttttcatggtcaattacactttcccaaatttaccttttattttcccattttaaatgctgtaaatgactgtatctttactttctaacattttctaaaaggaagttcaagaatttttttaaagaattaatggctttcttattttaactgctttccagttaagtgggatgtaaaacaaactttttttccctctaaatattaagtgcagtgatgttactccatctgattttaagtgggccacagatttaatttgagtgaacaaatatatgcttatgtagaagaaagtgaataattctcaataattgggtattagaccaccttaaatgtgtttgaatgttttctcaccagaattcatttagaaagaaaagttattaaaatggaacagaacagacaaaaaattcttttgatttcttgctctaacttcctttaaaataaatgccttgagtttctgttatgatccctttcttcagggatgcagagtgtgtgagtcagaaccatattggtggctccattagatgcctactagagacctctttcaagagggaattcattgaaagcctctggcttggtagtgttgactttcacatttagctgtgttttatggttttgtagctgtttgtaccctttggaagccctgatcataatattgttatttgaacattttctctcctccatgttttagagaattgttgggacttaccttaattgacagctttggtcaaaaataaggacacacatagaagaacaatggttgtattgtggataggaggtggagaatgtttcattggtgggcaattttgactgtctaaatttaggtggtggtttcaaatttagccactagtttctcaaccaatttagtgagcaaacatccctgttttaaatcaggttgcaatgaaaaaggaaatgagaaagtagttttatccatactgtatattgtgagaaatacagacagacataatttaataaccatgtttaataaatttaggatatgcgtggaaatggcctgtgtcagtcccacacaaattgtcctcaatcaggatgtaaaactggacaggatgccaaatattccctcatgtgtgatccatccttgccttgtgtgttaccatttcttttggagtaaagacctgagccactgaagcaaagctctggctttacactgtgttcacagcccccatttgtcctgtccccaatttgaattgttctagtaatgggaggaacagagtagccaagggaatattttccccaaatatggggcaagagaagaagagacaataaaaattccttatagatagagtcatttttgagagaatgaatttgtattctcgtattcttactaatgcataattgttaaagatatcatttatcttactagaagctaaaatttgaaatatttcagcatttagagtgtataaaatttcattaaagtgagtggattgaagtataggtaactgtgtatgtgtgcatgtgtacaagagtgtgtattaaaagcaccgtgaataaactccacagccatggaattcaagcagagtgtttaaaatacttggaaacctagactaaaatataattctattttaaatattctggcatttagaatacaatgaagcaggttaatatattcagcttcctttttctttttagagaacaatggatgagacaaaaacaatctaactgtattacaaatgtatgaaacaacctcactcaagggggtggaggtgctgaacaaagtaacatcggaagtgagtgaaatctgtaagatgaaggcaaaaaaagctgtacataattattgtcctgtattttaaaaagttgtttcccgtaggagtacaggttaacagttctgatgctactatagatgtatgctggaattggacagttaagtaaatggatgcccgatggtggaagccaggtactcactgttggagtggaatgttacagataagcaaaggaggagactaaaatgatgcaagttgtagattagagttggagacatcagtatgaactcaggtttagtttagtatagacacagatggttacatatagaaatatttttcagtacgtatatatacattggttggtatatttctttgctctatcaactgagagggcctagtagcaatgaacacatataatacctggattttggtgtttaataccattctccaatgaaagggaacagaggtccttggaaaaatgacttattctaggactagggaaggaaatatactgatcagcctgaagaatcttatagtgccaaaaagtaagcaagtgctaaaataaaaacaaaataaaacaaacccataatgatggagatacatcaaaaggacacaggaaccgatttaaaatgctcacaatggccaaactggaacaatttgaccaacacattcaataaagtagccttggattataacccaaagtataaagtaaatatccatggttcatactgatataaatagattgaataggtagtaagtgggggaggagagataaatctccaagaatttcaaacaatttaggtagatattttgccctgaaggaagtggaacataactccccactccttaaaatgtgagttgcacatagagacttcattccaaagagtacagtatagaaaggagaataaaagattaacttcacagttgaaaaacctgtcaacactactcagccaggtgaatagagtcaacatcaatagtgataagtcatgctgatagaatgaactcttgacagtatgcacttagtgttataaggatgccgctttacccctgtagtcttcctccccaaatcctataatctcagttttaccatgaggaaaaccttgacagtttgagggatactactcagagatttgcagggtattcctatggaggatcctaaaaactgtcaaggtcatcaaaaacaaagaaagcctaagaaactgtaatagccaaaaggaccctaagaaaacaacgactaaatgtaatgtggtgtcataaaggagatcctgtaacagaaaaaagtacttaagtgaaaactaagaaaatatgaatgaaatatggacttcagttaataatccatgcattaatattggttcatttattgcccagaccaatgtcaagaagcatttctcctatgttttcttctaataattttacagtttaaggtctcacttttatgcctttaatgtggaggtcacttgaactcaggagtttgaggttgcagtgagctatgatcatgccactgcactcccacctgggtgacagagccagaccttgtatctaaaaaaaaaaaaaaattaagtttaaatttaaaaagaaaagttgtctgtattatataaatatctgctacttagtaaggccatcttcattttaaatttagggaaaatatactttattagacactgcgttcaaaagtgttttgctaataaattcataaaaatacagcaacatatttatgtctcttagtcatactttcagaatttcatgattaaattaggtctttgtttagctggatcaaagatttttttttttaccttgtcgcttagttttggaagatagaagggcagtgtatttgtatgtgtgtgtgtgtgtacatgtgtgcacagtaaccctgtctatgcaatactttcaacaaaacattttaccaagaaaattgacagaaatttaaataaaaagggaatttttaaaagtcagtgtttgcctctctggtttagctttagaagaaagtggtgctgaaaaaaaatcaccgatgttcgcacattttgaagagtgtgaattttattcaccaatttgctttttataccagaggccagctgctaccttttggaagagtgaaacatttcagccagaattgcctgcagctcagtatagctccaatggcagaagaaatcctaccagattatgtcctttgatttttcacagattttgttcagaggatctggcaatgggttgcagtttcacacttcagaaatacatggtggccaagagttatttctggagttttcttttaaagccttatcagttgttgagattctctgtgctcctgaatccatttcctactcattccttacctgaaatgagatatttatatcttttctaagttgcttttaaatttgaaaactgcatcttctacaacagtgacagatcaaaatgccagctggacatttgataggattcttcattggtaggcgcctgacgaatgactactaagtcatgtgaaatactttctttagtcataggacatggtgctgtgaatcatgaaatgttagacataaattttacacacaggggattacattctaaaatgagtgctcaagatccttggctgtggaattagagaaacttcattcaagtcttgaatctgctacctcctagatatttgaacacattcttaactttacacctcagtttccttatctgcaaaatgaaaaagaaaaatagtgtctaacgcatgaacactaattgttgtagtattaaaggaggtaactttgctgtgcttgtcatagcgcttagtaaaattaaatagatattaagcattttcattatcatgctggcatttatggaagacatgccagctacctacccacctacctgaatagcatcaccaaatatgttgcttctaaaagatcagttgtgcataagttgcttaggaacatgtactggaaaagcctctgagattatgcatttgattaaaacaaaaacaggtatgtgccaaagaatatcattgctcctttgggatcttgacttaaagttctgccccataggtacctcagtattccatctctcacttctctttcctgaccaaagctaagctctaggctcttgttactgtatttggttctccaggattctctgccctgcccctgggaggctctcattcctgtaaccaggaagcactctggaagaccgaaccatctccgggccttaaaacaaacctcaggggcagggatggacccatggtggggacagtgacctgtcctgcctcttcattcacacccatctttgggaactgttaccagcttagcaagcaaggtaacaagtcactgagcttttatgggacccagcttccttgttcataaaatgagaaagctaccaaagatgaggttgatggtctcttgcttctccattattctcttggattcaataaattactggacatatctaggaaaaataaatgtcacagtcaccgcctccaagaggctttctttgttcacaaagtcttccttttattaccactcaggctgcagtgagctgtatcttaaaagtcttaatgtgtctctgacacattataagccatacccatggaaccttggaagttctttttttacagtaggggattagattttctttctattttttaaattttctttttttaattgatacattatcacatacatgtgataattagataaattcatataatgtgtaaagatcacatcagggtggccgggcatggtggctcatgcctgtaatcccagcactttgggaggttgagacaggcagatcatctgaggtcaggagtttgagaccagcctggccaacatggtgaaactccgtctctactaaaaatacaaaaattaactgggtgtggtgatgcacacctgtaatcccaggtacttgggagactgaggcacgagaatcgcttgaacccaggaggcagaggttgcagtgagctgagatcgcaccactgcactccagcctgggcaacagagggagactccatctcaaaacaaaacaaaacaaaacaaaaaccacgagaaaaaaaggtcacattagggtaatcgggatatccaccaccttaaatatatatcttttctttatgctaggaacattagaaaaattctcttctatttttaaatatgtaatatgttattgttaactatactcaccctactgctctatggaacactaggccttatttattctatctaactgtgtgcttgtacccttcaatcaacttctttcatcctcctcaacccctaccctttctggcttctggtaaccacagttctattctctatcttcatgagatcatttttttttaaagcttccacatatgagagagaacaggtgatatttgtctttctgcatttggtttatttcacttatcataatggcctccagttccattcatgttgctgcagatgacaggatttcattcttttttatggctgaataatattccactgtgtgtgtgtgtgatatatatatcacatttttctatccattcatccattgatagaaacttagattgattccatgtcttggctattgtgactagcgctgcaatagacatgggagtgcagacatttcttcaatatattgatttcctttcttttggatatacacccagtagaggaattgctggatcatatcatagttctatttttcattttttagaaagttttttaaggatagagataatgctgtttttaaccttcctaaagagctttaccaacaattacattcaaaattaacgtattattcattaaaattataaatgtatagtatataaatgtttaacatgtataaaatctgataacttaatatgtaaataaaatgtgactttctatgttatatatatcatatataccgtatatgatcttatacctacacatacacacacatatacccttttgggttcaaaagcacataaaaatataaggagtcattgtgattacaatccgtagtaaatggtggtctagtgttatgtagaacatcaaggtatttattcgacttgccgttcaaggagtccaagaaaaaacataccacactgacacaggacaggcaagcccccaaactggggcttagccccaaaggattcctggctttgcccaggaaagaattcgaggtcgagccggtggtgttggacagcagggtttattgaagcggtagagtgcacagcagcagcagagatgctgctccttgaggagagggctacctcttaggcagtgtgcccagaggagcagctcagaggcagttctgcagtcatatttatacccactttttatatgccaattaaaaggcagtttaggcagaaacttccaggttgtgaggttgtttccatggaaaggggtggtaacttatgggtgttatggcaatggtaaactgacatggcacactgatgggcatgtcttacggggaggtgcttccaccccagcctttattggtaggtgcttctgcctctgttttagctagtcctcaatttggtccagtgtccaagtcctgcctccagagtctagtccctcctcctagctcaatatccatggaaatattatctatttggataatgttgttatctttataactatcacagtgtggccaagaagagagataacagaggttaatctctctgataccttttttaagtagtatataattcaaattgccctaaaacttatgttgattataattgaccactgcttgtctaggaattgtaaggatacctaaaaaagtatgtacgtacttttgccagtgacaaaagtaacaacctgaattccttttgcaacaaaattatatcagcacaagccagcatggtggcttttgcctgtggtcccagctgctcgggaggctgagggaggtggatcacttgagcccaggagttcgacgctgcagtgagctaagattgtaccactgcattcctgcttgggcaacagagcgagacactgttttcaaaagaaaaattacataagcacagactggatgttaaataaataattagattcaagctttaaattatttggaccctttccccccaatactacttaatagcaatataaactttaaaaaatgatgggagccaaagaacaagataattaaaaaatgagttatccagtgcttcatttgtggtttcagtgtgggtagtaagacataggttttggttccaaattaagttttcaatcttaggagggtcaaggcagacataaaaagattattccaaatatcactgcaaaacattatgaaacagatgctatagaaagaaaaggagtgaatgagccagggagaggcaaagagagaaagagagaagatggacagggagcaagtgaaagggagagaattagctgattcgcagagggagagacacaatagcagacaaaggggcagccatgggcagcgatgtgatttggtgggcaggactgactggaggtgggagggtcttgtgctacccccttgatatttggctggtgttttcatggtcatagaggagagggggttgcagcaaaggaggaagccacagtggtttgatgcccagctagtaatatgctgcacgtgtgacctttccgcctacctaagcctttccgcttttataactggctcattccctgagctcccttcctgaactttctccttaccaacaccctttctttcaaatgggaagaggcggcgtgtgctggaaaccattttccctgattcttgttaaatatatagaaatttcgtgagctggtggttaaactgttggtagcctgaaatcagtcctggtgggaatattgacaccttggaaattgatgagtgagagctttttattttcccctcaagagtcagtttacctgctcaccactaagagaggacttgcctgggtaaaaatttcctgaaattcatatggttttcctacttattcatatttgtgattgatatcatgacttaagtccttcaaaatttcaggaatagaattgactgttgggctaattttttaatttaaagcagtttgtaaatccaagggacaaacatgtccatttaatatttaacattaaaggaatgcacgtcacttctaggagatcatcacagggagagctggggaaattgaagagaaatgactttagagatttcaaaataaaaacaaaagatacaggaaaaatatattgtacagacttagtcataattaaaccaaacttgaaatgttaattttaattgataataactttaaaattctaatttaatttctattgattctattctgggagaaaacaaccacgaagtttctattatccttaattccggttttctttttaatccttatgattgcattaatatacacgatacttctttttagactggagactaatttgtttaaaattttttatattcatgacttcagtgataaaattttgagttagttttgaactaagtacccagttcgctactggccaggcctggacaaagaccttccctcctggctcctgctttttctatggtgtttcttatagatttaaaggatggccccattgctcattatctatcaagcttatattattttccagaagtgtgcaaaatacttcatatttgtttgcaaaatgcttcatatatgataaaggttttgcttttgttgcccaggctggagtgcaatggtgcgacttcggctcaccacaacctccacctcccgggttcaagtgattctcctgcctcagcctccctagtagctgggattacaggcatgcgtcaccacgcctggctaattttgtatttttagtagagatggggtttctccatgttggtcaggttggtctcaaactcctggcctcaggtaatccgcccaccttggcctcccaaagttctgggattacaggcgtgagctaccgcacctgtactcatagtcattgagtgccagtcctgtaacagactcaggttggcactttacatattttatctaaaaccctacagccgtcccatatggtaagtattattactccccactcagaaaatattgagtggggagtcacaccaatattgagtcacaccaatattaagaataaatggtttaaactgtttgattccaaagcctaagttctttaccctatgccagcctgcctcctatatattatgcgattttaatctgcctattaccttatgaaatgcacagaaagtattatcactactttatggattaagttttagtcagatagctagaaatgtcctctgacttcctgtccagtgatcctccccagatggccaaaattacatgggcaataacaaaattaaaataaggtcatcatatctgacttaatgtgaaactttagtaggacattatttcaaactgacaaaagcttcttctggattgaacacaaactgcatgtaaatgtcgttaagtggttcatattttaaaagcgtgagtgtaggccaagaaagaaatctccagctactgtttgcctgcttccatcagaatgatatgtttggcgcacagtgtgttttgtatatcagtcctgttgtttatgggaaataccattcctcacccatccacgttcccctgttactaggtcccagctactgccttacagagaaggtgatgtttcatatttgcttgcttgtttgtttgtattataaggaattattcttagcgatgttaaaaatgattctttcccatgcaaggaacttttagacacccaagtttacactctgcatttgcgataaaaggaagtaggaaagtggagcaggagcaaaatgcagaagacaccaaaagaacctttgcagagagagtgtcctgccagggcatcgacggccgctcccggggcaggagctgagttaagtagagccccagcactactttcctttcctgatgtggctcaagggatcattgcaaaaatggactgtcccctattggaacataaaaaggccaaatcagagtccatttgacctatatcctttaaaactgcacaactgatggcgggtggtggggtgggggttgttagaaagcagttctaagagccaaaccgaatggcatggcatgaatctcaaatttatttcactatgattacaaaagcaatagctacttggatgtaaaagaaaaactgggctgggcgcagtggctcacgcctataatcccaacactttgggaggccaaggtgggtgaatccacctgaggtcaggagttcgagaccagcctggccaacatggtgaaaccccgtctctactaaaaatacaaaaaattagccgggcctggtggcaggtgcctgtagtcccagccactcgggaggctgaggcaggagaattgcttgaacccgggaggcagaggttgcaatgagccaagatcatgccattgcactcctgcctaggcgacagagcaagaatccgtctcaaaaaaaaagaaaaaagaaaaaaaaagaaaagaaaaagaaaaaagaaaaagaaaaactgatttgtagaaacataatacctaatttacagttgacaacccactgtggggttctaagccacccaggggagtgaaagaaagattaatgaatggtttaaaaggggcctgccccacagacctgtccccttcccttttttctcttctccttccacctaaagtgttgagctgcacatccagtctgacctccactgctgagacctcacgtctatcaggtggggcctagcagggatctgggtgggaggttcagtcagatgcaaacagcagccagctgtgtagaagccacgtgcaaagcagttcctcctgcgctgacatgacagccacgcgtttcaacaacaaccacaacaaatcgcataggggatcagaagaccatgctattccattttacactaaccacttaccagcagcctcccaggaagtcatcaaatacgtcactgtaaataatactgaggatgtcaaaattcatctttacaacttaacaaatggtacttaattatctaataagaataaggaacctttttatattgtcaaacgtattaccaggaaataatttaaggcctgctggcaataaaatcacaggactgatcttttaaaatcgcatttgatgacatatgtacgaacacatacacacatatatatgtacgtacatataatttgtgtacatatatatctaaataaaccccaatcctttgacaccattaccactgcagagttcaagctacttggagccgtgttatagaaaagcaaaatacttttgaagctcgtcttttttttttttttgtggttgatattggacccagtccatgagcctcacaagaaaaatcactcttttgtgcttaaaactttttagcctaaatggaattatccagtttgatcacacacattatttgctaatttgattttggctattttccaaagtcaaatccagattcaaaggatgatgactcaccactatttcgggtttttgaggaaatgggcccaggctgtgaagggctgaaactccagagacggagtctgagcaatcactgtggtgctgggaaaagcgtaggagtgaggactgttttgtgtcatcttatacatggtttagaaataagtcctgtggcttatcagttatacctgcagaacacagggcaatgttctttcttcgagttgctaagggaacaatgcctcccaagacgcagaggtctgaaataacaaggtgctgggccggcattgtgggaagtgtggcttggtgagagcacagcaatgagtgaatgggatgggagctgatcagttggggagattccctgggacctgcctctctgctgcaggcaaaaaacctgagaaacgtttattctatttgttctgtgccctatatcgataacttttctctgttgaaaaagtttgctttgagtataatatttatttttagtaatgtactgtccccaaatttgaataatgaagatactgttccctaatggtcaagtactatccagactcagtgtgttaaaaagaaatgggtcaggcatggtggctcacgcctgtaatcccagcactttggtaggctgaggtgggtagatcacctgaggtcaggagtttgagaccagcctggccaacgtgatgaaattccatctctactaaaaaaaaaaaaaaaaaaaaattagccaggtgtggtggcgggcacctacaatcccagctacttgggaggctggggcaggagaattgcttgaacccaggaggcagaggctgcagtgagccaagatcgtgccactgcactccagcctgggcaacaagagcaaaactccgtctcaaaaaaaaagaaatgaggaaacagaaacaaagcaaaagaccattggttagctaatcactcttgaatgtttgaatatgagctcttacagagtgacagtggggttcagacaggtgcattcttttggtctgaattagatactcaataatgaaacaatctggtgattgtttaacactgcttcattcaacgtttgcaagattttgaatgggtaaagcctcccttggacgtgctctattttcaagcaactaaaactcattaatgagttcctggcctctgcgtttgtagatctgggtcagtggcttaggtccatgctgtgctcactgtgttatcttggacaagttacttaacctttctgaaccgtgtgtgtaaaattaggttaattgtttttgcttcccagggttattgtgggggttacatgaaatttaacaatttgtataagcatatgacaatatctggcatggaagagaccttcaaatccaataagaaatggaatgtaggtatcactaaatatcacatgaacattttaaaatgttatttgtaatgaaaattctgtggaacagatcttgtttttccattggtttctaatacataatggagataaactttaaccaaaataccccaaatagaactgggcctcctaatagtccatcggactctcttgagcctttcctttgctatgattgtgtctcaaaatcaggttctttgagagcactgggattctgcttgtatctcaaaagtaatacacaattgctttgtttagtagagtctagtatttaacattaaaagtgcattgaatttaccttggcaccatgctaatacaaattataaggtaatggaacgttatgagatacgtgtattcattcagcaaatattgtctggttcactgcaagacactggggaatgcaataaggaaaataagacagacccagtctctcctgctgtgacgctgatagaaaaacagacttccaatggataaccacacaaacacatgtgtcatgtcatgtcactatgactcatgttacaaagcaaatgtatatggtgccgtgagagtgtgcaatagagttgaatctgaccagggaggtcagggaagtgattcctgagctgaggactgaagaaagagtaggtgtcactgttaccggaaagagtcccgatccagacctcaagagagggttcttgaatctcgcacaagaatgaattcgaggtgaatccataaagagaaagcaagtttattagagaaataaagaaacaaaagcatggctactgcataggcagagcagccccaagggctgctggtcagctatttttatggttatttctggattacatgctaaacaaggtgtggattattcatgaattttctgggaaaggggtgggcaattcccggaactgagggtttctctcctttttagatcatacaggctaacttcctgatgccatgtcatctataaaatgtcatggcactgatggaattttctcttaacatgctaatgcattataattagcatataatgagcagtgaggacaaccagaggtcacttccattgccatcttggttttggtgggttttggcaggtttcttcatcacagtctgttttatcagtaaggtctttgtgacctgtatcttgggctaatctcctgtctcattctgtgactgggaatgcagcccagtagacctcagtcttattttacccagcccctattcaagacagatttgctctggttcaaacgcctctgacatcacctgggtgcagataagatgagcatttcccaggccaagaaacagcctggagggcgggaggaagcaaggcaaaggaaacgaggaagttcagtgggtatggaacagggtgaccaggagtctcatatgaagctggagaggtcaccagccctgaagggctcctgtgaaggcgcaaagggaaacgtggaacattgaagtccatgagccatgtggtcagatgagcatttcaaaagaccagcctgaagtctctactgtttggaaaatcataacagaatctctgttttggacttagtcaaatctcaaattataattccactatgcagttggattttagaaaaatcaaatcttaactacaagtggtgtatccattacaagtagacactgagctgctattttttatagtcagtagttaagtccacaagaaatgcatattacatttcatagtaattttaaaatacctggaaagctgaaaagcaagtcttctaaaacatcaacttgattaacttaaaaatcaaatatgaatcacaacaaacaacagaatataggtatttaggccaggcatggtggctcactcctgcaatcacagcactttgggaggctaaggcaggaggagcacttgagcccaggtgttaagagaccagcctgggcaacaggaaaccctgtctgtgcaaaaagtacaaaaattagccaggtgtggtgccatgcacctatagtcccactacttgggaggctgaggtgggagggtcacttgagcatgggaggcggaggttacagtgagctgagttcacgccactacactccagcctgggggacagagcaagaccttgtctcaaaaacaaacaaacaaacaaacaaaagaaaatagatatttgattgccccagctaatgtactaggtaaagaaatatttttcttcacatatagaaattcatggcaccttaaatacttaactcatctcttctgtatgcaccccagagctgcagtaattatcttggaggatcagttgttgacatgttcattccaaataggcatgtgttgaagctattcgatttattcactcaccaaagctctgtaatatttcccagatcatgtcttagcaatgcatatccagttttattgcatttaatgttggtatggagcagcagtccccaacccccaggcctggtggcatgttaggagctgggctgcacagcatgaggtgagcagtgggcaaggaagcattactgcatgagctccgcctcatgccagatcagcggcagcattagattcttacaggagtgtgaaccctattgtgaaatgcacatgtgagggatctaggttgagtgctccttatgagaatctaatgcccgatgatctgaggcggaacagtttcatcccaaaaccatccatcaccccacccccatttctgtgggaaaattgtctttcccaaaactggtccccggttccaaaaaggttggggactgctggctatagaggataatgctacattgaaaatctctccatgtgaaaatagtttgaatccttagatattagccccatcatttgttagtatttgaaacagagaagttagaaaaaaatcaataaaagaattttaatatcttttaaagtttttttaaataagtagatttgattataactcaaggatgggtaggtctctatatcaatataccttgttttggattaatgagggatgctgatatatttttacaacattatattcatgttataagccaaccatcaactgcattatactggttcattataagaatgcctgagaagctgttgactaagagtgtgtctgcttgtattgaattttgagcagttatgtttccaaggaaaccactccattgtcaacaaaagattcactcaaagcaatgcaaaaacgtttgccaaaaataatccaaccttattattaaatgtgacttcaaatgtcctccacagccctaaagcaataattaaaaggggtttacattttttgtcgattccatttaataaattcaccataaaatgtatttcaaataatcatttaagtggtagaaagtaaatgatttacctgaaagatatatccagttttgaaagttaatgtcttagatgtagtatggatctgctaatgaagaattgattagatctttgctttttctattaataaatctgtagttgtgtatagtgaaatcttatttgtctcaaattgttgacagttggctgtgggttgggttgtagtttgtttttgcattatctatgaagaaagtctttgcaagtgtaaaattcttaatatagttgaagacatttttgcatggccatctttcaatattcactgctctagcatattctttaaaaaagctgacaagtgtcaggttatttctaactttaataatgccagatcaacacatttcctgcccaatgttaaaatcattgaagcaaagctctcaaaatacctggttcacaggcacaatcataggcttcatttttatttgtaatcatatatgtaatatgaataaatgtatagctaacatgacagtttgtttcatttaatgtgcttaactttgggcaaatttacctctcaaactgaattgatggaagtttagtgaaaacacagtgcatgtctttcctctccccccaccatgaccatcctagatcaagtcctaattatctctgacttagatacgtaaattgttgcagttagagcactttgcaatttacctctgtgttgctgtaacagtgatcttttggaaacagattaaatcacgtctaaatttttttttatattttaattcagttttgcttcataacatctgaagtacttaatcatggtggtaaaagctgtcccatctttctctcccataccattccctttaccattcttaccatgaattttcacaaaattgccttacactttgctaattagggacattgcctataaatgggcctatacaatatgtggcctttggttcgttttgcattcttttgcctgaaaatttatcgtgttttcatgatgcattcatgttatagcctgtcagtggtacttcattcctttttatggctgagtaacattccactgaataaatataccacgttttgtttatcaattaatcaatgatgaacattaaggttattccaaccttttgtctattaggaattatgctaaccatgagcattcatgtacaagtttttgtgtggccataggttttcaagtttcttgggaatataccttcattctttcacatgtgggtgtctggttgtcctagaaccatttgttggataggatattccttctccattaaattaccttggcatccttatagaaaatcaattgaccagctgggcacagtggcttatgcctgtaattccaacactttgggaggccgaagcgggtggatcacctgaggtcaggagttcaagaccagcctgaccaacatggagaaaccttatctctactaaaaatacaaaaattagccaggcacagtggcccatgcctgtaatcccagctactcaggaggctgaggcaggagaatcacttgaacctgggaggcagaggttgcagtgagccgagatcgtgccattgcactccagcctgggcaacaagaacaaaactctgcctcaaaaaaaaaaaaaaaagaaagaaaagaaaagaaaatcagttgaccataaatgtataggtttatttctggcttctcaattttattccattgatctttatgtctgtccttatgtctgtatcatactgtcttgattgctttagctttttaggaaattttgaaattgggaagtgtgtctccacctttattcttctttctcgggattgttttggctattctgagttccttatatttccataagaattttagatcagtttgtaatatctacaaaaaaaaaggcagctgagattttcaatggggataatgttgaatctgtagaagaatttggaaggggttattgccatcctaacagtattacatcttcaaatccatgaacacaggatgtcttcccatttattttggacttctttaatttctttcaacaatgttttatagttttcattgtgcaagtcttatccttctttagttaaatttatttctaactctttaattctttttgatgctattgtgaatggaattgttccttaaatttatttttagatttctcgttagtttatagaaatacagttgatttttgtatattgattttgaatcctggaactttataaaggaactcgtttattctaacagactttttgtgaattccttaggattttccagatacaagatcatgtcatgtgaaaatagagagttttatttcttcttttccaatctggatgccctttctatcttttcttgcctaattgacctggctagaacctgcaatccaacactgaatagaaatgaggagagcaggccaggcacggtggctcatgcctgtaatcccagcactttgggaggcagaggcgggtggatcacgaggtcaggagtttgagaccagccttgccaacatggtgaaaccccgcctctactaaaaatacaaaaattagccaggcgtgatagtgggtgcctgtaatcccagctactcgggaggctgaggcaggagaaccacttgaaaccagaaggcggaggttgcagtgagctgagatcccaccactgtactccagcccgggcaacaagaaactgtctccaaaaaaaaaaaaaaaaaagaaagaaagaaagaaatgaggagagcagacatcttcatcgtgttcccaatcttagggggaaagctttcagtatttctgtattaagtatgatattctctgtggagtttttgtggatgctgttttatcagactgtgaaaagttcattctatttccagtttttcttactgtatttattatgaaaggtgttagagtttctcaaatggtttttctacttatattgagatgctcaagtgggtttttttccttttttatcaatgtggtattacattgattgatatttggatattgtgatggccaactttccatgtcaacttggaggatgttttggataagattaacattttaattgggaaactttgaataagcagactgccctccataaagtgggcagtcctcattctattggcctaagacctgaaaagagcaaatgacccaccttcttgagcaagagggtctccaacagactgccttctgacttcatctgcactgttggctatactgggtctctttctgctggtctttggactggaactgcaccatcagctctcctgggtctcaggctaccagcctttggaatagacatgcaccattggctctctagggtctctgcctgccagcccatacactgcagatttgaacgtgccagtctccgtaatcacatgagctaatttcttacaataaatatctttatatatgcatatctgtatctgtctgttgaaccaactatctatgcacatctatctatctctccctacagatatctatcctattgattctgtttctctggagaaccctgactaatacagatattaaaccaatcctgcattcatggaaataattcctgttgctaatggtatacactcctttttatatgctgctcaactcagttttctagtattcggttcagcattgttgtatctatgttcacaagggatatttgcctgtagttttcttttcttgtgatgtgtttgtcttgctttggtaccaggataatactagcctcaaagaatgaattggaaagttttatttcctcttttttggaagagtttataaagaattgttgttcattttctttacatgtttgatataatttattagtgaagtcatatggtccagagatttccttgtggaatgttttttgattactaacttattctctttacttattacagggtctaattagattttttacttctttggtagtttgtatattttaggaattcgggcatttcgtccagattatctaacttattgatttacaactactgttagttttcccttttaatcctttatatttctgcaaggtcaaaagtgatgacccctcttttactcttcatcttagtattttgagatttctctctttttttctcaataagtttttttttctagctaaaggtttgttaattttgttgatgtttttaaagaatgaatttgctttcattgatttttctcaattaaaaacattctgtattttatttatgtctactctgatttttattattgctttcctcctactcactttaggtttagttggcttgttttccaatttccttaagtggaaagttagattattgatttgagatctttcttttttttaagtaaaggttttacagctatgattttgtccctaagtattaactgcatcttatcagcttgtgttgtgttttcattttcgttcatcttgaactattttgtaatttccattgtggtttattctttaatccattggctatttaggagtgtattgtttaatttccatatattcataaatttctcaaatttcctttattaatttctaatttcattccaatgtgatcagagaacatactttgtatgatttccacccttttatatttatcaaagtttattttatggcttaatacatggtctatcattttatggcttaatacatggtttatcctggagaatattctatgtctctgttgagaagaatgtgtattctgcttttgttgggtgggctgtactatatagttctattcattctattgttttatagtgttgttccaatcttccattttctttttgatcttctgcctagttgttttatctattatttgaaagtacagtattgaggtctctaactattattgttgaattgtgtacaggtcccttcaattctgtcagtttttccttcaggtagttttgggttctagtgttaggtgcctatatatttcttaattaccgtatcttcttgatggattgaccctttgtcgttaaaaaatgtccttctttgtctctaggaacaatttttgccttaaaatttattttgtctgatgttagcatagccactccagctctcttttggttacttttggcatattatgtcttctcattcttttacttccaaactacttgtatctttgaatctaaaatatgtattttgtagatagcatgtatttggatcatgactttaaagaaatagtctgccaattctgcttgcaattggagtgcttagcccattaattaatgtaattactgataaactagaatttctttctgccattttgctatttgtttttatacattttaaggcttttctggttatcttactccattactactttttttttcaattaaataagtgttttctagtacataattttaaacctcttattgtttcttttacttttttttttattatttttatagtggctatcccgaggaatacaattatcatcataagacaatctagtttggtataatgccaatgtaatttcagttatataccaagactttgctccaatatagctctttctccttcctcctcttttgtgctattattgtcacacaaattatacctttatacatgaaggcggtgttataattgtagctttatgcagttgcactttgaatcagatagaagaaaagtgttacaaaccaaaatatatttttactgtatttcacatttacatacttatatatttgcctatgtacttggttacctttgccagtgctccttagttctttatgtggaattaagttaatgtcttgtgtcctttcatttcagcctgaaagagtctctagtgtttcctgtaaggcatgactgctagtgacagattttctctgtttggggtttttctttgtttttgtttttgaaggatagtttagctggatatagaatatttagttgatagttttttttttctttcagcaccttaaatatgtcattctgctgccttctggtcaccaccgtttccaacaagaagtcagattttaatcttttttagactcttattaagttgtatgcttgctgatatcttgcaggtcactgagggactgttcatttttcttcattgttttttcttttttcgttcttcagactggataatcccagttgacctggagacaaacaaatgggaataggggaagaaaaatgccacaaagctgactcttcttccttagagtcagctgtttaataaatgctcctcaaattggtgcaagcctttggttcatttccagacttctaagaaaagtttattttgataactttttgccattgtttttatttctatggaggagccattccagaagtgcttctttatcatatatttttttaactcaatgacctaaggattgtgttcatcctttatgaaagctattcaataaccatttatcatcttaatccatttgtattactacaaaagaatacttgagggtgggtaacttatagagaaaagaagtttatttggttcacagttgtgcaggctgtacaagaagcatggcaccagcatctgcatctagggagggcctcacactgtgtccaatcgtggcaaaaggcagaggacagccatgtatcacatggcaagagagggagcaacagagaaagatgagggaggtatttaacaatcatttatcatggaaactaataaaacgagaactcactcattactgggaggatggcacaaagccattcatgaaaaatccacccccatgacccaaacactttccattaggccccaccttcaatattggagatcgaatttcaacctgagactttgcaaggctaaacaaaccatatataaaccatagcattgagtaatactatgagccatgtatcggatgctgaagattacaatgtgcctttcgctgtcttttaaaactcagtactgcttacattagctccttttgtagttgcaatttttgtattgccaagagttaggagggattgaataagaagcatatgaagaaataagcagaaaaagaaaatctctagcatagtacacctctaatctatacatgaaacatagttaatgtgatgatgtttagaatcgtgataagtgttctcaggtacatgaagcttcagggatatgaagaagaggtgatgtgaacaaagaagtgaggtcattattatgtaagcttaaacacattgatgcatacattagtgatgtatatatactgtgctgtgtagtaagtgaagaaacaggctgacaatacttttgataagactctggataaataattatctgttaatctatcagttacactttttcaggtctggcatttggggctagaaggagaaaggttcagtagaaaggtccaaagcttaaggaaacagtggccaagttatttgaaaactgagttctgttttctacataggcttggatcttgggaatacgggatagtttgtttttaatcacaggaaccatcttatcagtttctataataactaaaagaacaaatatgagaaggttaaggaacagcttaattaaaatgttggagaaaatgacagaaataaattaattcagagagtgcctttgacattaatcatggaaaaaatgcatctcattttggtagcatacttagaaaaagcaaaataagaataaatttgcatgccaattagatgcaaagataccacacatacctcaagataaatttgagatcctgaaacaagcaattgggtctataatattttgtaacatattcatttggatatgtgcgctatctgcatttttagtgaaagaaaatgcattcaatcaagggccatagagagagtgctatcaacaatattccaagttctaaactaaattgcagaagattgtctgtgcaagttcacttataatgtgtataatttatatcacagcaaagtaaatatggatgaaagaaacatttgaatgagaaagggatacacttttaaaattttgcccaacattttatacttttggatagctaattttttatttaaaaattatattcttccataaataattatccatgagaaaatctttataggtagccttataaaatgttcacagtaaattaacacatttgaaatcaaaattaataggcactggttgtgtataaaagaagcatacattttgattcatgtaatttgttcaattgagcaaccatgtaaaaaataattatgctacatttgtcagactcagtttgaggatgactaaaagatgattaatgattttgaaacatgcatagaaaaacattttaaactgatttttaggaatgcttaaaataattattaacttcaagttataaactgcacaagaaaattaacttatgaattttatgccataaatcaaatttgctcccttaagagaaaagatttttgtttatatttaattgaaaaaagaaaatgaatcaatagaaaggttatgtacaaaattggatttgtgtatagggatgtgtacaaactgagtctatagggtacacatgacaattggttacaattttacaatcataatgtgtagtgtagagaaatcaacagcagaggaaccactctaacacattaagttccttggtcaaataaaagagattctcctgttgaataacagaatttaaaacattttcagtggtaggcaagtgtgttaatctttcctggccatagtggaaataaaggccgtagaagaactgagtgatgttattagcagtgcaaatagagttaaaaattgccatcatctagaactgacctcatgtgcttgggaaactgaatcttctcgccacagatggctctaatgagtcgggaggatggtgctgggcagaggtcagtgttggaagtcctttcttatggcaaagagtttgcagtctgtgcatgcatgtgtgtgtaagtgtgtgatgagagttgcagttgtgggatgtaagaaataaaatgcggctgctttttgtatggcaaacagaaaactagataaacagtaaattttgagatctggcaatgataggtaaagagggggctctgataattccatgtggtggttggtgaagcattaccctacacacaccatattaatgactagtttcagagattgagaatgcaattaaatatctgctgtaaaatgatattgaacaccatttagtttttcattgattctgaagtcatgtttggatcataccataccccagagtactcactacaacattagctatcgagtcatacgtttttatagatgtgttggttaaaagagaattctggtttcccagaatgttgggtatcaaactatcccctgcactggattttatttaattccaaaggttatggactttcccagttgtgttacattctatcttcatcagtctaaatgacattttgctcttgacattctgttcttctgtgtctagccttggagttttgtttttcagttatttaaggatatgatcacttccttctgagaggctgtgaaaataattattccacgaacagatcccgcagtttggagatacgatcagtaactccaattctgtattaaaagttgctatgatccttgtctccttccttttttattatttctaaaaatgttattacctttcaaaaaaatacatctttgctttcacagggattcatgtgttattttatcaaactgcttagtattcaccttcttaaggtattatgcagttgctgatatttttctgcaaggcaaatcgagcaacctttctcatttggttggatgtttttgtttggagttgttctgtctgatttcgtgccactagccatgtgtaacttaaaatgagagtagtctgacttgaggtgtgttgtaaatgtgaagtacgcacaccgtgtcaaagacttcatgccataaaataatataaaatatttcaataatttttatactgattgcatgttaaaataacattttagattattagattaaatacattatcaaaattaatttcatttatttctttttagtttattaatgtggctactagaacatttaaaatcacatatgtggcttgcattatgtttctattgttcgaggataaagaaaatgtgttcaggttgttgcaggatccatgataaaaactcatggggtcatgtccttattgtatgcttctctcgtgagatgaatgatagggaagaggaaatccagataaaagaaagtgactgtttggtaattattggctgtgcttttctcttctaccattatgtgtatgctccgttagcctgatttgcttggtttaattgctgggttgggatggcttcttgatgggggagggaatggaatcattgtgctatttagggctccttttaatggtgaccccttgactagttgatcattaatagttcactcatatgactgggaaggataatggcagaaaggaaatacagaaagtttgtattaaaatatggctaatacaaatatgagatatgctgcattttaatgtactgtaggttaaatttgcaaacctattctgtagagtaagcatgtagcagtttgtgttgctttccattagtctgtgcctggggttacatgtataaagcagcagttcccccagactagtgattctagccatttgaacacgaaatgtgaattttactgcataattgatctggttgtttatatcagtatttcttggcaagaccatctaaatgaagtaaattgtccatgcgctagccttctggttgctcagtagttattacccaaataaatatatgaaagtattcgatgtcctagccactgagtgatttgctggttaactggttctaatttctaaacctgtttatgcttggatttgcagaagtgtgacagaataaatatggtcatgaggacagtcttctaacaaattgatgtttttcatctctagtctgaataaatacaatgagggcctgaactagtcagtgagagagatggagaaggcaattggattaaaaagcacagatgcaaaataaagtcctttgggaatgatcactggttggcaggtgtgggtggtgaaagaaagaaatggattccaggtaagccctagattggtagtatgggctaatggctggatgttgatgccttttacagggtaagggctgctttaggagaggggcaagattgaaaataggttgtgacaggctcattgttaggcatgttgacatcacagcatcatagaagctctggctgaaagaaaacttaagttccatctagtccaataacttatggtaagattggtagtttaatataataaatattaaatgccttctgtttccaaagctctatgccagacaccagaactcccccattggaaaaaattaaaaagctggctcatttgagggtttccattcctaaagagctagtttacccaggttttactgcaaaacagctttgggtgattcccccttccttcttcatcactgaggcttgtcaataaggaaggatcccacatggggagtcactaaccctcaagctaaacaggaaagcttcagaaaacacaggttcaaactcattgcagatgagagatggcacttcatatttcctgaagaaatttggaggatgttggtgtaactaatcctcattaatgtattgaatatctgctatatgccaagggctggaaatatattggtgaatgaaagagacataatcactgctcccacggagcagatgcaatcacatcaaaaattgtgtgggggggcggatagggagagagagagagagagagagagagaaagagagagagagagagggagagagaattaataatggcacattagaacatggtaggggaaaaggatgtttaagccaggatctgaaggatgagaagaagccaccactgaattatgcacggaacattcttctgtggttaatggaaagggcaaggtcaaaaacatatgatttacttgaaattctgatgagtctatagcttaagtttaaacatctattttctttttaaatatacaccacttaaacacactaatatactgaataatttgattatttttctcaatcatgtttgttcttattgtaagactaatttttttacagactagaaaaagatagagaattgtgatcagtttacctgacttacctgttgctgttgttatttttcccagcaactccaagagattgcaaatggtttgataacatttctcccatgagaaacttttctggaaacagttcatcaggattgggctttcatctgtattagattagttagtcattcacaggttgttaggtgacagtcataggttgtaagcattttaggtatgagaaaataaggctgtaaaaaaaaacagtttttatcggctgtaatttaaaattttaaaggcaacaaaaaagttgctctctgaaatataattctgaagaagaatgcaaagtaagcttcatctgaattgaagagaagccagcatttccaatggcaagaattaagcctgttcacgttttcaaacatgcattttgtttatatgatcttcagctctctataaaattttagagaggggtagaggagccaagatggccgaataggaacagctccggtctacagctcccagcgtgagcgacgcagaagacgggtgatttctgcatttccatctgaggtaccgggttcatctcactaagggagtgccagacagtgggcgcaggccagtgggtgcgcgcaccgtgcgcgagccgaagcagggcgaggcattgcctcacctgggaagcacaaggggtcagggagttccctttccgagtcaaagaaaggggtgacggacgcacctggcgaatattgtgcttttcagaccggcttaaaaaacagcgcaccacgagattatatcccacacctggctcggagggtcctaagcccacggaatctcgctgattgctagcacagcagtctgagatcaaactgcaaggcggcagagaggctgggggaggggcgcccgccattgcccaggcttgcttaggtaaacaaagcagccaggaagctcgaactgggtggagcccaccacagctcaaggaagcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcttcctcaagtgggtccctgacccctgacccccgagcagcctaactgggaggcaccccccagcaggggcacactgacacctcacacagcagagtattccaaaagacctgcagctgagggtcctgtctgttagaaggaaaactaacaaacagaaaggacatccacaccgaaaacccatctgtacatcaccatcaacaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgatgagctgagagaggaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatgcggagaatggaaccaagttggaaaacactgtgcaggatattatccaggagaacttccccaatctagcaaggcaggccgacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaaacccatcagactaacagcggatctctcggcagaaaccctacaagccagaagagagtgggggccaatattcaacattcttaaagaaaagaattttcaacccagaatttcatatccagccaaactaagcttcataagtgaaggataaataaaatactttacagacaagcaaatgctgagagattttgtcaccaccaggcctgccctaaaagagctcctgaaggaagcgctaaacatggaaaggaacaaccggtaacagccgtggcaaaatcatgccaaaatgtaaagaccatcgagactaggaagaaactgcatcaactaacgagcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattatataatggtaaagggatcaattcaacaagaggagctaactatcctaaatatatatgcacccaatacaggagcacccagattcataaagcaagacctgagtgacctacaaagagacttagactcctacacattaataatgggagactttaacaccccactgtcaacattagacagatgaacgagacagaaagtcaaaaaggatacccaggaattgaactcagctctgcaccaagcggacctaatagacatctacagaactctccaccccaaatcaacagaatatacatttttttcagcaccacaccatacctattccaaaactgaccacatagttggaagtaaagctctcctcaggaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccactagcaagattaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaagtaggtattgatgggacgtatttcaaaataataagagctatctatgacaaacccacagccaatatcatactgaatgggcaaaaactggaagcattccctttgaaaactggcacaagacagggatgacctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaagataatttacagattcaatgccatccccatcaagctaccaatgactttcctcacagaattggaaaaaactactttaaagttcatatggaaccaaaaaagagcccgcatcgccaagtcaatcctaagccaaaagaacacagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaactggctagccatatgtagaaagctgaaactggatcccttccttacaccttgtacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaaccaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgagggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgagactgtaaactagttcaaccattgtggaagtcagtgtggcgatttctcagggatctagaactagaaataccatttgacccagccatcccattactgggtatatacccaaatgactagaaatcatgctgctataaagacacatgcacacgtatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacattctggggactgtggtggggaggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataattaaaaaaataataataataataataataataataaaatagctctgtggactctgaaaaaaaaaagatggtagagaccaaaaaaaaaaaaaaaaaaattttagagagaaggtcagtgttaaaaatagcatcctgttagtagttaagtgattggaaatgataggcattgcaattaggtataattggaaatatattttgttcataagaagaaacctaaatatatatgtggagttttatagactaaaaattgtattaattactccttaggattgcctttatagtctggatgattcacggtttgtatacgacacacaaaataatgatccctaacttcttagaagtcaaagatcatccaagatatcctaaatataacataattaaatatttcattaagttttattgtatgccaaaagtgatcagatggatatgctctttagaacaaatcagtttcgttagttatttgaagacagcaatggcttatagatttatgtttcaatgtttatgttcttcttttgctctttctctccttacgagtttttctactcacaaatagtatggatttggaaaagatcctaaaggaaatattattttagggaatagaatatattcaatattcttacaatatagaatatcttccggttcccttagtgtagttcatctgccttcctgtttgttgctcttctttaagactatttagagctttccagcatgcaatattcatctctactcacaaccccaagatattttgaggattctccaagggaatttggcggagattttgctgggaacagagaggacttggacaaagattttgcaaattcaagactgtatgattctatattcacatttgtgttaatacagccttgtagcctactaacactattctagaacactcaaattgcatgtcttggctgaagcttctgactgtgaaatattaaaaatctctactaagctttatcagtaagaaggcactattggtattcatggatttgattttcatgatttcaggtgtttgaggctgttcccgaaggtctgtgatatatagttattcaaaattgctttgaggctcagcaggagtggtgagcagtcaatctatgacatagttgggcttatgcatgctgctgagttgaccaatgagccttgctggcctctgggcacactctcctcccatgcacatttactttccctaagtggtaagatcttgatttctttgtgtaaacttttcatcaagatataaatctttatggaacttgaaagcattatgttatgaatctgagcacaggaaacagcaattcagacattttcatatttccaaatacttaaaggtatcaagacggtcttccaaatacatactctcttatctgattctcatagtaatatcatagtccaccttacagatggggaaacttaagctaagaacctgtaagttacttgactggggtcagctagcttttgccctaaacctgagtcctctagatccaaacttcatactctgtcctccacagttgcttctggatctaggccaccccaaatagaaggctctttgcccaagagcttgcgaatcagtttctcagacaacaaaatgaagtaattttttctcccccgtggcctctcctttcagggctgcgccccctcctttcccctctcctgggaagcactggcctctggtgtctttaaacatggaaagtggcaaagcaggttttgtacagcaggcaaaaactgtttcacaagagggccttgaattgctaaaatataaatgtaaacatacatacaaatttggcaatgtcatggtacagtgtatcaggtttcatgctttatttgatagtttcacacgtagatgtggctcttgtggtcctttcttgtttctcttcccagtttaaaccagaggttctcacagcatttctctaaactgtgtgtctgtctgcccgctggtttgcgggtctcccagctccttggtacggctgcctggaaaaggtgcttgtcttcattcacattttcttccttttcctttgtgcatgatttccctaaaagtttctatgtaatccaaactttctttttttcttttaagttctgggatacgtgtgctgaatgtgcaggtttgttacataggtatacgtgtactatggtggtttgctgcacccatcaacccgtcatctaggttttaagccccgcatgcattaggtatttgtcctaatgctctccatcctctttcccccgaccctccagcaggccccagtgtgtgatgttcccctccctgtgtccatgtgttctcattgttcaactctcacttttgagtgagaacacgtggtgtttggttttctgttcctgtgtttgtttgctgaggatgatggtttccagcttcatccatgtccctgcaaaggacatgaactcattcttttttatggctgcatagtattccatggcatatatgtgccacattttctttgtccagtctatcattgatgggcatttcggttggtttctagtctttgctattggaaatagtgctgctaatcccaactttctttaccaactccagcaacacaagcttgccgccatgctgctagcccatctctgctctttgctatcactttgcctgcagcagctacagcttttgtggttgaatagcatatttccctgcacccttttctagtgttttccagagatacctatggagtgttacttgatatccttcgaaagcatgttcccatctttttagattttattattgtttctctttgaccttaaaatgaagttagtaatagtttgacatatgcctttcaagatgcaagattatttactaaattttccttatatgtgatcatcacattgttaacatttgctgacctccaaaatgggttgggataatgagtgatcattgttttttgttaagtcttttctttttgcatatacattttatttattattctttacattcagaatagataccttttattagaaacattcagctaccctttccaaatactcactcttacaagcacttttaaattataatctattaaatcagctagcactcaaacttcttatttatgtttcaggacacatgtgaaagttaccttacttagaaacctctaagtaaatgcggtttttgactgcagttttggcagtttttttaatggcaaaaatcatatacagtggcatttgattaaagctctgttgggcttaccagtctctttgtattagtttcatgctaatgatgtaaaatttcagtgccacaattttatttgtaaatatattaatacttagccagattgttgtgtacatttaaagtaaataaagcatttgacacacagtagacaataagtggtagcaactattactatttaaaacttgtgaacaggccaggtgcggtggctcacgcctgtaatcccagcactttgggaggccgaggcaggcagatcgcttgagcccaagagtttgagaccagcctggacaacatggcaaaaccctgtttctacgaaaaaaatacaaaaattatctgggcatggtggtgtgttcctgtagtcccagctacttgggaagctgaggtgggaggatcgcttgaaccccggaggccgagattgcaccactgcactccagcctgggcaacagagcgagactgtatcaaaaaagaaacaaaacaaaacaacaacaacaacaacaaaaaacttatgagcaattttgtgcctcactgagtattctcttcttaagataacatgaatttattaattttcttgttgtattttcactttatattctatttcttttcccccaccccagccctttaccctttcatttattcaacaaatatttattgagcccccactatgtgccaggtcctgttttaggctatggagattctgcagtaagtgataaaatcccctgctttcattgagctaatattccagaaccagtgcatgttacttttttgtttttgtaatttttaaagtttgtttgtaaaatgtgctaggagctccatttttagatagtctctggaaatgcagacacagtggaatcattttgtgatcacatactgaattattagagacagttcagaaaatgatgtggctttccaaaaaggaagctgacgctgattcccttctgataatcaaggaaaggcctatattaaggcaaaatatcagataaatgtattattttgttgttatcaattccatgactttttatatttaatctttgtgttttattttgcttcttttcagagtgactattattattttagaacaaacaaaacactctacagtaaagttaacataaagatataaaattttatttactcattgctctttctttaataagaaaacttaaatttttaattgcaaaagcaatatgtgctcattattagaaaaattggcaacagaaaatgcaggtaattaaattttaaaaatcataactacttccataaaatatcttttcagtccttccaatcttttcaggatggccgtatatctcttaggaaaataaagtcacagtgtacaagttgttttgtgttgttttgtagccttttgtaacctttgacttatccatatattgtgtagtttttcaatcaatattctttaatataattttgataggctgtatattttgtatagctctaacttatgttgcagtaccctattgttgcctatttatgttgtttccagtttattttcagcctttataagcaaatcttgccatgaatcctagtctcagcaaatatttcttgtatcttcaaatatatccttatgataacctataagaagttaaattgaataggctattatggttctggttatatgtcgtaaaattgctttccacaaagatttctaaagtttatatttctccagtagtgtataagacacatgtttctccaaaccagtaataatatgaaggatagcaaattgggtggatttcacacagacacacacacacacacgcatgcactagttctgtgattctttgttataagtgtctgtggcagaatgaaaatcttcaaggtcagtttctcctccttggagaccaaggtttagtcccagaaacattctgagcctggaaaatttagctcacacccaccaaaatcacatgagattgattggaatcagcttggcatcaaaatgctcattcaatagtttatgcaactggctttccagtctcagataagatcagatagtttagaaagtatgggcagattgctgagaagaggacacactgctagatctgcctgggatccctggaccagacccactggctttggtcacatggagaggagagtgggaaagagcacagaccagggcaggggactgccctgacaaggcctccccagccctcagggtgcagccatagctttccttagagttgaaatggtgccttttatgatttcctaagaactgtcgctccttcggaatttataatttattaagttaatttgccacaggatttaaaacaattagtcaaatcatgtggttgtcacaaggatggtggatggttgaaagaagcaacaacctaaaagaacatgtatgttcacacacatacatgtgtacatgcacatatatatttgcagatgagccagagacagccttttcctactggcctcaatatttgttttctaattcttgatctcccagcaagtatgagcttctctctgtgtcccaatataaaactatacttcaattttcttatttgtttattgcttaaaatgcctcagtggaaacaaaattttaatgtagcattagcatttcaataactttttaaaccctaaaaaagattgccattcctccaagaaaatctgttgttatttaacgttgaaggataaaattagctgtaagggttattttagagtacatttcaagctcattttattctctagcacatattattctagcgaatattggttgctaggttttgctgaagaaatcctttgacttaaattggatgacactaaattgaaactcagaacacttttaaaatgtggaagttaccagcacattgaattaactgtattgtacttgttttggaaatgtttgtcacctcacttggcttaaagtaaagaaaaatgttgaaaagaccaaaaagcctgtgcttatataggcttcaattcttgcctacaccaagccttgaattggccatcacccaggataaaaattggctattttttatcatatgttttacctggccttgtgagtagagttgttgtttttaaagagagattttttttttaacccaacttcatcatcctcctaaaaggggataaggtagataatccaagctaaaaacagttctttgtacaacaacaaaaaggcaacagtgcgtccaagcttcatctacttgatactgagaagaaaccaagcaaagcttccaattagcttgatctgtacaatgatgggctttcattcccagttaattaagagggattcagtaagatccaggccgtgggttctgatctttcatcttccaagaaaaaaaaaattacccaccaaataaaaacttaactaaaaggaaacctttgtttagagattctccagggtgatgagtcttacattttttatcttgtggtaccacacagttcttcttttgtctccttcatcacttgcagggtgcacatcatattccatgccacacatcctttccatttaaaacacaaagtcaatgagatgtcttctggcagacaaggggtgtgatgttgagttccatgctaaaggagtcctagcatccttggaaggtcaggaagaaggggacctgaaaaggcatctggcttcagcctcctcttttatagaggaggagactgaggtccaggagagtgaaatgacctgcatgaggtcacacaaaccaggagacttctggaacccataggcagctggttctttccattaaactttattactttgatgttgctgaaagaattattgtctgttcaaaaaggtagcattgttttttgctgttggatgtttctttcaaccttgtgttttgttactgctcctaaagaatcagttatgcggccaggcgcggtggctcacgcctataatcccagcactttgggaggccgaagtgggtggatcacctgagatcaggagatcaagaccagcctgaccaacatgtagaaaccccatctctactaaaattacaaaattagctgggcttggtggctcatgcctctaatcccagctacttgggaggctaaggcaggagaattgcttaaacctgggaggcggatgttgtggtgagttgagaccacgtcattacaccccagcctgggcaacaaaagtgaaactctgtctcaaaaaaaaaaaaaaatcagttatgcatacaacttttatagcaatgtgtagagtacatacttaatgtattaaaaatgtaagtttgtgaaaacaattcacatttactcattcaattaaccaacatgtatttattgaatgtcacctatgtgctgagtactggcaatatcaaatcagataatacgtgatcctgcatttatacattggaacatattcagggtttttattttgcttttgttttcttgtaaaacatcatatggttaacaggttgtgattattcttgatggctttattttatttatgatgtctaaattccccaataaggcatttcaaatgatctttcaaatactttgaagttaggttgctttcgatgactttagtaatggtatttaatggtatgtaaatggtatataatactaattcatataatatttaataatattattttagatattaaaatatggtatcccgctcttaatgcagccttgcaaatgagaatggcaaatccaaagccattaggtgatgaagcttgtcacctgcaatgcctggtagctgctgatgtggccagacccctagactttcttcatcctcacccctagaactgccatcaactgggacatgccagagagtgttcttgcaggttgatatccaaagatagctgacttggtttccgtccttaagttatgataggaactctagaactcacagggggaaaaaatgacagtagagagtaagtgcccagtgagaaagaggaagtcatcactgaggggaacggccattaataagcctcttagattgtgtggggtttaagatttgccttgaggattacatggaagaactgagggaatagggcaggctggccatgtaatagaagaatgctagtcaaggttaggggtgaagtgggggaaaggcctcacttgacttaaagcttgcagttacttactttccttcctattttagccacatcaagtaattagtccctcttcctgcataactgtcccagatgcaaacgttttgctccctagaatgtaagacttgtttgggtggattgggagatttcagcaatgattgctgctatttgtgtataaaagtcagtagttttgtaagcaacagtctaggattagctctagctgcaggtcagcagaccgcaagcatcatccttccagaccatctcccaacagatctcctaccaatttcctccaagaagagtttggtactagggcataataagacatcaggtagcagtaatgaggagaatagaatttagtttaatattgctatttttaaattccagcctcataatagctctctttgtgtcaagaaaacaaaattaggaagaatggaagtcggaggcctcaggagaaagagtctgtctccctgatggcagggagggccttgctcagccaggtagaaggggtttttgtgctggtcctgagaggaagaagcagggattttctattccaaattgtccttgaaggaagagagacaaaaagagagaaggaaaaaagagtgaggccacccataccattgactataatctcaagaaacacagtgtgccaaacttttggaaacttaggaggattccattcagctcaccccagctctggaacaggcaggctggcagctgtgctgagtgaatgtcatatccattgactattcagaaaaagtgtaattgtgggagcagaaacttatttgggaattttttttttttgtttgagacagattcttgctctgttgcccaggctggagtgcagtggcatgatctcggctcactgcaacctctgcctcctgggttcaagtgattctccagcctcagcctcctgagtagctgggactacaggtgcatgctactgcattcagttaatttttgtatttttagtagagaaggggtttcaccgtgtcggccaggctggtctcgaactcctgacttcaggtgatctgccttcagtggcctcccaaagtgctgggattacaggcgtgagccaccatgcctggcctatttgggaaattttttaattgtacctaaaaatcaaaatcctttatcaccattgaaattagtgattatcttattctcatatattttggattcactgcccagtgataaaaagcagtaaatgttcagtatctgttgtagcgaaatctgtaataattgcagctttaactgaaactctttctgcattgtacgttctcatctcacctggaaatattttagggtgtagctctaaaaaggttagggcacttttttgaaaagcataatcacaataccattatcttatgtttgacaaatatttattgaaagtctgcagtgcgcatgatagtgagtttctgtcagggaagcaaggagagactaacggataaggagagagggaagaatattttggttgcctagaaatgatcaagaagaccactctggaccccagagtttggcataagtatgatgattctgagtggcttaattggaggggaagggagattggtagagacgcatcggctggagaacagggacccgaagaggcagaagagctattcgtatggctgtgaggtgcctctgaagagccatcaatgtgggtgtgaggtttctgcattcgcaggagatattgaatggagaggattatgaaagggctctatttttctttttaggatgataaaactcaaaactattgaagggcatttttattttaataatgatattatttatcaaaatgtttagcattttctgacaataggagtgtattgtgtcgtagttttgtactttatcttaaggacgttgtgagtcaatttttcttctaagactcctacactttcttatacttcttaattttattcagaatttaaaaaattatgttaaaattttagggcagttgaagggacactaaaatactcaaaagggggtcagtaactaaagccactgaggaaggtgggagtggagctcagcatgtcaaaagaagaattgatcgagtgatgatgccactccaacaatggtctggatcagcaatcagaacatgggaaactgctgaccacacttagtgggaaagtagactggttgtgctttatattaaatatcagcaataagctggaatcaaaaatgctaaacttcagattgctacaccaagctacccaaaacaccccaggacctatgcattctggttagtcaaaacatttctgtataatggaacaaagcaattgccagtagttaatccatgagaagcatactttgctgtttggttggttttttgcttagttttggtttggggggaagttcttttatatctgatttaaagactattacattgcaagtttcatgacttacaaccatagttggaatgttctgtatgagaaagaatgttttcattagcaatcagtcatttttaggttaggactgaactaatcaggccaacaccacctcatgatcatcggtattaaaaactattgatagatgtaaacatgtgattggctgtttaactgttttccattgtcagaatgaaattaacctgtgaaattagagccatgcgtgttccattcacactggaaaaagccaagagagggaaaatgttctttgcctccaaagcaagtttttgagatttctgctctacgatgattttccccttaaaatgagagatgagaaaagaaattaaagataatcatatctgcctaggttttagttggattggggcctatcttcattagtaataaatctcatatttcctcatcattaaaaagaacttgatccagacaatacatgctcatgttcagtggagaagatcacgagattatccaaaatgggctagccttggctttgcatttgtgtatggatgaggctgatattggatttaatttcaaaccacaaggtgtagccccaagagaaaggagccattctggaaactaattggctttttccatcctaccttcaactcaaacatcattaaactctgtttctagcaggaggagactgttcctgcatgcagatgtagggaagtggttaaggggctttaaagggcttcactgcatgtaaaataaataacacaggaatcagagtgttaaaaatagaagctctgagtaaatagctatagctttgtggccaacaggtcgaatgctcactctcagtattaaatgggcaaaaataaagttatgctgtccatatggatgaaagcaaagcatgtataaaagatgatgcacagagtggataatacccttcagataagtggtgtattaatcagggttctccatagaaacagaaccaataggttgtgtgtatatatatatatggaaagagatttgttttaaggaactcacgtgaacatcgagacaggcaagttcaaaatactcagggagggctggcaagctggagactcaggaagagctgatgttgcagttcaaatctgctagaatggcctcctgcttgtggaggtcagccttttgttctattcaagctgtcaaccaatagatgaggcccacctgcattacagagggcagtctgctttgctcaaatttagcaatttaaatgttaatctcatctaaaaacaccctcaaagaaatgtgcagaatagtgcttgactacatacctgggccccgtggcccagccaagttgacacataaaattgaccacctcaagtgggaatgggcattgcacatggtgctgtttgcaataccagcacactgaagcgaatgatgaagacgggaggccttaatctatctctccttcttaaagcactgatgattttatttacaactaaaataggttggcagggtgcagtggcttacgcctagaatcttagcattttgggaggccgaggcgggtagatcccctgaggtcaggagtttgcaaccagcatgaccaacatggtgaagccccgtctctactaaaaatacaaaaattaactgggcgtggtggtgggcacctgtaatcccagatgcttgggaggctgaggcaggagaatcacttgaacctgggaggcggagattgcataatatttaactccagcctgggcaacaagagtgaatgaaactccatctcaaaaaattaaaaaaaagaaataataaaattaaaatagatgaaaatattgttggccttaagtaaagcctaatatagaagatattttaggaaaactgttgtaatcttattgcttatgtttgtaacatttctgctagatttgcatttataagaacagccaggaaacaaagatttatggtaaaaacgtgtgatctcacgtacgtgggttagtttatcttttttgaggttgtctctcacagcctgctgctaaaaataagcagtcttctattatttgctcacctgtgatttagtcagaaaagccagtgtattctaatgagttgggaagaggtgaaatttccattcagaatggtaattttctgttaatcatcattgaaactgaagagcctcccagattgttcctcaacatttgaattggcctcagtaaaaatgaaagaagacaaaggaacatttatatgaaagtaaaatgttcttattctttctggttttgctaataaaactaccagattggtttccttgtctttgtcctctgatctgtttacattccttttattatattttggtgtggcccattaaaaatattgccccatactaactagtatattgaaaacggatagaattagatttcgtaataaagtgaacttagttcactcaaatgttaagtcatttcctccactgaatccttgtagacacaggcatttggattgtatctttacaatatgatattggaaaagatgagggaatattggtaatttgaggtgaaaaagaaaactcttataattgaatgtggatgctttgtctcttcttggagcagaggtttaagaaagaaaaggaagaaactccaccactacaaagctaccttggagaacacttagacaaaaatttctcagagcatatgctatttggtgaaaattcacaaattgctcttcatagctttctgaatttgtgtcatatctgcattttaaaattgaatgtgctgcagttccaacctgtatgcttttgaatgaaccttaatgatgggccatttcttattgccgtcatctgtgcctttcattgctgatttatgtcaacttcctttaaatgcattgtggtatttaggcagtggataagatagtaatgccatcgcatgctggttgcttaatgatgcaattgcttgaaaatttaaagcccataatagctttaggtcaggttcagaagttcatgttccatgccagacatttgaagactgaatcagagcccgagcactgccaaaatcatgccacatttgtcaagcctggccttgggtaaaagctgttggaagccgcccattcatccaagccaatcactgataatgaagcttgagggaacatgaaatatcttttctaaaaagaacagacaacctcaccagttggctgccttttttttatttttagtataattaccaggggcaaactgtcttgcagaattgctatcttatattagctttgagtttgtgttcttgagacctgatgcaaggatgttttattagctaagaatatgtggtttgaggtcagctgaacatgattctttcaggtttttcttgtgggctgtaatgtgattgactattctgtggtgtggaagcttacagctagaaaagaaacttcaggagaaccactttcctgttttcacgcttatattttatctgactaattcgcttggctcctgccacaaacatccatcagtgaacagacttctgctacagggaaagttctagaagagctgcccacctggaacacttcagtcaagcctgaagctggaattgtaaagtgtgactgattccaaaatcaccatgccccaacctactcctgctaaatgttagattttttttttttttggaagctgcatgttacttttccccttttctttttttcaaagggctcatagtattggttccagtatctcaaaaggatgttttgcagatgagagaaaagtacttgaaagagtctgaaacgctggaaggactagagatgttaactggtcactttccctcactcctgcctttcatattccacactcaggtctttaaagactttggctttgaagagaggaaatgaaatatgggagcctcaaggctgatacttatcctagctttttttttttttctcatgagtgttcagagaaaggaattgaatttgaattctctgaagcaccatatgataggtagttctgattaagttgtggctagatgtctttgatgatgttattaccatcatcaaaaaaatgttaactaattcctcatgtatgtaaatctttgtaattcagaacacactcactttacctgattctcacaaccacttggtaatgaaggcacggcaggtactggtttcatcctcatcccccaatgtgtagatgcggaaactgaggatgagaggtaaacctttccccaagtttcacagatagtaagtggcaagtctaagacaaatcatgctacgtccagtgcttttcctgtattttatgctgcctcctgccttctgtcagcagattttggtggctgttggaggaaagaaaattataagaaaaattataagaaaagatccttgctcttgatgagtttaaggtctacctggagagacagaactgaggcatgaaagagacaaagaagaatgcaaggtaggctgtgctaagtgttcagtcagtagttttgaggttacttgttgctggagcgtcatgtaggagaggtgattgatcgaaggcagggacagcagagaaagctttcgggaggaagtgagagttgagttggtcttgaaaggagagtaggtcttagataaaagagagcagagcagcttgagcaactgtatcacagaagcagatgcatatgacagtgcgtaggaggctgagcaagcaattgtgctggacccacatattacatcagggagacattgcaggcaaggctgcagaaacagcaaaaggaccaggatgtgaaaatcttgaatgcctgaatttggatttaatccattaaataaggagaagatatccagggcttcagagcagtagcttcatgtgtataatcgattagagactggagatcactgatgggggagtagtatatcagtgcagttcataaaggtggtagaattaaaataaaggaatgaatgaccaggtcacacaaaggaaaaaggatcaggattttcaggggaaagaggagaaatagagtgatcataaaatgtattgtccaacctaggacattttccaagacaaatgctacactggtcaggacagtgggaaaacaggcacaaactgggactttcctaggcaaattgaacatatgatcatactggtcaacaatgatgctggggttttgagactggggcatttgtggtcattgatagaaggaaaatcagcaaggccagtgatcttggattttaagcttcaagatgactgcagtaagtcaggagtagatttccagtgcaaagttagaaatgcacaaaacttgtctgtataaccctttgtttcacctttcactcctcttttaagcccccaacattaaaaaaaaaaaaagcactttcttttgaaggaagcaaacaaagtaaggaatggcagccacatcctagtactgtcaacatgttgcattgtaattctccattttgaaacgtgagcctggatgtactgtcaggaactcctcatctttgtgagactatggcttgcaaaagcaaatccttgcatgttttcccacatccgaggggatcatttgtctctgaagtggattcagactactttgcgtttcaaaacagaattgaacgtctgtcaacctgttaaaaattgagattttcagaaggaagaagtgcgaactagaaggcatgagtgtgggaacccctataatctatgatttcattatagatcaaaaagaatttgttcattaattatcagttagcttgggacttttcagagaggcaattaaaccaaaatctactgagccagggtaatcataaaacataatttttataattaaatatgtcatttaggcttttatttgacattttaggtgatttatgtggcactttccaggcattagaaaaagcttgatcaatgccgtgtataagatcttcctagcattacccccaaatagatgagtaacttgtcatatgaggttagaacagggtaggcagtttcaagctcacaaaatgatctggaatcagacctggatttgctaatggggggaagagaagaatcttttcctcttccatcctaggttcacagctgaggcccctataacaagagatagtttaatgagagaaaagcatgcaaatttacttaatacaagttgttgttgttgtttgtttgagataaggtctgtctgttgcccaggttctagtgcagtggtatgatcacagctcactgcagcctcgacctcttaggctcaagtgatcctcccagctcagcctctcaagtaactgggcatgcacagccatgcaccaccacacctggctaattttttaaatttttcataaaggtgaggtctcattatgttgctcaggctggtctcgaactcctgggctcaagtgatcctcagcctcagcctcccaaagtgctgggattacagatgtgagccaccacatctggcctttaatctaaatgacacaggagtcttcataaggaaatgaagacctaaaaaaatagttaaacttctgtgtttctatgctaagtctgttgaagagtgaacagtcatggagacgtatgattggataaaggtctgatctaatggtaataagtggggggaacttagcaaggcctgtttgttcaggttcttcttggcatctgtgtcttaggcacttttctttaggtaaagagagggtacctctcccatgagggtcttatgacctgcttcatgggagaaggggaggtgggtgaaatgagagtgaccatcccatttctgctttttctcaaatgacaaggtgccatattttggggtagcatgttttgaactccatcaccaaggagagggtatgtcctcttgccttgtaaggaacctggtccaccaggaagcctgaggcagtcatcacccagagcaggaatttgaaacactgactctccatggtcagttttgtattctccagtcctactttgtagacattatgtacaagagaatttatcagattcaaaataacttggtgggaatattcagaaatatctcacttaaaaaaaaattccccacgttggctgtttaaaaaccaacaaaaatagtaacattttaagtcttgcttggagttcaaaatgagcttggaaaccatctgccctgacttaatctagagcgttcactgagtgtagacaactctacataggtgctgtgagggatccagagatttctaagcccagctggaagtcctacactctgtatctatgaaccaagtggagaacaggtgtttattacaccaacagccactgtctctactgcagagcaagttcagagaaggctgggattggccaggcatgacctggggtggagaggtatcctgggagccttgtaactgaagatgaacagagagacagtgagaactcaagcagagatcagaggcgcaatagccaattgggactgaagttctggagcatcaaagagcgccccctctgggagaaaggatgtgcttcaaaggcctgggcaaggtggaggattcttgcaggatgctggcaatttgtctagcattaatagaagccgtagtgtagtattaaaaattatgacttaaatacacacaaaatttagttacttttcatttgtattttggtatttagtattagtacaacttgtactctgatattcaacctaattttgtatccttggggacaattaacacatggtttaaataggaagacattgttgggaactaggacctaggaccacaaatatattttctatgctttttacattctcatcacgagtgtgccaccttcagatataattttcatatttttagtagacatatgtaaaaaatgtaattaagactgattaccccagcagctgtgctttctttaaaaaagcaaaaaggtatatctggcacctaccaactcttagtttatcacatatcagttattttttaaaattaaatattttcttctaaggtgaaaaatgtgaagaaaagtctttataaaggtgatgttttgctggatgtggtggcttatgcctgtaatcccagcaattcaggaggctgaagcaggagcatctcttgaaaccaggagttcaagaccagcctgggtgacataatcagacccctgtctcttaaaggaaaaaaaaaaaaaaaagccaattagccaggcgtgatggtgcactgtagtcctagctactcaggaggccaaggcagaaagattgcctgactctaggagttcgaggctacagtgagctataagcaagaccctgcctcttaaaaaataataatggtcaggtgcagtaatgggattatacacctgtaatcccagcactttgggaagccgaggcgggtggatcacctgaggtcaggagttcaagatcagcctggccaacatggtgaaaccccatctctactaaaaatacaaaaattagccgggtgtggtggtgagcacctgtaatcccagatactcaggaggctgaggcaggagaatcacttgaacccaggaggcggatgttgcagtgagtcgacatcgtgtcactgcactccagcctgggcaacaagagcaaaactctgtctcgaaaaaataataataagaagaagaaagtcatgttttgaaattccaaagtatagatattttgcaaaaagcaaatttacaagctgttccactacacatgtatcttaagggagtctgtcaaaggggagatagtcaattcagaaaagcagagcatgcggtaggtgttggagagagtgaatatgttatggattctgtacccctattatcttctaaatcatgggctaatttgtaaagtttctatttattgtttgctgaaaatttacatttacattgctgaagatggcctgcaggtgagagagcacctgcaggcaatttccaatggttgtttagatcctggagtttgcgtccttcatggcgtgtgctgatgataccctgtgagttgttttgggcggccgcaaagattcaggtctcctgaaacgttctgggctgcagccatttccttactgcaaatgaataatgaatgagctgtgggttaaactaatagttcaagataaaatcagaagctcattgcaacatgggcaactttccttcgtcatctccatggaaactgctatttgtcaagacacactagtatttcagaagacagtgaggagtcaccagttttttaacttcaggtcagctgttgaaaaatagatttaagaagcacagattgagacagaatgaatacagagaaagccatctgcatgcagtgggggagctctgttagaccattctttgggacttttagaaaaatagatcataaatggtataataaatattaagctgtaagatttgaatggaaaattgagttaacactttttccctcccccaacactatgacttggcatctggctgggccacatagtgagtgagtgctcagacctcatccaggtggccttcttgcatcacagggggagggctggcaccggtgttgcaagaggtgagagcagctggctgcacagcactggtacaaaacgggcaccctcacctcgcacatgcatcaggccgcggtgtcgccaacagcctgggcgtggggtccccgctgcaggggctgatgtcagcatgctgaggtcacattggggatcagatctcatgttgcagcctggcagtgggtggggcgggggccgacgcatcccagcgctgagaacagtggcactccagccactcagggttggagggaggaaacagtggggctgggtcttccagccccatcaggactgggaggtgctggggaaagagggaaataaggaacaagaaatgtccaaaagtggggctcagaagtagatctagccaggtggctggggctgccttcaccagcacagcacgcaggaggctggcctgagactggggacccctgaggatgggctgctccttgtccctagtgagacagatgtggggagcagggaggagattgtgccataaaagctctagaaatgttcaggcatcaataatatgttaagaaagcacctcttcacactgtaagcttctggcctctggagcacatagtattgggttacctcaagtccgagggaaaagaagcaagtgttacagactgggactctatcttggctcccccactgtggccgcgttactcagggcgggttaggtgtcttctctcagcctcctcccatttcatccgtgaaaagaccaggtagtggtgcccctcagggtcattttattttattttttttattgttgtggtacataatggtgtatgtattttatgggataggtgagatattttgatacaggcatgcaataagtaataatcacatcacagaaaatggggtatccctcccctcaagcaccccctaagggtcgttttaaatatgaaatgagacaatacgtgtgaaaagatgaagcccagtggctggcgcctcactgctctcagtagaaaattaaggcatttctcttcactaaggctgtctacagaagtctcccccttgcctctaaaaagggggtcagggttcaagccttctcctgcctcagcctcctaagtagctgggattacaggtgtgcaccactatgcctggcaaatttttgtattttttttagtagagacagggtttcaccatgttggtcaggctggccttcaactcctgagctcaagtgatccacccatctcagcctcccaaagtgctgggattacaggcgtgagccaccgctcccagccgccactgatacttaattctcagccagtctcagtctctattgtccacccctttctctgctcaattaatgagagaacaggaaggggaggtaatttaaatacttttctacacaaaatattattaggaaaatggagcttttacaagagcattaaaccttttcagtgcaaacagaaatgcctttacatgatcgtccaggctttcttgcagtgaggaaactttcctcctcaccatctttcccctttctctttagggctgatctccctccctgaccacatgttctgtgcttcatacccattgcgcgcatcatcacccctgaaaaactaaggtgtagctctacttacaaatgcagcctctgcttagggaaggatcttggatctgcctgagaagaccatgagggtcccatcagtttctgtgtttctccaacccctcccctgccctacctccaaagccattcactcagagatgcagaaagctgcgagtgagcgacaaaagaaaccctctcaaggagctaatgtcaggcagattgtgaaaagtgctgtggtttttgtgtgtgaaagaggtgatcacttctatacccctcagtatgtgcttttgatttcccacattatttagctggctactcagatctgattaaaagcatgtgtacgagccaaggtatagcaatgaaagtcaaacacagacccatgagaagatttaatggaaacaaactatactgggagttcgcttgctagggtgggtttgagaccagatcctcaacctcctggttctcccctgcctcctctgtgaaccagggataatgctgcttcattggcctttttttttttttttttttttttttttgagacggagtccactctgtcacccagactggagtgcaatggcatgatctcggcttactgcaacctccgactcccaggttcaagcgattctcctgcctcagccacctgagtagctgggattacaggcatgcaccaccacatccagctactttttgtatttttagtagagacgggattttaccatgttggtcaggctggtctcgaactcctgaccttgtgatctgcctgcctcgacctcccaaagtgctgggattacaggcatgacccaccgtgcccgaccttcatcggccttttaagtgaggactgcacctcacgaactcttaatatcttctccactctctgattacgattgtttggactttttacttttccttaaatctggggatcaatactgctgtgctgaggatgtggctttcttcctgataaaatatctatttcttccattggaatacactttaatttgggaacaagcatcaatcttagaatagatccttcatgttctgctagttggcattactacctggccaaaggggaggaagattctggaaagcaaaggaaaaagggcctggaggggcagcccatccccagccagtctctcctgagcctgtaggctgccaaatccctcagtcccaagggccaaggctgccaaggacctctcctttcagtaacatcaaaaatgagatgacatcaggttaccctttactagtgcctagagagttgtcaattacctttcagtcacttaccctttgctaattgcaaaataaacagactccgcagcctgccttcaatgacagcctcgtctcctgtcctaatatttatatcttagcctcttattaattgcatttcattgatcatttcctgaatactcttcttcccttttgcattttcagtactccaattttttttttttgtttgtttgtttttcaaagagcaggcatcagagtcagattttctaaagggcctgccagtgccacacctgctattgttgatcctcataccctgtagatccctaaggatggctaatccccttcacaggaggcattgtttccagggagaatgggcttattggctttccacacctctgttagaaacaacagtggagaaggatgatgtggaagggaagtgagctggtagcaggtctaaatgcatccataatcagaaagatttccagatttccctaattgctgtttttattcacagaacttctattttaagcgcacacactcacatgtggattgacaggcaccagccactgtaatggctgtgtctgtctgtagcgactgcaaacgcttgtttccatggtgacgggaggcaccacagagacacaattatggtgctgctgggaccagggcactgccacaccaggaggcctctcaagtgtgtgtgtgtgtgtgtgtgtgtgcatgcgcacgctgggggcacagggttgctgtcgagtgcggagtgtgaaaaagccaagcggggaaggggttggggagataggcagagggaacattcgctggtacagaagcctggggggtagtgaagagaggtgatacctggatcaggggaatgatagaaaattgaagaagaaggggaatacagatgggaaaaggaaaagggcaaacaaaaatggaaaatttctcctctctgcagaatattattgcccctccctttgaaaggtttattgtggcagaattatctcacataaatttgccaagtagagaaatagactttagcgagcagaggcagacggttcaggcagtttgggtgtcagagtttttctgtaactccaaagttgatagtttgctgcctccagctcaacagccccatcctggagaggagatgaattgctccctcacccactgcagggttttctgggcatgtgaagccattacttctcctctgggctctgcccaaggtggaggcacccagtgttgtctccaaacaatgtcatttggtctgagtgaattacatgtcaggcaaatgaggcctcgtcaagttctcacagagggcacaactgtttttcagagaccttgaaaggatgcccagaggattccgttttattaatgatgacttggtgaacattgactgaagtcctatcctcggctgacagacagacacccaccctaggggtcaagcaaacaaaagggaactttctggggttatccttttaggctctggttgtaaaaatcagtggttctctggttccagattgagcacttattgacaacctactgtgtgtcagcagttttcacataggctcacctgcaccactgtaagtggtgttggccccatttcatagtggaaggcctggaggctcaaagtggttgagcagtttccccatagtcaaggaggtcaagtcaaacccagatttccagattgcaattcagtgcagtctcctgttcaaggaggtcaagtcaaacccagatttccagattgcaattcagtgcagtctcctgttcaaggaggtcaagtcaaacccagatttccagattgcagttcgttgctgtctcctgtattcactagttctcttttatgccaagaaaaaacttttttaaaaaatttctttgggtacacagtaggtgtatgcatttatgggtacataagatgttttgatacaggcatgcaatgtgaagtgattacatcatggagaatggggtatccattcccttaagcattatcctttgtgttgcaaacaatccaactatattcttttagttattttaaaatgtataattaggttattattgactatagtcaccctgtggtgctatcaaatagtaggtcttattcattctagaaaaaactttctgatggaaggattcaggcccaggagtccccactgagcctgattccactcatgcacttggtgatggaaggaccaggacatggtgagcaggcccagcaggtgtttggccaaacttggctcctagacagaagtgctttccagagattaacatgctccaccagccttacaaaagaaagccttatggaagggatttcctgtccatctcttgaattttctgaagagttctgggttggctcatgcctgtaatcccagcgctttaggaggctgaggcaggaggatcacttgaggccagggatttgagactgcagtgagctgttatggtaccactgcactccagcatgggcaaaacagtgagaccctgtctctaaaataataataataataataaagagttctggaccctacaggaagcttgataggtaaagcagaccaaaaagcaattcatggtcgggtgcagtggctcacacctgtaatcccaacactttgagaggccatggcgggaggatcacttgagctcaggagttggagaccaacctgaccaacatggtgaaaccctgtctctactaaaaattcaaaaaaattagccaggtgtggtggcgggtgcttgtaatcctagctacttgggaagctgaggcaggagaatggcttgaacccaggaggtagaggttgcaataaaccaagaccatgccactgcactccaacctgggtgacagaatgagaccctttcaaacaaacaaacaaaaaaaaagcaattcacactaatcaatggactttgaaccttcctaatcatttgtaacgttccgcaacagatgtaacttaacaatcaggttttagattttcgaaaaattgtattccaaatccaaagattgacaatgaagcatcgcttgtgttatttatagtaatttttgttttgctttgttaatgttcacattgtgatctcactgtgggcccactctggttttagaaattaatggaactttaggtatcctgacttcactaagttgaaattcacttgaatcggttgccctttctccctccctccctccctcctccctctctctctctctctctctctccctttnnnnnnnnnnnnnnnnnnnntctctctccctttcttttcttttcttttctttctcttgaaatagggtctcactctgttgtccaggctggagtacagtggtgtgaatcactgttcagtgcagccacgaactcctgggctcaagtgatcctcctgcctcggcctcccaaagcaaggggattacaggcacgtgccaccagacccagccttgttccctctttcctttgtgaaaagtgcctatcccagggggctgtgacctcaccttaactctcttcctttctggcccaggatccctccgggtgggtgtggtgaaatcttaaatgaacaatgcatttctataaccatcaggtactactgcaatattttataattagagctctcaaaaattcatagaatttcagccttgggaagagtttaaaaaaatacatgaatgaagggttctacctcacacccactaggatggctagcataaaataatcagaaaataacaagtgttggcaaggatgtggagaatttggaactcttgtacactgttgatgggaatgcaaaatggtgcagccaccatggaaaagagggtgacagttccttaaaaaattaaaaatggaattaccttgatctagcaattccatttctgggtttatacccaaaagaattgaaagcagggtctcaaagacatatttgtatacccatgttcatggcagcattattcacaacagccaaaaggtgggagcaacccaagtgtccatcaacagaagaatggataaataaaatgtgatatataatacaatggatgattattcagctttaaaaaggatggagcacagaggattcttaagggcagtggagctactctgtatgatactctaatggtggatctgtgtcataaatttgttcatagaatgtgcaacacagagtgaaccctaaggtaaaccatggattctgggtggtagtgatgtggcaatgtaggttcatcagttgtagcaaatgtcccctctggtgctggatgttgatagtgggggaggctgtctgtgtgtggggacaggaggtctatgggaaatctccatcccttcctctcagttttgctatgatactaaaatttcccttaaaaaaagtatatattttttaaaagcaaggaaattctgacacatgctacaaaatgaatgaactttgaggccattatgctaagcgatataagcctgtcacaaaaaaaaaacaaaacactttttattccacttctatgagatacctagagcaggggtccccaacccctggttaagaactgggctgcactcttttgattaatgaaaccttatagcattatgaaatggctctctttgttcctagcaatattcttttctctgaaatctactttgtctaatattattattacctctttggctctcttttgattagtgttggaatgggatttttttcccccatccatttacttttaacctatttgtgtcttcatattcaggactagggctgggcatggtggctcacacctgtaatcccagcaccttgggaggccattgtgggcagatcacttgagcccaggagtttaagaccagtctgggtaacatggcaagaccccttctttaaacaaaaaattacattaaaaaaaaagaagaagtactgggctgcacagcaagaggtgacagcaggatgagtgagcattactgcttgagcatgccagggatttaggttgcatactccttaggagaatctaatgcctgatgatctgaggtggaatgatttcatcacgaaaccatccccgcacccagcccacgtccatggaaaaattttcttccaagaaactggtctctggtgccaaaaaggctggggaccatgatctatagtattcaaaattaaaaagacagaaagtagaaggggctacttctacttttgctaccatgatctacagtattcaaaattacaaagacagaaagtagttgccggggggaacacggagtccgtgttttgttttgtttgacacagggtctccctctgtcaggctggagtgcagtggtcgatctctgctcactgcaacccccacctcctgggctcaagccatcctcccacctcagcctcccgagtggctgggaccacaggtgcgtactactgcacctggctaatttctgtatttttagcagagatgggttccaccatgttggccaggctggtctcaaactcctgagctcaagcaatcctcccgccttggcctcccacattgctaggattacagacgtaagccaccacactcagccagggagttcatttttaatggatacagagtttcattttcacaagatgaaaagaattttgaagaccagcggtggtgatggttggacaacaatgtgaatgttcgtagcactgctaaactgtacactcaaaaatggtttaaggcaggagatctttatgttatgtgtattttactatggaaacaaaaaataaaagtgtatctcctattggtcccaagtagatgggattttgttatattttcaacagcacactttgagttgtaatatgtttttcccagaatcacagaagagccagtgtgctcaggtccagctgacttagtgccagagctgctcagagaatccttcatgtccagttgaagaggaaccaggccgcctgcatgtggttgcctttgcggagacaaaggtcattttcagcccttattgcagggtaccacattgcaaaaactcactgctctccagctgttaagatttgaataaggtaaatgaccgtgattggcctttcgccactgggatttgttcgcagtgaatcatcagcacttgactgaggagccagctcagcatctttttaaaagtaaaaaagaaaattcagttccttcccttttagccaaaaatgctatgagtcagtactttggcactgggagtggaaagcagtgagaaacgagtgggcctttgggatctgacgggaaaggatagctctgggacaatattgtttatggattggctgtcatgcatttgccaagcaatggcagtggctgtttagaagctttctgcgcctcaccccattcacatgtcctctttctggctgtctcagttctgaaccccatgcagagatcagctgacatcccttgtcttccatgaaacctcattgattagtccttccccggccgggtcttctgaatcccgggctgtattcttttacttttaatagtcattggaaagtcgcttggcacttcgttgacagcccttgggctactgcctttttgtgggtaagggttgtcttccaggtggagaatatttctccagaccaaaaacatagcttctgttttgtggcctcatggcttagcagagatctgtatgtgagattgggtactgggaacagcttggcaagttattaacctctgcagagctcaggtttctcattttaaaaataaagacaactaccattaaaggaagatcgtgttttcaggattagataagacaatataggtagagcacttagcactgtggctggtgctcaataattggtggttattactcttactagtaaggtaataggtgtgtattctgtttgggagttaacctgagtttactacccttttagaagatagttccatcattccgataattcatgccgttgtcattttgtaatatctttgtgtgaaatggggccttacagaaaaaaaggtgtggaaatctaacgtaatctcttgtcagggtaagtgtaaatttgagtttcctggaggtctagtgacaccaagtggcgaattgtgatattacatgttggttgtttgagagtgttcaaattctatttcattggtaaaatagcaaattattctgctgtgtatgatttctgagttttcctctcttaattgtaatctagtattgagtgagaatggaaagaatattataagagtactacattgtagacttattgaatgaaaaactggaattctagaccgggcacggtggctcacgccggtaatcccagcactttgggaggccaaggtgggtggatcacttgagcccaggaatttgagaccagcctgggcaacatggtgaaactccatctctactaaaaatacaaaaattagccgggcgtgatgtcgcgtgcctgtaattccagctacttgggaggctgaggcaggagaatagcttaaacccaagaggcagaggttgcaatgagccgagatcgtactactgcactccagctgggtgacagagtgagactccgtcaaaaaaaaaaaaaaaaaaaaaaagaaaagaaaagaaaaaaaaaactggaactctaaattgcacaaagcagaaaatcgattcttaatgtgcaagtgttttcttcatgtattatttatatcctgtcaacacagtgacatatttgaaattgacaccaatttataatggatcgttagtaatacttccttaatatttctttcagggacaatgacattctgcttattatctacccagtctgtaaagaaagctgacatttgaatactcacagagctcttgttgacaatgtaattgtgcccactgtgtagagaacgttagtcctattaacttatgatggcttccgaaccttgactttcttcatggggaaagaaatgaacaactttccattatttgctatgccaccgagacaacatctgggcctggagttagtgcttgaacatggagctgttcttgggtgtatgacaccattcttaggtactgaagagcagaccagagttgatgagctgggattttctaaacctaatcatttgttctcagccttcttcatgtcactgccaacattcatctctggctgtgatctggtcttgtaggtaatttcctcattcattattcaaggtattgtgtggaattaaaaaaaaaatagcccattagacccatcagaatacacctgatgaccagtattaaatgtgtgcatttctgtactttaattagcaaatacctaatattggggcaatggagaaccatgtgcttaagtcaaaagggcttcgtgatagtcattcaccaaaatatacctcctcagaaagagtccttggactcaccaatcctttgcttgccctcaggccacttatttggggtgagctgggagtggctgacatacccttccctcctgcccaccccaaggaaggagcgcagaaatgcagacagcagattgctcagggggaaaacttgcccaatctgcccagacactctgagttgggaacataatcagctggcatttatgaggctcatagttctgtattcagcttcctgatatgcatgaagtaacttatatatttggaacagttgataaaatttgaatttatctttctctctctgtatatatatacacacacacatacacgaaaaatacagcattttatttttgtcatttcttaacatctggagtggatgcaagtttcacaaatgaagctttttgaattatttctgatttaattccttaaataatataatccagattccactaaggcttaagctctctatatccttcctgaggctttgttaattctttgaggacactgtgctgatgattgttaatgccgtggtctgttcatttgtgtgactgaaagtgtaacttagtgcagcgtccagccaggcatgcctcacttaaaacctcggagaaggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaaaaattagccgggcgcagtggcgggcgcctgtagtcccagctacttgggaggctgaggcaggagaatgaaatgaacccgggaggcggagcttgcagtgagccgagatcccgccactgcactccagcctgggcgacagagcgagactccgtctcaaaaaaaaaaaaaaaaaaaaaaacctcggagaagctgaagtgctgggaggacctttctcagggtcactcacagaattctgcctcgagttcacaggcttaagcatcatctgctaagggttcaccaacatccctgcccagaagtgttgctgaggctgttagggaggagacggtgagcactgtgccagcctcggcaagatgctgaggtggcagtgtggccaggagcttccatctgggctgcagctgctccaaagtcacctctctctctgtagcatcacgtgcctgtgctgtccttccttacttgcccacgcccttcctggactgatcagaactggtcaggactgacctcctttctcctcccaacctgcctccaaacccaccctacaatgctttgaaaaagaaccctacccgcatgtcatcctttggggctggcttggaaccccgaggaaaacagtgagctcaatctgctaaacaattgatgctgtgggagactagaggagttccctagaggactggctcccctctgtgtcattgcttagtggcccagtgataagccacagaggccactgccattgaggaaataggtcggaggatgtggtcccctgacacattacagggaggcttgctttggctttgcagctggtagtgcattgtggaagttttcaaatcacgagtagatggccactttcagagtggatagggctccctaccctgttgagttggcacacaaaaggcaagggagcgtggcccagatgtcattagacatcaggtttccactggtaggagatccttctggtgatttcaggtgagttagggcagagccatgaaggaatcaagggaggaagcctgagcagatctgtatgatgccccaacccaagatttcctagggaaaactcatccccgtgctcagggcacagtcgtgcctcctccttttgtctccagtttctgagccgttttatacaaagtcatgctgccagaactctggtagcaagtggggtgggggtggggtggcctccagccccttgatctcaccttggagctggtggaagaggatagcgtccttcgtgggctgtgtggtggggacttgtccaggaacagggagtggaccctcagtgtcgcctccctgcaccttgttgcccttgtgtttctggcaccccaggttggcaccgtgaccagctagatggtgccatgaaatgaggtctccagcctgatgcaggtcagacccccttttcttcttttcagtggcaaaggtgagactcatctctggttctccagaacaggtcataagtgttttttcctgcccaagcctactggtccctcacactgtgtcctctgcctcgcccacaccacaggctgcacctgccctcctgctcctggatctaggcagctcagtggtgctgtttctgcagcatggatggattggtgtaagacctgacctagtctttggtcatgtagtgtttacagttgtgcacaggtgttgtgcccttggggaccttacacaagctctgccctcacttttttcacagcacactaagcatggaaatggcacctgcctcaaagggctgttgactgaaatgagatcattgagctgaagttcttagcaccattcctggtatgttcattttctagggcctccataacaaagtaccacatactgggtggcttaaacaacaaatatttattttcttacagggctagaggtcagaagtctgagatcaaggtgttggcagggttggttccatctgaggcctctatattagtttgttcttacacttctataaagacatacctgagactgggtaatttatgaagaggtttagttggctcatgattctgtgagctgtacaagcttctgcttctggggaggtctcagaaaacttacaaccatggcagaaggtgaaagggaagcaggtacactttacatggccagcaggagagagagagcaagaggggaagcgttacacactttcaaacaaccagatctcatgagaactcactatcacgagaacagcaagggggatatccgcccccaagatccaattacctcaccatgtccctcctccaaaattggggattacaattcgacatgagacttgggtggggacatagagctaaatcatatcagcctctctcctaggcttgcaggtgggacaccctccccttgtgtccttacacggtcttccctctgcatctgtctgtgaccaaattccctctttgtgtaaggacagtagcaagatcagattacatcccaccccactgacctcattttaaagtaatcatctgtgtcaaggtcctctcttcaaatgcagtcacattctcaagtactcggggttaggaattcaacacatgaatctgaggggggctcaattaggcctgtgatctctagcaaataacaaatgctcaacgaatgttagttactttttcctgggcagttattctaaacttttgtcattttgttttatttgttttattttctatttctatttttatatgtctatttgctacttagtaaatgacccttcctcctgtatttttttgcagaaaaatgaggtaccagggcataaacttattcaacttacagaatgttcttccctctcctttgccccaaacctcactgacatcatccctttcctgccagtctcagaaaggggggtttctctgtccctgctccaggttcatcctcactcctctgtgctctgacctcctccaggaccatgagccagcccctgctccctcttcctcacatcttcagttttctgccatcttctccatccttaacctgtctgcaggatcaggttccccgttccttgaccctgcctgtccttccagcagctgagctctctcttttttgccttttctcattggagcttttgaaggaaaagcctacattctgttctcttctttttgtcattcattcatttattcattcatttgttgagcaccttctttttgccagcactgggctaggcatttggaatctaaagatgtgtattcatagtcccaagaccagagaagaaaacagatcattgtaatataatgaggtgtgtggcatgccttgttagagaggagcccagtgggccctataggaggacttaggcacatctggcccaatcaaggcatagaccgaggtgcgaggtgcaggggagagcttcccagaagagggccctgctctgagtcctgaaaattagatgggccatgagcaaggggaggtcttcccaggaggggcaaaagcctataagcaggaggcctgggatcctccaagtgggtggtattttctttcctcccctttgctcctcagctcactgacctctgcatgtgcctcgccattgaaaggatttcatgggggttccactggacccccactaagtgacctggagaacgcagtgtgttctttatctaatggaccacctcccctccttctgcctctcctcccttagccccaccctcacctgccatcctcattcctttctccatctttctttctctgtcttcgtggaagctcctctgctgtgggccccagaatgtactgggtgctgactcaggcaattgggttattagtgatgtcagcaaaggacaggaggaagagcaggcatggggatgtgggaataataataatgcatttgtacagcatgaggactgggagttttgtgactggtgagatgcagtggacagaggagatgagagagaaaggtcaggactgcaccaggaggctgcgtgtcatcaggatacaggatacagggtgtgcttgagccatgatggtctatgggatggggcctcccttttcctcatttcttacatcaaattaggttcaaaggtcctttgtttttccactctagccatcttttgagtccacctcactgcagtattcatcatgcttccttcccactctgtctcagtgctgccccccaccccatctccttgctacctctctaacatgccacttgctccttgtcacttctctctgtgtggcaacctctgttgactccacatatcaatgcagaatacctccggagctttcaggaatgtttgtaatcagactccccatcttaaatatttatcataaattgataagcaaatagttattggatactatgtgtgtagctctgaggtagtgagcttctctgtctgtatgtctctttctctacacacacatgagctgagcacttagtaagcagtcaagatctcatgtcaaggctgaggcaggaggattgcttgagcccaagaggtcaaagctgcagtgagctatgattgcatagcgacaccccatcttaaaaaaaaaataaaggctacctgtcaaatggttgattaagaatctacatgaggaaagaacttgctgaaagatgtttgagagccacagaaaggacctcagaggaaggaggaggagagaaatgtctaggtggtagataggaccagttggaggtatgctggtgctgagccacggaaatggttgagctgtgggacaaggataggtatccaagtctgtggtcaccaatcaatgagtgtgaattttaagtcagcagttggaaaaggagaagctcctgggagtgcagttaatgaagaattggaaggatttagtctagacgtagaaaggaagtccaagataggattattagctggtagaagacaggaattatttgtaacttgctccctgtccttgtgcaaacaacaacaacaataaaaacaaccgaggtccagggatgggatttcatcccagaggtgcgttagcagctccagggcccagcattaacagggagagtgcctttactatggaattttttttttttttttgagatggagtttcactcttgttgcccaggctggagtgcagtggcacaatcttggctcactgcaacatctgcctcccaggttcaagagattcttctgcttcagtctcccacattgctgagattacaggcatccatcaccatgcctggctaatttttgtattttcagtagagacaggttttcaccatgttggccaggctggtctcgaactcccgacctcaggtgatccactcgcctcagcctcccaaagtgctgggattacaagcgtgagccactgcacctggcctactgtggacttttgatgaaagcacgcatcttcctgtcttcttgtatctcatcatttctcaggggagtgtcatcaagctctaagtcttagcttcggtgtcatgtccttcaacctaaaatgggaactagcatgcatgtgttgttccaaatggcagagctcttgtgcggggtccagagaaagcccttttaattcttttcttctttttcagtgcttcagttacattgaagccaatcaatcattctctgcctacttcattggcaaaaattattcaagaaaatggtatcctgataacagactaccctgacatagcacagtcacttgtggaagagtggaaatcttataacttcagttggttgtttgagctatacagtgctaaagagctgggtttaactcacttttctttttaacagaactgagtgtattcctggggcatctgctcttgcctgtcaagtatgttaccctaacaaatttgtagcttgtttctctgttactccatgggccctttgctgcttccatggccctggctgttcataggtagcccagtctcatctctgttctgccactgccccgtgtgctaactgaggctggtgattaacatttagggcactgaaatgaggctactctttctgcttttgacctcaccaattctccccacaagatatctgtgaaattaattgtcttagttcattttatgctgctataacagaatacccgaggctgagtaatttataaagaatagaaatttgtgtatcatagttctggaggttgagaagtccaagatcaaggtggctgcaggttaggtgtctggtaagggtccagtttccactcccaggatggcaccttaaaggctgcatcctccagaaggaggaacactattcttcacatggcagaagagcaaagagccgagaaagagagcccaccgccaatagtccttttatgaatgcattaaacacacccatgagggttgaaccatcacggcctaatcacctcttagaggccccacctcccaatattgatacattggtgattaaatttcaacatgagttttggaggggacaaacattcaaacagtaggattaaccatttttattcttttggcaaaatatcagaagcgggattggctagaaaaatcctaccattcaaaaaatgctaatatcattaggcctgatacattaaagcaaagtgaatggtctcaaatgtggggaagtggcacttctgatattgcttttcacaactaatttctggatggagccacgaatggaaaacaattctttaattgttaggaagattagcaaaacctaggaaagctaggcagctttgaaaagaaaaagtgtgagggtctcggtcccttaatagaaaggagaaagagacctttagattgtgagagagacctcaaacaatgtcatagatcatttggctgctataacaaaataccatagactgagtggcttataaaaaacagaaatttatttctcacagttctggaggctgggaagtccaagatcaagatatcttggtgaggaatcatttcctggatcacaggtagtatcttcttgctgtggaaggggaaaggcagccttctggggcctcttttataaggtcactaatcccattcatgagggcttcactgtcatgcctaatcacatcccaaaggtgccacttctcaatactattacatcgggggttaggattcaacatacacattctagggggaacacaagcatttatctcatagcaaacaaccaagtcaccactgattttgcccctttgacaactgagtcagtgtgtgttgggtggagggccagcgtttcttagggaaagaggaaccctgatagggaaacatgccatctcttgtgagcacactggacaagtttcccagggctgccttaataaagtatcacaaacttggcttaaaacaacagaaatgtattatctcccagttcttgaggccagaagttcataatcaaggtgtcagtagagttgtgtttcctcccaaggccctagaggagaattcttccttgtctcttccagcttctggtggctccaagtatccttggcttgtggctacctcacttcaatctctacctccatgttcacatggctttctcctctctatcttctcttctgtctcttataaggacatttgtcactggatttagggccaacctattaatctaggatgatcttacctcaagatccttaactttttccaaataaggtcacatctgcaggtactgggggttaggacttggatgtatctttgtggcagccaccattcaacccattacataccagtggagtcaggacttcagacactcacattatatgtcctaactgttggttcaaaaactatgctcattatagttgcaggagaagtgaaaattccctgagacactgtacccttgttacatatggtggtaattgccctgatttttatcttcttttaacatgtagcattttacaccagacccagggaaatttgctggagaggttgtgcttcgttttgaactgtagatgagcattttgtttccttgttggttggctgattggttaggacgtatttgggagaatgccatgggttgggaggtcggtacagtcctgagaaaaactctttcttcagtttgtgctcaaaggccattgtttgtagaaatgtcctctatgctgggactgggtaaggttttttcttcttgttttgttctttcattttttttttctcttagaaagtaagcctgagaatctatgatctgctgagagaattacttgtaaatcagaaacttggtgtgtcagtacccaatctcgcagccctcctttgtgagagaataattgcagctgccccttgtaattgaatttcagagaaattccaatagatcaacagtcaggtgggctataatataatgctattgttgtattgtcagtgtgcaagctgttagtgctaatttgactttctgccgtagacttgtagacagtagtaattgcaagtaggagcaacttcatctgatgttcaggaaaaggaagctaaggggaattctgctggaggaagtgtcagatgaaggtgctctgtagagagcccaaagcccaaacaggtgaccctcactggtcaccgctgttgctcatgctgtgttgagttttgcggcattaagtatgtccacaatgttgtgcaaccaccaccatcatccatctccagaactttttcatcttcttcaactgaagctgcagactcattaaacactatctctctattcctcctcactccagcccctggcaaccgtaattccacctcttgtctctatgaatttcactattctaggtacctcatataagtgaaatcatacaatatttgtcttttgtgatggactcatttcacttagcataatgacctcaggattcatccatcttgtagcatgtgtcagaattttcattcatttttttttttaaattttatttttactttatttatttttgagacggagtcttgctctgtcatccaggctggaatgcagtggcgtgatcctggtcactgcagcctccgtctcccagattcaagtgattctcctgcctcagcctcctgagtagctgggaccacagcaatgtaccaccgcccagctaacttttgtatttttattttttacttttttttttaaattttttttagtatttattgatcattcttggatgtttctcggagagggggatttggcagggtcataggacaataatggagggaaggtcagcagataaacatgtgaacaaaggtctctggtttttcctaggcagagggccctgccgccttccgcagtgtttgtgtccctgggtacttgagattagggagtggtgatgactcttaacgagtatgctgccttcaagcatctgtttaacaaagcacatcttgcaccacccttaatccatttaacccttagtggacacagcacatgtttcagagagcacggggttgagggtaaggttatagattaacagcatcccaaggcagaagaatttttcttagtacagaacaaaatggagtctcctatgtctacttctttctacacagacacagtaacaatctgatctctctttcttttccccacatttcccccttttctatttgacaaaaccgccatcgtcatcatggcctgttctcaatgagctgttgggtacacctcccagatggggtggcggccgggcagaggggctcctcacttcccagacggggcggccgggcagaggcgcccccaacctcccagacggggcggcggccgggcagaggggctcctcagttctcagacggggccgccagtcagagacgctcctcacctcccagtcggggtggcggccgggcagaggcgctcttcacatctcagatggggcggcgaggcagaggtgctccccacatcccagacgatgggcggccgggcagagacgctcctcacttcctagacgggatgacggccaggaagaggcgctcctcacttcccagactgggcagccgggcagaagggctcctcacatcccagacgatgggcggccaggcagagacgctcctcacttcctagacggggtggcggccgggcagaggctgcaatctcggcactttgggaggccaaggcaggcggctgggaggtggaggtggtagcgagcggagatcacgccactgcactccagcctgggcaacattgagcgctgagtgagcgagactccgtctgcaatcccggcacctcaggaggccgaggctggcagatcactcgcggtcaggagctggagaccagcccggccaacatggcgaaaccccgtctccaccaaaaaatacgaaaaccagtcaggcgtggcggtgcgcgcctgcaatcccaggcactcggcaggctgaggcaggagaatcaggcagggaggttgcagtgagtcgagatggcggcagtacagtccagcctccgctcagcatcagagggagaccgtgcaaagagggagagggagagggggagggggagggggagagggagagggagagggagaggccagaattttcattctttttaaggctgaataatctcttttatggttatgtcatattttgtttatccattcatccatcaatgaatatttggattgtttctactttttagctattgtatgtagtgctactattaacatgggtgcagaaatatctattcaagatattgctttcagttcttttgggcatatacccagaagtggaattgctggattgtatgggaattccacacttaattttttgtgagaaatcagcatgctgttttccacagtggctgcatcattttttattcccacaagaatttcacaagagttccagtttccccacatccttgccaacgcttgttattttccattttctgtttatttgttaataatggccaccctaatgggtggcaacccatttccattttcaaatgaattgtattttcaaaaaagttttttcatgtttcttgtttcatgtgtttgttttgtttgtctctttaccttgagctttctgtttttcctcagcatttcctgatctcctgacatcttgtttcaaatgtctaggaactctccctgtggccctcctctctttggaatgagaagttcagatcccttacagtctcttattgttcttgtttttatttgtatatggctctgaacagtatttctaagattgggcacagcacaaaacaaaacggctgagagagagagagagagtgagagaatacaagtgctctactccacccctaagagtggaaggggtctggatgcagagggattaagcatagttgattctcagtggcttccagtcagtcttcctaaaagaggagaggagcaatgtggtttcttaaccattctttagctgctttctaatgatcttttctttgtgggaggacatttcaaggtttccctgagcaagaattttctctttctgtcctttgcacagcaactggtaaactgagatccttaaaaaagtaaatatttttaaatgtggaaacatcgcttacaaccaagtgaataacatctggctaacaaagagcatggcactatcagatggaattagggcacatgcacgcagtacaaaagctccagatgctcgtgttaattcagttaaattcgagtcaaagaatcagtggagccggtcctttggactgactggtcctataaatacaaatggccaacgcatgcccagcctggctcattgatcaaacagagtagagatttattgacatatacaggaatattctttttctactgaaagatggctatgtgtgttgtacttatttctaaaattattggcatcatgaatgacacattcatgaggtacctgccctgtgttcagaagactgttaggtagagaaggagtaaagaactgcactggtgatctcagaacagtgtcttctagggcatgatgtaaaggaacttgcagatttcatgttagagcaacttaagttatggcttaagtcagcggtcagcaaacgttttctgaaaagggtcagagagtaaatattttaggctttgtgaaccatatgatctctgttgcaactactcaactctgtctttgtatctggaaagctgccatagacgttatgtaaacaagcgagcatggctgtgttcctaagactttattcatgggcactgaaatttgaatttcctaccatttttacctgacacaaaatgtgattcttcgcttgagtttttttttttttttttccaaccattttaaaatgtaaaaaccattcttagctcaagggctgtacaaaaagatttggcccatagatttcaatttacggaacccgtggaagtcatagcttccaagaatgtttctttttgatgctcagatttttgtatgtgtaggaaaacttggatgcaagcaaaataaaaagtatgttctagcaaatggtttacaaagatttgaatttatgagatgaaaacaaatatttccggccacatgcctcagtgtaattaggtttgctgatttaatgtcttcctgaaggcagaattttaggtagcaaagtgagcctgccaagtaggaaaggaagacggaagtttaaaaactctagcactgcctatgaaatcttaaatcctgcattcatgcaatttgcatgttcatttcctcttttacaaaatgctcctggaattcttatggtttcattgttagtgaaaattgtttctttttttccccttcacaatcctatattacaaattctccaaacctggcacttcacggcatattccttttgaatgtctttaattctgcaattttatacacccccttatcttacaaatttaattagtttccagaagttctgcagagaaaatgggccataataattcttgattattgccacttatcttcttataatttgatacaagaggattttattgcatttttaaagtagttttaatctgaaaaagatagtcctctccaagtttaacttcatgcagtagtaataatttaactactatttcctggttctagaagtatttttctatctaaaaagaaattgcttttctcaaattattgtactaccattgtattagtctgttttcacactgctgtaaagacatactcaaaattgggtaatttataaagaggtttagttgactcagagttctgcattgctggggaggcctcaggaaacttacaattgtggcagaagggaaagaggcatgtcttacatggctgcagattagagagaaatgtgtgagaatgcaggaaaaactaccatctataaaaccatcagatctcatgagaattcactcactatcacgagaacagcatgggggaaaccacccccataatccaatcatttcccacaaggtctttcctaaacacctgaagattaccattcaagatgagatttgggtggggatacaaagtctaaccatgttatccgtgataataatttaactacttcgtggttctggaaacacctagaacattgaagttctgagttatcattgaccagaacaatgccagaaaaatttcataccctttaacctctcagcataagccaattcttgataatcccggtcttcacattcacaaaatatggccaagcaaagcttcctattatgtctcctaccctaccaaaacattcaataagagtgtctagtaaattgtagaattaaaatatttccattgttccccactatactacctgtacaagctcctgatgcatttggtttttagtgtctcaagcgtagtaggctcataagaaaattcacctccccagttcaccctttgcaggtttcctttgtaagtcatgaaacaaaagagctagaagagacattgttcatttagtataatttatcattttaaagaagacaaaaccggcactcagagatgctaggctcacactgtgagtgatttacagagtcaagatgaggagaatccagttctgctgattcgctgcagtgcaaggtcctgcccatgattcacttgttcttggggcattgtcgtgattccttgtttctatcttagaagtcaaggaggtgtcctataaaagctttcctattcttagttcactcttctgaatatataatgtaaacaactaacaatgaacaaagcagaaaagacaaagagaacataagagagtccaggtaatccagggtctgtacaaacaactctttcatacaatcaggaactggtcatggtggcataagtaataactggcataaatgtaaaatgaataaagaccatatgtttgcccttcttcatgttggcagaacatatgtatgttaccagaatttcctatgctttagagttttcctctaaaaccctctgaaacttaactaagctcaatggaaaaatgaagccttttaacagttgttttgtaagaaaatttttatttctgtatatttctgtgtgcatgaaaaaaccacacctgtattaatttgttaaaacttctgtaataaataaccatgatctgagtggcttcaacacaaaaatgtattgtttcacatttctgaggactggaggtccaagataaaggtatcagcagggttggtttcttctgaaagctgttagggagaatcattcccaggcctctcccctagcttctggtgtttgctggcaatctttggtgttccgtggcttacggaagcatcttccaacctctgcctttatattcacgtgccattcttcctgtgtctttgtccaagtgtccttttcttataaggccaccagtcatattgatttaggggcctgctcaactccaggatgacctcatcttaactaattacatctgcaatgaccctatttccaaacaaggtcatatcctgaggtactgggaattgaaactttgacctataagttttggggggcacagttcaacccacagcaacacccttcactgagatattgcaaaaaataagataactattttgttcgctgtagagtttcatatagacacttcttgagctgaaaaatttttgttaacagtacatgtgtttggacactgaagggcagtataacactacaaataatttcaaaaagaagtttatggcttgattgcttcagaaattacattgttatggtgattttgtttaaatgcatcaataactatggctatcatgtatgacgattttaaccttatttatgtctgattacacttaatattaaagtcagacttaaaacttgtggataacacgttgaaatttgtctaaatcagaaacaaggagagaactttaattttgagatttgcgttgaataactatgccttttttgtggttttaaacctttaaattgctgttgattgtggtagttcatgcttagatctcatttcctttagcatcaaggaagttatgattggcgtggacaaatgtttcagccttgagggaattttcaatcatctacttgtcaggtacttgaaaagaatattatttcaggggatgcaaggggaaagttcatcttaatttagttattgcactgtattcttcacatgtaaaagaaaaatggataatatacagaaggaaagaaaatacaattttcatgcactttggtcaatgttgattgcagtttgaatgccttatggttgtctgaatctaacagctgttagaccagaataattttcaatgtaaaaccagtacaaggaaaggacaaactggaaaccactgatttattttgctctctcttccatggtagttgactctgagagtaatcttggaagtttatgtttcaccaacattaacttaagggctatactgctattatttgcttttctctgaacacttgcattgggcctgacatgtccatgcattatctcatcaaattctttcaatcatcctgggaggtagatgcaatattatcctccttctctctgtgaaggaatgtgttgagtaggtgactcaagtctcccattcatggaattgagttttaaacttaagtttctctgactccagagcctatactcaaaacctctattatatgctgttctatattgctgcattgtttaaagtgaattggaatagaaaaatatgtaaacatgagcacgttctcatccaaacaacaaaagcatcttcctgtgctaggtagatgttctgtacataaatggactggaccactagggacattcagagccaatcatgacatcgtaagagaaggccatcagtaatatgagacaagtttgtagaagaaaaaaagaatcatgtcaactcattcctgatttgtgagaaacccaataaataaaaatcaaccattagaaattatttgtggaaagctctgatttttttttggccaggcatggtggcttatgcctgtaatcccagcactttgagaggctgaggcaggaggactggcttgagtctaggggttcaagaccagcctgggcaacatagtgagaccccatgtctacaaattttaaaaattagccagctgtagtggtgaatgcctgtagtcccagctcctggggaggctgaggcagaggatcacttgaacccaggaggttgaggcagtccagcctgggcaacagagaccccatctttaaaataaagtaaacaaacaaatgaataaataaaacaataaataatctgatttttatcctttcactctgatgtcctaaaccccttttccccagattgctgagttttatttactctgcttccttccaactaaagctaacatttctaatagttttaaatggccctggtggttttttaacatttgggcagagaagatgtggccagaaggaaaattactgcacatggtggatttttatttttagagagagagtattcatttttaaggtgaagttggtagcttttgaaaccatgatttgcccttgcagccagaggatggattaaggggggagaaagggaagtagaaggagcttcttggctttattggaggggtttagttttacctctgctgagctggtaacatttgctctgaaatttcctgttatagattctccactttttttctctcctcctctctccaggaaaaggaaagggatagtcatgatgatcaagcattggggaagagaggaaggacacagaaaacaatctgttgactaacacaaccctttcccaggacaggaatgtaagcacatgtagatgcactcatgtacatgtgcacataaacatgcacacacaggtgcacacacacacacacacacacacacacacacacacacacgacttgctgtattggttttttcatgagctctaatttctaggagtggtgggtcttgattgtgccctaccctgcctttggaaattacaggagctgaagtgtccggaagctggtagtctcccctgagatcatagaaacagccaagagtactggctctgcacatgttaaccatggctgctggaattctcccctggagactacaaactgcctgcccacgggttgaatccaggacatggacatgtctcatttggaatacacaatgttttttataaaacacgattttatcaccaactttttaaaaatcaggggctttcaaatgaaaatctgatttcactctctcacagaaaattaatcaatctggcctactttcctgcatgacaagtgttgagctgccccatttataggtgggggggtgttccaggtcagtgcagtccccatcaatttcctactgtctgcctgtgttaatggccagtgatcgccctgtttgcatggtgttttattatgcctggcccacttcactgtgtatgttacctgccaggtctctgtaggtgtttgaagtcatgatgctttatgccttagttcatgctttgtggggagatggaaaccagccccatgttactcactcaactctagatttaaatagaaaagaattaattgtagatgctctaatatacatagtatacaatgaagacaaagaggaaatattgacctaaggtgttttcatcaccatatataatttttaagaggccattaagaatcaagtttgtattcgtagttgtgtacccacatcagaatttatttgtaaaaacgtaatgtcttgaaaccaagctttcattttgaactgtacttttttttatcttactattgccatctctctcaaccttttattagctgtgtttagatcttaatacaattatgcaaaaacagtattattattcaaacaattccagagaatgtttccatttataattttaagagctcacttgctctcaaatatatttttggaagaacaagcatctttctccaatattttggaagccatgtaaatgtctttagtagctgcatttaagtatgggtgaaaaaagtaaatttattnnnnnnnnnnnnnnnnnnnnaaatgtcagctttgtgggattgttgttgtttgaaaaacatcatttacttaagaagactaatttgcactgtataaaaaatgccttttaatctcaagttatatatgcagagaagtagattcaaacaagaaataaaaatatttaaagcaacagactcaatactttaacgttaagtgacctttacaaatgttcctggcaaaagcatacttccatggctttgggaatattattttacacaatctcaggcagcaagccagtgcacaagaacataccaggcaaagtgatttatctttatgtttttagctctcaaatatatgccaatacttttgatacttataattttcttgcaaaactttttaataatctgattttaccaaagagtccttgtgagaaattgatgtaacgtcatgtgtcaagtctctcttagggcctcacacatcataggtctcagcactcatcccaggctccttctaaaaaacatcaagagggaaagtcatagcaccagaatgcatttgtgtgcatgttgagtaagagtcaacaaaattataagagaacaatgagttgctttaaacacatttttaaatcctgactctatctgaggatgttgcctgacacagattttatgggttgggtttggttctctgggtttgaagcctgacttttgtaactttatctgcatgccaagattcctgtaaagcaccttacactagctgattagtgactctttccctttgctccaagtttattttgccccaaacctattctattaatggtgttttgtaggcttataaacacttagtaggagaatctcagagcatcatttctttgttcttcatcttgacttttcaaaatagtgaccaccctaacaaagaacatacaataaactgatacaagaataaacatttgaaaatcttttttgaaggtatagttatttgcaaagttttatatgaatgcttttgaatggactgaatccaggccagaggagcattttgtatgggtttacgtagtaccacagattttattttttaattggaaatgttaaatttacaacaattcttcctattaaaattttttagagaaagtaatgtgggagcagagtgcctgatgctgcttgctttggacagggcatttatgatccagtttgccactgatgatgttttttttgttttgttttgtttttccccagccttcgctcatccatattccctacctatccctggttggtcctgtgtttatgactcctgctatgaacacctcttggcattggtgatgagaacttgaagtgtttctcagaatgacttgaagatagcgttatgtccaatatcactccccaggcattaagcagagaaccagccatatgttcagtgccacattttaccccttaaggatctccaaaatattctgtattatgtggcttcatgtttctcttcatagttttatttcttctttttccaattatcacagtaagatgtttctgcctaattagaaaccatgccacaatgttaactacctacttgcatgaatcttttgtgcaatagaatataagtttgcctctcagcaatagaatataagtttgatcttttcctatccctgaaaataatgagttcaatcagatggctcagataagccaatttcctgggcttggtcacccttaatcttgaacactcatcttaaggtaattgatttaggttagcttctgggttcagaccagagtttatttgtatcctctccagagaaactactgtgtcacagtttttattttcttggactatcctttaattccttaagtgaaagaggggcaagtaggtgagctattctaaaaaggaggtagacaacagtaaaggatgtcttaatgagagaaaccagaggaataggactgatgtggtattaacttggcaaaagaccaggattggaaaccttctaagtaaactctattcttcatacctctctttcccagatatttaagtttagtattctattcttaaataatagccccaaatcactcagacagatggtcactcagagacctacctactatgccttactagtatcagcactgacagcagtagctgctcatccctggtgttctctgtaagccaggcatggaactgattactctacatacattatctcatcgaacctgcatgaaaccctacagggtaagcattggtaggtccattttacatatgaggaaactgaggcttgaagatgttaaatagttgtccaaagtcacacatctattaggtggccaagccaaggcacctggtcaatatttgttactagggtgtcattttacactttgctctagtctgaacgtttgtatccccccaaattcctatgttgacatcctaacctccaaggcgatagtattaggaggcgggcctttgggaggtgattaggccattaggttacaagggcatcatcctcatgaatagaatcagggctattattagaggccccagagaggtcccttgtcccttctacctcgtgaggctaaagtgagaaagcaggccctcaccagacaccagatcatctggtgcctcgatcttgaacttccagcctccgggctgtgagacacaaatgcctgctgtttacaagccacccagtctaggatatttttgttatagcagcctgaatggactaagagacacatttttaaaaagagaatgaaatgttagcattaaaaaaaaaacaggatagataataaaggatgaatcatttagaataggttgcagtctgcttaggtgtgtctgagtccatgaaagatggtgatccatgcataaagggtgcattcctgggtcagagggtatgttcaacagaaggctgcaatagctgatgtccatgtcaactacagcagctgagaacacatccaaggaaggaatacactttcaattccataattgactttttctgattgacccagcgaatcaaattgctaccatttcaaaggagaacttttcctttttctatttctttaagcatcagcctgttagtttgagtgttatctcctagcctattctgaatttcaacagtattatccattttttttaaaaaaaagtcttagagcttcatgttttaaacttgtaaagagtactttgaggatctttattttcttctttctgttaattattattatttaactaatttattttttattcacatattttcctctggccaagatccagagattctttaaagaattttttattagaagcttctagccataagaactagagtaaaataaattatcactttcataaatttatcatcaaagaatgaaaacaaaaatgtaaagaagggatggagaatgtgttttatgacaataacgtaacacgcttctaatatttggctataaaactgattgtaaacatattttagaaccagaaacatatggaattacatgattataggacagaaaaattcacagtggttgacttataatatcatgtggcataaaaatgttcattgctaagaatggagagaagaagccaagtatggaatgaaattggaagaggaacctcctctcaatttagttttggcaggacgaggagccccatatgtgccaagttttaactgaaagctaattataatggtcacattacgaattgtgcagaaagaggaaggttgttgacttggcaccttagatacataggtaactagatttttttttaaaaaaaaagcagtgtaagcattcctttttggtaaagagcatctcattaaactgttagctacagaacgtttaagcctgccatctttaactggtattaagaagtttaagaaattacaaatgaagtattttaaagaaaaagaaagttaaaacagaaataatgtgccatactcgataattgcaatagatggaatgaatttattcgtttttacttctgtgatggtttattctcttgcttaaaatatattatttaaatggatgacagcaaaatattttggtgtctctgatacaatggaaaacacctgataaagacacaatgacttctgtggcttcaaatgcatccagggctgcagagatatcccctgtttcgtttgaagagggcgctcttgtaaagaaaatatccttgcctaggccctgctgagaaactggcccagctccctgaagtcagcgtcaccatggagatcttattccagtgagggggaatggattccacggtcctgctttggaaatgtgtaaacagcagatgcttttattgcctttgtttgaatctctgcccttgcagagcaacacaggccggaagctcagaggagaggaagtccatatttgtctgtagcgttttgtttcctcgtaagcagcttagtctcttgggacgactgtgcgtaatgacaagttaatggaaaagatatgaattcagatttcacataaagagagtcagaaaaaggaatatgtcttccttgagccaaaggaataattcgaacttccttcttttaaaaaggggggtttattagacaccgtttttattatatactattaatatacaatatatgtggtaactattgatcataatgattttatcagctgaaatttataatatgcaaatgtgagggtgcatgatagactcattttcctacagcttggtagttaacagcctgcatttgggttctaagtgacctccgttcaaattcctactgattttctgtttaacctggctggatttttcatctgtaaaatggggatactaataccaataaattattgtcaaatagagtttgtctctttcagagttgaaaggattcagtgttatcatgtatattgaagatgaaatgtagtaatgtatacagaactattcctgttggtacatcacaccaaaaagagtattttcatatttattttatctttatcatataattactgtgataaagcatattagaaccaatgcagtaactgataagcaagagaatttaagtcactcatccaagttcatgcaacagttataggccaatatgggctcagaacccaggtatcctgaccctcgttcaaggacttttcccagcacatctggcaattataatcacccatgttttttgaggtattgtgggtatggcataatgctaagcaccatcacatagagtctcatgcaataaatggactgtttttcattggagttaaaaaaaattcaacattggagttagatttccgtataataaccaaagcactaagtaaaaactgaaaattagtcaacagaatattaagtgtcatgtactataaacagattacctggcttatgaattgcatatattacacatacagtatcttttgcagtggagatatttcaacagagagcagttttctcagaggaataaaaatctctggttgtcacgaaactagaagttggtgacagatctcaagaggccctgagttaagacagtggtccttagcacatttgttatatcaggtgaatatgcttacaaatgacttttcgcagcatcattctgtggaagcctaatggaagtcagtggtataaaccgtgtcccacctttgtgttagcagcttctaccagctttccacccattctctgatgctaattcaaagtgtgtctttctttcatcaaagtaatgatactgatagaatccttattcccaaagcaagaataggcacgcgtttgctacattttcttcaaatcaacttagaaaagaagcatgttggtataaaacttaggaggtacatactgtgtgtttgcttttttaaacattttttccatttatattacgtatgcactcgatttatacttatttagaagtaaaaatacatttgggctaataaaaaaagctaaactttattgaggacttattctctttggattcatcgtcttaactcatcttgaaacaactgatatgataaaccgagacacaaagagattaacatccaagtggaagtgctgggttaactcagaagctgggctctgttgatagtgctgtgctcttagggaacagcttaagcagacatctccatggtgccaaaagaaatggcacctaacgcgagacactgcctttgctctgactgaagctaggatctacagaaacaggactcatttcaagatagctgatggaggtttcctgatttgcgcaagtcagtgatggtggcagagcaagagctggagtgatatcacctgtctccagcttttgacaaaaccactagaaggtaatgtaagtcactctcggctgaattactgatttgcaacaggaattatttggatcataagtctgtaaacatatactagaaaagaagaggtgatggataagggcagccatattctcaagacctagcccagtgactggcaaataatgggcactcagtaaacacgtattgatcaatgggtagaggttcagagcagggatgagtcactttggattagagtggatagagaaggtagggcttgaatctgcaactgagcaataggctataggagggattcgaacaggcaaagagtaagaaaggatactagatagaaaaaacaaacacataggaaagaacaagccctttttcaagaaaaacaggtaaagcagataaattgaaacatttttcaggttaggacatagttcttccatccgtccatctatccatatcatccatccatccatccatccatccatccatccatccatccatgcatccatccattaatccatccatcgtccatccatccaacaaatgcttatttaagtatcaggcaccatgtcccaactaaaaaaaccggaagcttgaaaggtaggttggggtcagattttgaggcatctggaatgccaagctcagaaagatgaactttaacttgaggatagtaagccatggatggctttctgagccatggagagagatattgaaaatttgtgaaggaagagtagactgacagaattaaacaggatggattaaacagaaaggcggtagggctgagaaaatccactagagtaaaatgccagggtccacaagcaggaggacgagccctggactgacttggtgctgggagtaaaggagaggagggtgggagaaaggcctgggtttgaaagttattgcaggggcagaatctctgaccgtagtgaaaccacagagaagagcaggctctgacaacatcaactctcctgggaggtacaggagcatggaggtggaacagaaaagcttggaaaggtgcttctccacaggttggacatctctcttttctcaaacttgatacttctgcctttgcgtctgccctgtatctaatcatgatgaatgcttctaacatctgacacctactgagcaatgaattcatggcagagaggccaattgtcactatccctttgtaacaagaagcatgtttttcatccataaaacgaatcttttaaaaaactggtaactacactgaatctttaggacaccaggtttcaaaaggagtaacactgcatagataaataaaatcagattattgtgcgaaacactggttttcaattcctccacctttttataattccttaatatcagaatgtacagtaatgcctcaaggaaaattctcaatgtacatttgtctaaagaagagggttataaatctccctctgttattctttcttgttagttggaatacattacagctacctctgtatcaatgataatgcatgagcgcgtggataattgaagtgcattgaagtgcacagattatcctaaattcatctttattataaccttgtgtttaagtctcctttgctatcaactctttaagaagacttctagcaaggagcggttttataaagttgaatgtgatctactgaccatacctaccttttccaatgggaagttgtgagcaggaaagtggttacatgatttcgaacagaaagcacggaaaacatcagagtttctgttagttcaacaaattctctcatttcaatcactgaaaagtgagaggtaaatgaatgcatgttgcttggcactgaggtgacttgcccctgcctttttgtgctgggtgatgacagttacttttctctaacaatcattgcattccttttatattcttggagtctcagtgttggaaagaacatcaaaatttcatcacgtttcatttcccgcttgccaaaaaaaaaaaaaaactgcccaagatggatcattgtttgttctgttctttaagtctcagacttggagaatggtcatcagtaaactgatggaagagcattggctagcaacctgcttaaaacctgttgtagttttgatgatggttatttttccacatagaagtggcgtgaaatatgcacacaccgatgagtaggatgtggttagcaatcagatgttctcaaatgcaaatggtgggagtgggaatgtgtttcctttaaaaatcaatatttttcatctatcggagatacatcatcagaatgtttgatgtagagtaggcccatcataaatgtctgagtgagtaaattagttggcagtgaaatatttatcagctgcagaagcatggccgcctaggagcagagtggataactgttctgtctttcctgtgctcccagagatcttttcacctatggctgtcagcccacttccaaagggcactctgaggaacagtatctgtctgcatgatgctgtgtgagaaaaaagttctggaatcaaataagtttgggaaatactggatttttctatctcttctttgacatcatggtgtacattagaacattaagggttttgagaatttggaaacaaatattttccaaatctgtttggctttagaactctcttttgcacaaaacgtattaatcatccacactttaggagatactcctcttttgggttaattgttcacatttgggtggagatcatgacttcttcatttctgccagatgctgattggaacgtggtaggcattcagtaaatactttctgtaaatgaaatgtaaaatgaaaatggccatagggggttgattgagatgatgctagaagaagctatggtgtcatgaaggtaaagatgaacaggattgggttggagtcagagagaggagtgaaatggagggtgggttctgaattcaaatggtctgcttttaaaccaagtagaatatcagagcttctgacatctctcttgaagcccttcagtttatcttcctcagtgattacagcctccctcttaaatcccctgtgtttttaagctttcatgggcagactaaacactgacaaccgtggatagtacctcattcgtgcttaatgttgattatcaaactcttatagaaattccattttaaaaacttcggccaagtgattatttagaaatgagacattatttggaaagacagtctaaagcccacacatcattgcatttggggactctaaataatgctgcgttctctcaacttactattccatgtcttacagcacatgtaatgtgtccgagtagcattcccagggactaacaaaaaagcagaactccagaggtgcccacagaggaaactgcagacaagtcagagaggagcgcattacaaacacagggccaaacaatcgagcactccagagaggcttgtctctggtcctcaaatatccaggagaaaatgctattacaacatctatttcatacagctctgaatgggtgcctgcaactggccatcttatgattcgtccaagtggtcaaaggaaattgaaaatagttaaaaatcagcagtgttcctagtgttggtattacacataatgtgaacaaaatattacatagtctatccaaagacagagagcaagatgcttgaaaattattcattttgatcacatttacttgcaaaaatgacatttagctttcttaaagttctcattggagagtaagtcgagtaaatatcaaaaggttgccttaaaacttgccttttgcatggcaagaagaagttgggtggcctgggagttttagagtttggcagagcttgggtggtgggcatacacttaccataatctctctaagcctaagcaatagcttaatttatttattattatttttaaaagagtttcatttttctttcaactagaggtagaatgggtttaaaggaggtgatgttcatatcatgagagaagtatttttctttggtgattatcgtgtgtatatgacagcatcaattactaaacatatttgttgttaaaaccatatgctgacttgtgttgctatcaaagagtattacattccgaagaggaaaggggcactgcacctcctctattatggaaacaaagggctcttacctcagagcctgttgatatatcaagtaataaatgtgacagttactggttctattttccttatcctgttttcctgcagaactgaaatggaacatgtttcttactagtaacagatgctcgaacccctcttttgaaattcctctgtggaagctgccctgttgattccattaggtgggaaggggctttatgcagatgtctgctcgtggggttgcattgttgtaattgctgttctaccacccttgctgagtgccatgcttttctcttgtaggtgatgtgccttcaggacttttttggtgatgatgacatttttattgcatgtggaccggagaagttccgttaccaggatgatttcttgctagatgaaagtggtaaggaaaaaaaaagttcaaaaccaggggaaatttgaggcagctttcgaaaatgagctgcaccaggccaagattatgtcaactccaaagctaccaaatcagtttcagatcctcacccagcgtgtcttttccatatcttggatttctttgattttttttttaaatatggaaaacagatgaaatgagaattggaaaagttaaatcatttagaagaataagtaactaatgtctaatttataaccacttaataattaaattgatgttatgtagaaaatgatggtgtggaattctacatttttaatttttttttcacggtttttagctgagggatttgtcatcataaaataatttaggatgtttctaggctcagctttcaggtggcttcctttaattcctaaccaggcaagtggtttgctttccctttttcctttaaatactgtagaattcatgtggcattagcatctgtgaggtatcagaaaagagaagttagcttccttccattaacaaactaaatgtgctactctgtaatagataaagaggggatggttataaagagggaaatacatgtcttaggaaatgaatgtgaaatgttgtggctttaagaatgatatttttgatactattaatcatctgagaatcttagcactatcacaggtaagattattctaccaaacaaagattattgtagcccttctttgataatgttactctaatttaattatgggagtattgcatatttactgacaacccaaattctgcgtagttggaaatgctttttgaaatgataatgaattttttgcttagatgaatgcagaaaaacaaatcagtgagcttttgaaatagtggctgagcaacacttgagcattaacaataatgggaaaagtgatgtggtcacttgacttgacttgactttcacctgttctacacaggagtggtctcactccaacactgcagatgtgtgttaatgcatagcatctatattatacacatatatacatattatcagttgtatgcatttaggaactacaattctttcatttaaaaatgacttagaggatgggcatggtggctcacacctgtaaccccagcactttgggaggccaaggtgggcagaccatttgagcttaggagtttgagactagcctgggcaacatggcgaaaccctgtttctacaaaaattagctgggcatggtggtgcacgcctgcagtcctagctgttcaggaggctgagatagacagatcatctaagcccagggaagtcaagggtgcagtgagccctgattgtgccactgtacttggtctgggcgatagagcaagaccctgtcccccaaaaaaatgacttagagtgtgtagggagggataagaatttttaaaattgcccctttctcatgaaaacttcagatgcccaataagaatataaatagatgtgtcatgtgaagagatttattttggttcaaggaccataactagacaagtggtttggcatccctttttctctaaataagttgactcaaatacattccatctttatttctgacctacgtgccctttgaggcacagatttttgtaaatatatcacaagtatagtgtcctcagggaaggtcccccccacgccaccattttaagaacagctttgccattgtgtagaacaggtgaaagtcaagagtcagacagaagagttgacagcacggttttgagaaaaataaactgccctaactttccatttaaagaaaatagctgcttgtgatagaatggtttggcagaccagatgcattctgaaatgaaagtctgtttgttgctttgatatagaaaacagcctgtcaaactcgacctggaatacatgtctttttcaaaccagcaagcagagttggccacagcttccaaactctggggtctctatctaggccccagatggacttggggccccttctccctgctggccaggctgggtgagctcacacagctgggcttcccctccgcaacagccaatgcgctctccacccaggatgccgcagctactcctgtgcacctgctatgaccagcaggtagactttctgagaagtacaacaggaaaatgccagaaattccataatagagtaggtgcactgcccctttcctcttgctatttcccccttagaattatttctcaatgcccacaggctgggtgcagtggctcacgcctgtaaacccaggactttgggaggccaaggcgggcagatcacctgaggttgggagttcgagaccagcctgaccaacatggagaaaccccgtctctactaaaaatacaaaattagccaggcatggtggtgcatgcctgtaatcccagctactcaggaggcttaggcaggagaatggttgagcctgggaggcggaggttgcggtgaaccgagatcgcaccattgcactccagcctgggtaacaagagcaaaactctgtctcaaataaataaataaataaaagaataaaaaagaatgcacacagattatatacggagatatgcacacaagggctcacatgcaaacacacacacacacaccccaggacaccttctccatcttttgtggtttggccttctgaaggaccacttcaaactacttagctgagaacttcacatcccttccctggatgaataataccctaaccctttcttggtgtgaaatacatttgctgagtaacgatgtcctcccccattccaaaagaaacacatggatatggaaggaaaggggctcaaatagaaaaacgatctaaattgagattttacttccttggatgaacttaccccaagactaaattcacacattgacaactgcaattttcctgttgcttgtacagcatgttctagcgctaatgtattaacatttgaatctttttttaagtgctccgagcatgatttagcccagcttatctgtacttgctaagtggtatttgcacatcgatgcttcatttggccttttccatagtagcttccttaaaggggtgtcagcggtgggtacagacatcttcagaattactactcttgccctgcgcagggctgtgcttcatttaaggtgccaagaagtggccttttgccacaaggcggcacttttattttaactttccaaattaacctggctcccagtgagttcaggatttagcaataatacatccctctaattactgctaggaaatctcctaaggatgtctcttaaggtccatccttggagaagatttgccattgtagatgagtatttcatggggccacattggagccagattaatatcggaaactgccagggagactccttcctcccctaagtttgcacattcggaaaataacaccttccttgttctagttcagaatgtaaccattttagcgatatcgtcatcagtcagtagaatcttagcaccttggagatggtggctagtgcactatagatagagacaagcagagaggccagcagatccttcccttgctgtctaatttagaatgatgaaacagaggcagggaaaatgtcacattggagacaggaagctcaacatggttttgcttctatgttgatgacaaatggacgaatttgtaatccgtagccatttaaaagtgatagggttttgttgagaaaggatcaccccatgcttgggagggacagtgaactccttggggatgagcctgatgctggatatcaattcttgtccaacctgctggcctcaaagccagtacccccactctgcttggcttgttccttcacccattcattccactgccatccggagcctcaccttggccaggcctgctgcgtgctcgggagtccagatacctgtcatcctctctttcatcttttctcagattattctgtttttttatcaactagttcctaactgctcttgattctgatgttaataggcgttaccttcaatgtctattgttttgcttagatgctgaatgaatttcctagggctgctataacaaagtaccacaaactgggtgacttaaaacaacagaaatgtgttggctcacagttctgaaggcaagaagtccaaaatcaaggtactggcagggctgtgctccctctgaaggctctagggaagaatccgtcctcatctcttccaagtttctgatggctgccagcaatccttggcttgtggcagcatcatcactccaatctccacctccatcttcatgtaaccttctcccctgtatgtcagtagaatttccctcttctcataaggacaccagttattggattaggacccactcacattcagtatgacctcatcttagtttggtgacatctacaaagactctatctccaaataagattcattcaaaggtaccaggattcggactggaacatatctttttggggaacaaaattcaacctaaaaaagacattggtgggagctgttcaaattttatttgaacttggattacaagtaaactaatgtttatttatttgtttggatctgtccttagatacttaccgttatagcattatatttgttagtagaatacatcaacaacagagctgtggctgcccctcatctgacccttcacacttagggtttctcacctcatggatcagaggaatgctgtcagacagtctgagaatttcaacagtgcatttgacagagcccctcttgaagtcccttggactaagatgaaaatatatagtaaatggtataggtggctgtatttttaattgatttatcttctctgtccaaaaggtactgatttataggctgatgtcaaatgtgccggaggagatctctattaggattgtcccatcaggcccctgaaggaagggattgtgtttgtttgctgagagtgaacaggtttcacaccacaaggttctgctttggacttgatatggtttagcatagttagaagtgtccttttgaggccaggcgcagtggctcatgcctgtaatcccagcactttgggaggccaaggcgggtggatcacgaggtcagaagaatcacgaagtcaggagatcaagaccatcctggctaacacagtgaaaccccatctctactaaaaatacaaaaaattagctgggtgtggtggcatgcacctgtagtcccagctactcgggaggctgaggcaggagaatcacttgaacccgggaggcggaggttgcagtgagccaagatcacaccactgcactccagcctaggcaacagatcaagactccgtctcaaaaaacaaaaaaaaaatgtcctttagaaaacattaaagccgtgtggattcgaaccatcagggaggagagctgatgtggtcaaaggtagaatgaggatccgaaaaggttctaacagggtggattgtatctaacaagataaactttaattcatataaacaaaaagaagagctctagggtgtgaaagaaagatagaaagaaaaaagccagccttgcaagcttacttaggagcaatgtcgttttcacagcagcacgtgtgaaatttacttttacttgactgcaggcttagtatgagatgttatgtgatatgggtcatttgtgtgtggattgtaggggtatcatatttttatactggaaaatgtttttgcccctctgattgaagatggtaaatatgaactgaaacaaaacattaaaatttaaaaatgtgttatttaatattcataaaactaagtaactgtagaaaaaatgtaaacaagctttcagatttttgtatgtttgctgtgtttataattctgaagtcattaaagctcaaaactgcaggaagacttttgagacgcagcgtgcgtgtgcgtgtgtgtgtgcgtgtgtgtatgcccgtgcacgtgtatgtgtgcctgtgcacgtgtgtgcatgtgtagtgcccgatctccaggaaataccagttctgcttctccctgcaccagacagacgtgcctgtagtccagtgttgttcttcctgggtatgtgattctagaatggacatttcctcagcttctcttatggatcaccatggtgttgggtacccaagatctgcttggtaaatatttctagaaatattctattctaaccattttcctgggactcatgtcccaaataagacagaagctgtatcaggtaccattcaccatggggttctgatcactttccctaattctgggtgataagaaaatagggctagaacctattaggttgctgcaaaagtaatcacggcttctgccattaaaagtaatggcaaaaaaaagtgattacttttgcaccaacctaatggaatagtaggaacagtattggaatagtgggattgtgttgagaagacacagtctcatccaggctctatgtcctactttctgtgtggtctctacatctccaagcctgcttcctattccctgaaacacatttttttcctgagttgtaacggacctcaaatgagacaataaatgtcaaagcacattcgaaactgtgttccttattacccagtgaacgatgctggggaatgacacctcagctgaaatatacctcctagtggattgcagctggactcagccatgtagcttcatttgtggggcttaattggaggcagatgacatcaagatctgcttttggtgctctttggaaccagaaagcgattactactgctttcttccactcttaacttttgttgctgtggtggaggtgagagggaattaaggctcctttgaagatatccactcttctctggagggaatctctagaagattaaactaaaccacctgtagaagaaccaatcagacttctaaaagtgacagtgttcaggagtcccagcccttggtaaatgcttccctctctccgtgcccatgttgatttgggttaaagagacctgatggccctgctgctttgtcctgaggctggtgatgctaggaaaccagaaggttaatggaaacactggaagatgctcacagtcaggacaaagaccacacctcctcacaaactagtttttgagctactgctaacaaaatccatccattctttcactcatgcagtcatttattcaataagctaacttactatgtaccaggcagtgtgctaagctcaagtacctgcagacagtaacacttaggtcagatgtgacccttcatactaacttatttttttttttttttgagacggactcttgctgtgtcacccaggctggagatgtgacccttcatactaactttttttttttttttttgagacagactcttgctgtgtcacccaggctggagtgcagtggcgtgatctcggctcactgcaacctccacctcccaggttcaagcgattctcctgcctcatcctcccgagtagctgggactacaggcacatgccaccatgcccggctagtttttatatttttagtagagacgggttattgccctgttggccaggctatccatacagacgtttaatattgtttatgtgtaaagatgtcaggggatcttaggtgctgaactttgacccagaatattaaatattgcatattattctagtggcttttatctcttacgaaacatactgtggtaaaatgactagtgatttgcaatagacagacaactctttgtaaatctaaattttaattggattataaggcctgtttacattgcatctgtgggcagatttctttgagatggatggtatgtgttggtgctggcatattttatcgtttcaatagatgttaattctaggaatatacagtttttattttaaagaaacagtatagggccgggcatggtggctcatgcctgtgatcccaacagtttgggagctgaggcaggtggatcacttgagcacaggagtttaagaccaacctgggcaacatggtgaaaccccatctctacaaaaaattaactgggcatggtggagcacacctgtagttccagctacttggcaggctgaggtgggaggatcgcttgagccccagaggttgaggctgcagtgagcagagattgcgccactcctgcctgggcaaaagagcgagactttgtctcaaaaaacaaataaacaaaagccaaacaactgaaaaactaatatagctatcttgttgaataattctaagtttttgtggctcttcattgtcttatgagaaaaggatataaaatctggtatgatcattcccgattgcattgatttgtagaattcagcctgatgtctgaaatagagggtttgggagcttttgtctgttttgtgttccgaatacagggcacattggctaacgtgctttgctctcgtcagctagttcccatttgcctccaagcagtggaaaggccacaagggtttctggagacgttcccgatcatagctaccttttagctcatgcataaatatgaaatgtcccggaacatagtgatagttccaatttaatcaacagccaaactatggatacatatagagtactgcaccttggagacagactctaactcaagctccagctagttccttcgctacaaatagataattttctacttagaaaatcaaggcattgtataacatctgcaatcttttctttacattttctcttccggtcctcacaggccttcctttttattgtattcagtaacagtgacatgaatttttgatgtggaaaaccctacaaaatatagaattataggtgaatcctggacactaaaggtcttggaggtcatcagcttcccctcccctttgatgcagaaaccctctccacagcatccaacagttgcttctccatccccaactggaaccctttgttgatgatggggtgtaaatttagaaaaaggccaattccactgtccgctagggctttttttttttgagacagagtctcactctgtcaccaaggctggagtgcagtggcgcgatcttggctcactgaaacctctgcctcccgggttcaagtgattctcctgcctcagcctcccgagtagctgggactacaggcacgtgccatcatgcctggttaattttttgaatttttagtagagatggggtttcaccgtgttagccaggatggtctccatctcctgacctcgtgatccacccgctttggcctcccaaagtgctgggattacaggtgtgagccactgcacctggcctagtgctcatttttgacaagttattgagcccaaattaatgtctccccagcttgcacatagtcctcctagttctggtctccagagtaacaaataccacccactgccctcattctaaggggagcttccctcctaccccttccctatggtcaaagtcactcactgtaaactccgttatttcttttccttctagaccaaaatgacgtatatctttcctcatcttctctcctgttttcctcaactttccaaaaaatgaagtctcctttcttttctaaaaatcaatgatagtcccttgtctttgtcttctctttctctttgtgaccttgcctcgtcagtgttctgttcctactgtttcgtggattttttgttttaccctatctatagtctctcttctttcagcccacagccaggcccaggttcctcctatcctaaaagagcctccagtcatctctgtcatctcaccaaaccacattgcctttctttctctgccaaattgctaaaaaataataataaataatgactgtccttgaagcctccacttcttcaacctgatcatttgttataccattgggtaactggtacatggaacacacaagaattatggggttttatcagtttttttagaaaaattgtcttcccccatcctttgaggtttatgtaaggctggaagttcctttcttggcactggatggcacctcagcaatcccaagatttttctggtccctcctaagatagtaaaaaagtctgtggactcttctagataaaaattgccatcatcatatctagtcctacataatagtcattcaaaatgggagttccatttccacacctagctagatcccaatgtagcatgtggtgagtcccctactctgcaggacaaggggagggttgatgacttctctcctgctcactccctcctccccgctgttttgatccctccaagattggaatggggatgaggtgggtggggcaggatgatgagaaaggagaggtggaaagtccttccttgactattctgttatagggtggcttcaaactctctcggccaagaactgtgattttaaagctaactttctgggaccgggtgcggtggctcacgcctgcaatcccagcactttgggaggctgaggcgggcggatcatgaggtcaggagatcgagaccattctggccagcacaatgaaaccccgtatctactaaaaatacaaaaaaaaaaaatagccggacatggtggcgggtgcctgtagtcccagctacttgggaggctgaggcaggagaatggcgtgaacctgggaggcagagcttacagtgagtggagatcgcgccactgcattccagcctgggcaacagagagagactccgtctcaaaaaaaaaaaaaaaaaaaaaaaaagctaacttttcttttggatgttttaatgggttcttcagggactctcactgggaacattctgctcttctttattaatgtggttgattcagtttcttccagctttggctgagtctctctcagtccctgttttccaaagccctccctattggcctcagatgctcctcttgggaagaatttaaattagttccacgccaccttgtgccctcaaatccatcagaacactcatgcaacctttacctccaacaacaggccatccagtacagccaagcctccttcagttttctgccagaggctctcgggtgaaagtcaaacacataaataccagtctgttatttgcctctgtccacagaggacactgatcaagcacttacaatcttccagtgaaacccctattgaggtgaaggggagcatcgcccctcttttggaatgatggaattcacagcaaggctctctcttaaagaatccttctcatagatctgctttctgtctagtaacttaagccttttatgtcctcaaagtgagtaagaagactaaggtctagaactgtttatatctgctttgacatttctggaataggatctgtctcacaattcactttggtatctgatacacatctccttggagtctgggtgaaatgttcattttcaatcctattgcatttgcaactggcttctatgcctaacatatgtagtagttccactaagcaaggataatcttcaaagcactatattcagtgttctatatttttcttttcttctttatccttcttgacttcttggtagcatttgacatttttgatgattccctccttgaaattctctccccttgacccttcatagtgtcttgctgtcttggtcttttgcctgtccccctttgaatactcttaagctcctttcaggtttgcttttctgtcatatatcccttaataattgttccctaagattcattcatgtttttaaacttaattactctctattcctagccaagttcatctactttaatggctttagcaatgatggttctggtagacagtgatggtgacaaatggcaaccagatggtatgcaataagcaaagcctttgaaggatgtataattttcccaaatttacaattaaggaaattaaggcttggagatgataaataatttgttcaaggccacacagatagtattaaaggcagaggtcaaatccaagtttgtctttgtttgacaatatatccttaatctttaaatgtaccccctttgaggtatacatctctaaccctgactcctctcaggagctccagaaccacatttccaactttctcttatgaacttccctatgactattccacagccacctgaaattcaacacatcccacaactgaactcatcatctacctggtcagcttcatttcttgttctgtgtttcctggatgagctcatggcatcagcattctcaacaccaaggttgcaaaacatggagtcgtcttttactcacccctcacttttactccccatagcccatctgtccccctcctttccaatgctactgccattatcttaggtcagttcctcatcatctcccatttagactcatgaagatgcttgaactttccatccttgttgcagtttttcatctctccacaccatgtttgaacccgattaatcctcctgaattgacttacctagccctccactgcctacagactccttggcatgctattctagggcagttgtagtctgactgggttatatctttctagctgttctcaccctttattcctcctctgccctccaaccacagtattatttgttggtctcccaaaagctatttatttttgaaatatctgcttttgctcatattgcctcattcatgtggaatgctctttttcctcttctccttcctcacccaccaaactccatcttgtcctttgaggttcaagtcaaacatcaccatccttgtaaagcctttctccatctacttggtttcaatcagttactgatttctcattctttttccagctctttgctctttattataccattgttgttcattctgctgtgtgttctgggatttttttttaaaatgcatctagcttgtgaataataatcacgtttaattatcaggaaacctctgcagtgttgctttacaataatgaaagcgatgttaggagaagttgagaaactgcccaaggtcgctgtattaatcaggattctcaacagaaacagaaccaataggatacacaaacacagacacacacacagacatactgatatggtttggttctgtgtccccacccaaatctcatcttgaattgcactcccataattcccacatgttgtgggagggacccagtgagagataattgaatcgtgggtgcagtttccccaatactgctctcatggcaatgaataagtctcataagatctgatggttttaccaggggtttctgcttttgcgtcttcttcactctctctttgcctgctgccttccatgtaagacattacttgctcctccttgccttctgccatgattgtgaggcttccccagcgatgtggaactgtaagtccaattaaacctctttcttttgtaaattgcccagtctcgggtatatcttcatcagcacatgaaaacagactaatacagtaaattggtaccagtagagtggggtgctgctaagaagatacccaaaaatgtggaagcagctttgaaattgggtaacaggcagaggttggaacagtttggagagctcagaagacaggaaaatgtgggaaagtttggtgatagcgatatggacaataacgtccaggctgaggtggtctcagatgtagatgaggaactttttatgaactggagcaaaggtaatcttgttatgttttagcagagactgacagcattttccccctgacctagagatttacagagctttgaacttgagagagatgatttagggtatctggcagaagaaatttctaagcatcaaagcattcaagaggtgactcaggggctgttaaaagcacttaaaagggaaacagagcataaaagtttgaaaaatttgcagcttgacaatgtgatagaaaaggaactatcattttctgaggagaaattcaagccagctgcagaaatttgcataagtaacgagcagccaaattttcattcccaagacaatggggaaaatgtctccagggcatgtcagaggtctttacagcagcccctcccatcacaagcctggaggcctaggaggaaaaaggggttttgtggcctgggcccagggtccctgagctgtgtgcagcctagggacttggtgccctgtgtcccagccactctagccatggctaaaaggggtaatgtagagctcaggctgtggcttcagatggtgcaagccccaagtcttggcagcttccacatggtgttgagcctgcgggtgcacataagtcaagaattggggtttgggaacttctgccgagatgtcagagggtgtatggaaatgcctggatgcccaggcacaagtttactgcaggagcagggctctcatggagaacctctgctagggcaatgcagaagggaaatgtggggtcagagccctcacacagagtccttactgtggcactgcttagtggagctgtgagaagagggccaccgtcctccaggccccagaatggtggtagatctgccgacagcttgcaccatgcacctggaaaagccgcagacactcaatgccagtctgtgaaagcagctgggagggaagctgtaccttgcaaagccacagggccagagctgccgaaaaccatgggaacccacctcttgcatcagcatggcctggatgtgagacatgaagtcaaaggagatcattttggagctttaagatttgactgtcccactggattttggacttgcataggccctcttgcccctctgttttggccaatttctcccatttggaattgttgtatttacccagtgcccgtacccccattgtatctaggaagtaactaacttacttttgattttacaggctcataggtagaagggacttgccttgtctcagatgagactttggactgtggacttttgagttaaggctgaaatgagttaagactttgggggactgttgggaaggcatgattggttttgaaatgtgaggacatgagatttggcaggggccaagtgcagaaagatagggtttggccctgtgtccccacccaaatctcatcttcaattgtactcccataattcctacatgttgtgggagggacctgctggttggtagttgagtcatgggggagttttcccacatactgttctcatggtagtgaataagttgcatgagatctgatgcttttgttggggatttccacttttgcatcttcctcactctctctttgcctgctgccatccatataagacgttacttgctcctccttgccttctgccatgattgtgaggcttccccagccatgtggaactgtaaagtccaattaaacctctttcttttgtaaattgcccagtctcacgtatatctttatcaacagtgtgaacatggactaatacacatacacacacagaaatagacgaaagatatacttataaggaaatggcttgtgttattatggaggctgagaagtcccacaacctgtggtttataagctggtgacccaggaaagccagtgttacagttcagtctgagaataaggacctgagacctggaggagccaatgatgaaagtcccagtccaaggtcaggagaagatgaaatcagatgttccagctcaagcagtgagacagaaggaaaaaggtaaatttctccttcatctaccttttgttctgttcaggctttcgtggattggatgaggcctacctacgttggagagggtagtctaccttatggagtccactgattctaatgctaatttcacccagaagcatcctcacagacacaccccaaaataatgtttaatctgggcaccctgtggcgcattcaatttgacacataaaattaaccatcacagttacatacccagtgggtaacagagttggaattaaaactgaggatcctggacactttgtactttatcttactttattgtaagtgccttgagattggtcctgtgtatcattaaaacatatatcccacagtacatatcagggtaccatgaatgtagtaacagctcaggaaatattagctgaattattagatgcagaaggaatctactccatctgtcaatcatcagatgctgaggactatagcctggtacttcccaaaagcttcttttccagacaaagtttcctcagctgtttcttttaagactaccccactatcctggttgcacttctcttgatatccaatactagatattgatcagcaatatcctccctaaaatggcacctagaacagaacatagtattccttgggggcttcaaagagcattgagaatataaacttatttgatagaggcaacaaacttgtccaaatacagcctaagcatgattaaggtttcttttaacaattgccaaaccatgcaggctcatggttagcttttggccagctgaactctctggggctttctgacgtgatgtcaagccagcttctacttgtttaattgaatatttgaacctccttgtagtgctttaattgtattcatgccagatagcatcttattaattttagtcattaattctggccatttaagaactttaagcatccaaattctgcttgaggataaataatagcagagagttgaaaagaggtctgatttccaggcccttgtttttcccaactgagttacgctgctagaggcctgcctagccaaagaccaacagcatagctgcctggaaactctgataaaatgaaaacaaatgaaaaggtatgctaacactcacatttccttgtgggaaacaacgtaagggagcctcagattcaatgcctagctttgtctgggtgattgtctgcagctggttaacaaacagttaaaagataaacgtaaacacattaaaatgttaaagagtttatttaaacagacagcaattcatgaattgggcagcaccaaaccaaaagctctttggcctccaacagagtgacatgagaagaggcttttataaggtgaacattgactcaaggcaaagaaaatgtttgactcattgaagtggagcagtatccttatttaggttattctagtggaaagtccctggttaaagattggttagcagtttctgatgggttatgcttaagtttcattttacctttcacactgagttgtatttcagcttgcttatgtaggaagccaagatgctggaatcatctcagtctaatggggtcccaattaatttcttttgtttttgctttgttttttttgtttttgtttgtttttgtttgtttgtttgtttgagatggagtcttgctctatcacccaggctggagtgcagtgacatgatctcagctcactgcaacctcctctcctgggttcaaacgattcttctgcctcagtctcttgagtagctgggactaccagtgtgcaccaccatgcctggctaatccaattaatttctttttaacaagtcctacagaggaagacaacagattgttttgtcccttacactgacccacacatacccctgagtacaggagggaacttcaggactttcctttcagtgtgggtccacagggcataggaacttatgtttttgttcctatttgaaatatgcccatttgttttcccacaccaaacatgtactagttaagagcctactgcatgtcaagtattcttgggtttaaacaaaaacgttctggaaagttaaatatctacttcagggtttaaacaaaaatgttctggaaagttaaatatctacttcaggaaagcagatgaagtgaaaatccctgtggaaaatagtatatgtgatgtgaaggtgattttaaaatctagcttcaaaattgggtaataatttgatacatgtgtatataggctgtctttatagctttttatttttgtaagtgttctaaatgactaaaatataataagatactgatactctatggctcttcactacctgaagctaagtttttctctcttaacacctctggaaaataaacacatagataagcttttagtaaaaaaaaaaaaaagaaaaaaaatgattgtgtgggtgacatcttcatttttcaataggctgaatcactgtgaaatcatgagtctcacttttcctgaagacctaaaacagatatgaaaggaagtgtggttctctaagttcatatcactcctagtcaaataatcagaggacacagctgaagaaaagtggcagtgctgtcaggaagtgccagcaaatggacaagaagaatccatacatgtttgcttagagtaggggaatgaggaaaggcaaatctttgccagcagagcaggatgaaactagcatcatcttgctcaaagataaaaatcagcctctatgtttagttatgaaagcactccagggccaactgagccagtgattgccttttgtccactaaaggacagcctaacaatatggcagtggggacatcccacaaatctgaccacagagctccctgcccaactattgagaaccgaggttataaagcttttgaatttattagctctggagaaagaaaaatctgcttttatagatttgcccctcaactttaaagttaacatagccaaatttatgttttcatacctttttttatttgtttgtttcacacttgacagcctttcaacagaattttcctgagaataccattagaagttagaagattagtataagctttttaaaaagtgtttagaactttgggaggccgaggcaggtggatcacggggtcaggagatcaagaccatcctggttaacatggtgaaaccccatctctactaaaaatacaagaaattagccaggcgtggtggtgggcgcctgtagtcccagctacttgggaggctgaggcaggagaatggcatgaacctgggaggcggagcttgcagtgagctgagatcatgccactgcactccagtctgggtgacagagtgagactctgtctcaaaaaataaagtgtatagaaaagtgagctgcttcttgctcaagtgagatataaaatgtcaccatatgctatggggttcccaaatatgaaaattagcatagctcaatatactacccacaagggcttatagacaattaacatgaattcaatttattatattgcaggagcctgatcttatatgtgtatacatgcatagaggtatagatttggcaagattcaactaatagtgagtgaatatctacaatgggcaggcactgctcttagcactaggcatatcacagtgaactaaagagagaaaaattcttgcccacatagagcttacatcttatcagaggaatgcatttaacatacaaaatctcatatgcaaattacttagtgtatcggaaggtaagtgccatgaagaagaatgaaatagggaagggagaaagggagtaaatggagagtgggtggtgtggggaggctgcagggggcaagacttcaggaagcagtgacatttgagcaaagacttgaggggtaatggagccagccatgcaggacccagaagcaagaatcatccccgggcagagggagcagttagtgcagagggcctgaggtgagagggtgcctgacctgtcctcatgcacagctcagtagtggcaggcaggccgcagtgctgagggcagttccaacaccaactaccaggagtcggcccagacttcataggttaagggcaccatccccaccaaggctgcccacgcttcaggaccagccatagatttaggagtccccaggccacccacacttctgaccaactggctacaaattcagggattcccacagctccctcgaattcaatagtttgctagaacaacttacagaacccaggaaagcactatctttatgattacagtttcattacaaagcctacagactagggctagccagttgaagcgacagacaggggtaaggtctgggagaggcccataagtggagcttgcaggtcctctccttgtgggatcaggacacgtcaccctctcagcacactgatgtgttcatcaagcaggaggctcactcagctgctagcgtccagagtctttaccagggtttggttatgtaggcatgggtgattacgtcataggccctgtgattggaactgagtctccagaggtcaggctgatatcacatgagtcaaagccctaaccctctaatcacatggttgacctttctggtgtgattggcccccatcctgagtcatctcattagcataaacttggtgtcatccaaaggacccaacatagtgttatcacttgggaatttccaagggtttagaagctccctgccaggaacctgggaagaaaaccagacacatgttttattatacagcatggaagctgtcaagatctgggggaggatatccacgctaattctgtaatgagaataatgctgaacacttataataaggagaaatcaaacggtgtaacaaaaacaatgaacttatcagagactttggatctttgcaaacagagaaaggcaaaatgactagctcccagctcaggacagggaggctgatcactcccttctcaagagtctgatttctgcataaaggtcatagaaatgttttgacaactgtgtacacagccagcttttagttaattagctcttagccattgagaaggatggacttatggcatgattcatctaaaaatatgtataatgcaaaatctctttcatttgcttgtagagtagactttatatttcacacaatgtattatttccttcagacagataatttggaaactggattacttttgctccataaaattcctaattgttggagttgaaagaaccttaaggaatttctagttcagttctttcatttcacaatatgaggaagccaaagcccagagggattacgtgagggcccaaagtcaactagcaggttagtgtcacagctgaggcctgaagcatctgacttccaaaagctgctgacttccagtctagggctcattccattatgtgaagttgcaccattcagtcagtacatcagcatcagcctaaaatgtgcccttggaagagcaccagctctggagatgggggtcatgggtcccaccaactcctgcccttctcacctgtgtgaccctggacaaattacttaacctctctgagttaaggtccacagtaaaagagagacaaaagtagtaccaatcacaaaagattgtcatgaggatcaaaagagatgatgtaggtgaaaaccatgttgcaaggctgtaatataatggacaaatattactacttggtgatattatttttcagttctaagaaactgtcatctcttgattaaaatggagcaaatttgagatctttagtgtgaactatttaacaaacatttatctgaacaatatgctagtgaatgtgggggatgctagcttgtggtgaaactcccaggaagaggccatccacagtcagcagcaatgcttagcaaactcagattggaaaatggtacaagggctgcttgacaatccaaagcagaaagcttagaaattccagcatgtggcgcactgttgagtggaataagactcctgagaggtccctgacaataagactacatttgcagctgggcacggtggcttacgcctgtaatcccagcactttgggaggcctaagagggcggatcacttgaggtcaggagtttgagaccagcctggccaacatggcgaaacccatctctactaaacatgcaaaaattagccgggcatggtggcacatgcctgtagtcccagttgcccaggaggctgaggcaggagaatcgcttgaacctgggcggcagacattgcagtgagccaagatcgtgccactgcactccagcctgggcgacaaagtgagactctgtctcaggaaaaaaaaaaaaaaagattacatttgcaaatatttcttcccttctggccaagagactgttaatatgtgtaactctcacccctagctctggacacctagttttgtatacaaactgcaaactacgggtttaagtaaagcatataggtcttgagatttcaagcatgggaaacactaacagaattacactgcatatcttggatgtgtagtcatattttctgtggtatctccttgctttgttctctgcagagtgaatgaagagtatgcacgtgtataattagagtccgtatatgtaaactgatcagccagcaaataggtcagaatggtgagatctatccaaaataagaataaaaataaaaacaacaaccaaacacacaaaaggtagttcttgactcaaagataataaaattaacataatatgctgtttatcaaaaaatgcactgaaaatggacatgagtaacttaaaacacattaaaatggaataagactttttgttaacctattttgtagcccaagaaaggcattctatcaaactgattgatatcattatttttaaaatgctcttaagagatttttctgtatttcgactgatcctaggctagctaatatatggcatcgtttctgcagctttgccttcacgtggtgagaacattagcatattttatatcgtcttttaaatgtgctgctgctaattatataatttctcatgtttggtttgtagccagcatcaaaactctgaattatttagagtgatgacaattctcttgcctgactacctcttctctagcagtttgcaaaggagtcttgacccaagatgcccgtagcaggtagacttggaagaattctaactagcttctcctttggccgctcctctgcccaataggtttccaaagacgacaggccaatctgtagtagatgtctataagtttgcaaatgtatcagagccaggaaacttttattctaaaatcatttgctcacctttgaattttggtggtgaattattagccagtaagtgctcttgtagtggatggtactaaaaagagcttgtctaaatttaaggtcagcagcctttttctggaaaaagcaagatagtgcatattttagccttcttgggccatatggtctctgttgcaactactcagctctactattctcatgtgaaagcagccatagatgataggtaaacatgtacaggtagctgtattcttataaagcattattcataagaacaggcaatgggccaggtttggctttcaggctatagttagctgaaccttggtcagagccactgatttttagttttctggtgaatatgctccttcatgggaatttaatgagaggtatggaccctactccagaaaaataaatattcatgtgcagaatactaagaatactaagccttccatttcttttttatttttattttttaagacagggtcttgctctgtcacccaggctggagtgcagtggcacgatctcggctcactacaaccttcaccttgggttcaagcgattctcctgcctcagcctcctgagtagctgggactacaggtgtgtgccaccatgcccagctaattgttttgtatttttagtagagacagggtttcaccatgttggacagactgatctcaaacccctgacttcaggcgatctgcctgcctcagcctccgaaagtgctgggattacaggcatgatccactgtgcccggcctaagccttccatttcaagactcatccatggatccaggacttggtcttgacggtgacaagaaagcctttgtaacggtctgctggatgctctgagacagccatttaaaaaaaaaaaagatttgcccccacttatctcacatcagaaactctggactttaatcagactcagcagttcatagagacatagaggtcttgaaccagatgaggcagctgcacacatcaaggggctttaaagggaagaagtcatggacaggttggaaaggtcagggagaagtatactttggggagcactggggagagatgggagtcaaaggcagttcggctgtgatacttgagtaaatggtgggtgacgtggtaattggaaacacagctgaaatacccagatccttatgatccctcgaactattctggtccttaatgacctctccttttgctagaagggggtctagtttagcatgtgcatttgttctgcttcttactgtcttgtgagcatcaaaattccctgaatttattgtcctattcttgacagcaagggctaacagacccccagggtttcttctgtccttcaagggcattcttcacaaaattgtcacccttctcggacaggtgtgtggcttatgtctaacacgttaatgcttagtaatacaggaactgcagcatatagaaatagatagcagggaaatatttttccctgagttgtattctgaaatacaactcagggccatactttctgctcacagacagtgactcactggtgaatcaggggctgagccagcgtgtgtcctttatgtttagtgccaccagattatcatttgtcccatagcctctctaccccccactgctccctcctaagcctcctgacacccacagaattggttgtctcctccttaacaatgttccctaggcccagggcagcccaccaagccctggccgtgttcccagtgactcagatgcccttcaacagctcaggggaaaggtggtaaaaaaaaaaaagaaagtgaagctagtggcatcttggactgtgctccagagccgggttggaagtcaagctctcctccaaaccaaactggagtgtgaccttgtcaagcaggtcccttagcatctcacctgagtcctgagacccccgtctctaaagtccccatcagttgctttcatctggtcacaatcctttatttcagtgcacaaccctgggagatccacccaggggtctttcccgctggagttcctgcattcttttcctgggtagtttactggctggtcgacctgttcactttacttaagttcccaattgattcatagcagttactccaattctttaaagttctgatagagaagccaagtcactttcaggaacaaggaaaggtaaccaggattggatcttcatttctggtgcatcgttcccatgaggcagctctccgggcctctgcttcttcagatctaaagcagatgggtgcgctgagacaggcttccaggtgcccagggatggcagggggcttagaagtcaaacatctgttttaacaccacttgggccacttgaagctgtgtgactttgggaaagtgtccaatagcttggagcccatttcttcacaggtttattgtgaggattgaaaacaataacacatgccaggtgtgtggcttagtcttcaaccaggatttatgcccaatacataacaatgcctttctatctccatctccatccgttcccttccagtgctaaaattccaagctgtattaataataatggcaagtgtgaggttttgtgttcttgcagtttgcgcagtgctttttttgtgtgctattgcctacaatcctcacaatattcttgttcagagatagaggttttcagttacattgtacagtcaaagaaatagattcagaacctgggtctgactgtccgccaatgctctatgctgtatctaataggcaatcaagacatatttattgatcatctgctgcatgcgtagctctgaacttgatgccgtgtgcagggcatgggtgatatgtggtccttctccccaaggaattcatgagtaatggggaaagggaaggtaataggtagaagataattgaaacaagctaccatcacccccaagaaatgtttattgggtacaaactgtgtgcaaagctgtgaaattatagtacctattatttacattaaaaaatttgatttattttttcagtcactttctcataatgatcttaagagaaatagcagagattgaaagtgagccctgattcaactcaagtgatgattttaaaaagtaaacaaaaaccgccctacctatatgtttcaaggtcaggacagggtttctagccttggtaaggtttttgttggatagaacttatcttcatcaatgaggctgtatggagcacttaaggtagtaggcactatgtttctctatttatttttacttctacccaacatatgaaattccaaaactcagtttctagtccagacatccagctgtgtcattgacaccatttcctcccagctcctggggtggcaactttatctctgccctgtcacctggtcttttccccaccttacctgccccttcccacagtcatcagccccataatatatcttgccaaatgtcaccaggtccttctttcattctctgagttactgtgggagattctttagcgctcttcattcctctcttcattcagtcaacaaattttcatttgtttcactttggccagacacctttctgggtgctgctgccatttacataagacagacatggtctttgcctcatggaaccttaaggtctcatgtgagatagggacaggaccttaaaggaataattataggaatgatgtgtactatgaaaaaggacatacaaggggctgtgagaccatgcattgtggatctaaggtttgggttttaggaaagtcttctctgaggaagtcgaatttctgctgaaacctgaaggagtgatagatgttagctggtgcccgaggtggggtctgatgctccatgggtatgtaggggtgagagtggggtgttgtggccgggcaggtgggatgagagaagaatgctttcaggtacagggaacacacacttgaataccagccagctgaggaactgggaaatccaggtggctagagtagaaggagggagagaaaaagtggtaggaaacagggttggggccaggctgtggtaaaccttctaaagccattttacggatttgggatatcctgggaataataggatgtggtcccagcagggtatgacgtgatctgacttgcattttcaaaagatctctttgaaagcagctgagaatggattggagggacccaggggtaaatgcagggcaaccagttaggtcgcttcaaaatagtcattgtggaggtgttggtggcctgctgtgggctgttggccgtggggggcagggagcagtggacagaattaggaaacatggaatggcaggaatgagtggccacggtgacttactgaatgcagggagtgaggagaggaataggtgagggaccacgggcaatttccttgctgggggccacatcgggtggtgacagggagaagcaattgggaaggagatacacgcagctgtgtatgtatgggggatgctgcttagagatgaccccagagcaggtgtccctcctcccggcacctcccaccccggttccttctgcacccagcctgcagattcatggccctcaatctccggtttagaaaactttcgatgaaccagtgtgtgtaggaccaagaacacccttcttgtcctccatggtctcaaccttgtctctcattggccccatccgtaacactcattggtttcctccacaacccccgtgcattttccttcacttggctcatattcccttcaattcctgcttcaagcctaactccttgagaatacacttaccaactgccctagcctgttcaagcttttggttttgctattcattttacacttgaaacacactactgagctttctcgttatcttctccctttatagactctgcctcactgatttacttagaaaacccaattaggatattgtcatacacttcacagctagtcccttccgtgatgctatgtgcattgctatgctccatacgtgtcaaggcaaggacacgtgaagggcaggtctgtggagtggaaggtgagacagatgaatgaggctggaaagtctcatggaaggttgaagatgtggacatagttgcagatacgagtagagagatgtccatatacatttatatcaggagaaggaatttatcatttatttggtatataatagtggaggaagaacattgtgaagtttgaaacacgaggatcacacatggaatgtagtaatttaagaaaattaatctggcagtggcataaaggtggacttgaaggggaaaattgctactgattaatgtatttattttatttgccggctgtgtcgtaagcactttacatgggtgaatttatataattctcacaacccccccacccccccgcaagagtgctactatcattatcctcattgtacagaggaagaagatgaggtctaaagaaggtaaacatttttttcttttttttaatgaaaaaaaattttttttgagaggggtggggtctcactgtgttgcccaggctaatctcaaactcctggcctcaagcaatcctcctgcctcagcctcctaaagtgctggaattataggcatgagccaccgctcccagccaaggtaaacttttaattgttgaaaccaggttgcaaatccagcctgcctaaccattatgctgtagtgtcttctggaaaaagagaggagtctgggagagggctatggtcaaactgttcagcgttctctggggttccaagaagatcctcagagtttgcagccaaaataaaaaccctctccttcagccggagcagccccactggcatctgtgtaaacatttgggctctgcataagatttaagaaacaatcccctgtttaaaatgtttgaaaccactggatgcaagggtttgtgtggtttggtttgttgaagatgctatagaattcacaccacacactgccttagacgctacaagcctgaagaagtcttcctgaggcaaaggaatagatatttgttcttcccaaagatgggaatctgctagctccagaatgaaaaaaaaatgcacttttaaaaaacttaattagtaccaaaacttgttttaaaactcttgggggccgagtgtggtggctgatggctgtaatcccagcactttgggaggctgaggcaggcggatcacttgaggtcaggagttcgagaccagcctggccaaccttgtctctactaaaagtacaaaagttagccaagcatggtggcgcatgcctgtaaccacagctacccagaaggctgaggcaggagaattgcttgaactgggaagcagaggttgcagtgagctgggagattgcaccactgcactccagcctgggcagcagacagagtgagtgagactccgtttccaaaaaaaaaaaaaaaaacacactcagaaggaagatttctttttggcctttaacaaattataagacaattaattaaataggagcacttgtgttgttatagacattccccattttcaggatgctttcataaatccctttatttgagctgtgcaactatctgtgaggtagatacggccagtcatgattagtgcccatttttctttgccaataatgggcttaggaaggctaggcaatttcttgggggttcactgctctgtcttcagtacctcgcacccagtagttgctcaacaaatgtttgttgaacagttgaatgatcgaacaaagaccataagagttggaatctaagccctttaaaatcagggctggttttatgatcccactctgtcttcaatgtggtgagagagtccagtccatggaagctactatgcaataagtgtcatatgacattggaatcagttaacttttagtgattaatgtttggaacactctccatggtcacataagctgaaacactctaccccacataactccccactcctccacgtttcgggtttgaatccacacaacctcacagatgatctgtctgccgggtattacctattgcaaccacctctgacaaacatatgttccttttattacaaactttgatgcaatttatagaacatattgtatcgggatttggtgggaagagtacatttattccaaatttactctctaatgcattttagaaagaaaaataaaaatttgtgtatgccttatgagtcatatgaggatacgtagaaaggattcattctttttgcttgtcacttgaaatgatcacatcttagtatgcctgttaagaataagcattgccatttgactgtaacagtgtttagagaagagaatagcagattaatggtggggtttggacatggtctctatttgttttctcttctgtctggctttcaggggcatgagctggcggctctctgcccttgcccgtggctgcctgaacctctggaattctccccaaattctgaaatgtgtgtcaggccaattgtgcagtctccagcccagctagagaacgcctctccactggaggcccccccgccctgccccccgccacaggaaatgctctgctgagctctgcctaaaatattcccagggtaactaatgattttgaaaatgccacgttaccatggtacctgaggcatggtaggtggggggcatgcagctgggtttcgaattcagtaggtatccagtttataagctttcattttctttttgttttcagttgttgtttaatttataacatgccgagaagaaaactggatcacacaaggcttggcatgctttctctttttcttttcttcctccttgaggctttgtcctccacctcctaagtccctaccaggtgttctgtgtttagaggtaggacgggattgcttgaaagctcccacctttggagagccgggtgtgccacaacctggcaacccccgaagcatcactgaccacaggaaatgctatttgagggcccgacaatagcaaacaaaaccgaacaaaaccctgcctccatccagcgttattgttttagttatatgcaattataggggaggaaaaatacctcttcctctccaattgtagattcatggctgaggcccctataacaagagacagattaacaagagaaaaacatacaaatttatttaatatgagcttcgtgtgacacgagagttttcataaggaaacaacgacccatagaaacagttcaacctgtgtgtttttgtgctagatttgatgaagggtggacagtcatggagaaatgtgatagggcaaaaagggtatgagttaagtgtcatgaactggggggttaagcaaggcctgtttgttcagattcttctctgtggccctgtgtcttcagcgataatgatgctattttcctcgaggtagaagaaggccacctgttgagtgagggagggtcttatgatcagcttcactggaaggtcagaaaatcctttctaggttttatgacctgctgcaggagagaagggaggtggaaggtctgagaggccttcctgcacatgctgcctcctgaatgccctcaccttccaaggtgccgtagttaggacagcatgtcctgaaccttgtcacaatcccatgagcattttttaaagatagggatagatagatattcaccatcacatatgtaatatgtatgcatgcatgtgtatctgtgtgtgtgtattaaagtttcatgttttgacctgctaaggaaagggtatctacagagacatagagggagagaaaaaggaaggaggagaaagagagagggaaatataagtgaagaaaagaaagagataaaaagaacaaaggagaagggcaggatcagaagatggaagtttaaaatgtgttgcgcctctgctgtatgttcctgttgaaggcagggctgggcttcttacatgggggaaggaaaccaaggctaattgtaaggaagatggagagggcagaggagggagaggcagagggggaagagagctgcctagagggtcagagggactgcctggaagtcccagatggtgctaatccactttgtgtttctataatgtacagggctctgggttgcagttactggtcaccagatccctttcaaatgctcatttgctatttctgtcctgaatatagctgatcagtttctgtgttcaaatgcaaacgttatttatggtgcttatttgttatgggtgttttggtttcttttgcccatgggattcttagggttttgctccctggcatcttggaaatctagtgtaagcctatgctaacagggacctgaagatcctttttgcagaaggtaagtgcctcatcacgcagagcctgaaggttagatttagggtaaggattgcattgacctgagactcacctttgactcccatccttaaaatcaaatttccttgatttgtttaattgttttaaaatacttactcttattcttctttgcaaacggatgtgtcaggcttgaacatttgaatgagctttgaaagaaagctgcctcactttttatttggtggcagcctacacaggttagtgatcaatcaaaacataagtaaagtagtaactcaacatttctttgaatgtttagattacttacctttgcatagctcttagccttttaaaaaaaattattattcagactgaaaattcagctctgtgtttttgttggtttgtttgtttttgaggtggggtctcagggtcacccaggctggagtgcagtggtgtgatcacagctcactgcagcctcaacttctggactcaagttattctcccacctcagcctccttagtagctgggactacaggaacccaccactacacatagctagttttttgtttttcttttagtagagaagagatcttgctatgttgcccaggctggtctccaactcctgagctcaagcgatcctcctgccttggtctcccaaagtgctgggattacaggtgtgtgccaccacacccagcctaaaactcatctttgaataggtaactccaggagtcaaaagtagggaatatagtttggggatacacagcctttgcggctggtaacatcagggtgctatgatttaaagggaccccctccgtgttacaacacttactacccaagttattctcttcagcatggttcatagtattgacctagaactattgagtttctgtgactctgaaaaaacataattttttatttcttcaatctgcaaaatagtgatatgttctaaggattaacaaattgcttcaaatgcctgctatgatagcattatacttgagcttaacttatttttatgtttcagaattctctgaatagcagttaactttctcatgggaaatttggatacatttagtagatttcaaagcataatgcaacaataaatgtttcttttcagtatttatttgccccttattgcctcataaaacaattcctaaaatcattggctctctccagtgatcttttactcatcttcaagtcatctccttcctctttatatttgattgaattatgagattttactgtttgccaggccttcaactaattgccagggatagaatgatgaataagctatgatctttgccttcaaaaaaacttctgtcttttcgtgagatggttcataaacagcccagaatttggcagcctcagaaaatattaggttagtttctttttttttttttttgagatagaatctcactctgccacccaggctggagtgcagtggtgtgatcacagctcactgcagccctgacctctccagctcaagggatcattgtgtctcagcctcctgagcagatgggactataggctgtgccaccatacctggctaatttttgtatttttagtagagacagggtcttgccattttgcccaggcttgtcttgaactcctggcctcaagtgatctacccacgttggccttccaaagtgctgagattccaggcatgagccactgtgtctggccttggttagtttcagttctcttttcaattagcaataattttgcttatatatatatatatatatatacatatatatatatatatatgtatatatatatatatattttttttttttctgagataaggtctcccctctgttgcccaggctggagtgcagtggcacaatctcagctcactgcagcctcgacctctccagctcaagtgatcctcccacctcagcctctcgagtagctgggactataggcacatgccaccatacacagctaatatttgtattttttgtagagacgcgtgtctcactatgttgcccagggtggtctctaacttctgggctcaagagatcctcctgtttcggcctcccaaagtgctgggactacaggcatgagccatcgtgcccagccctaatatatctttttatttcctaaaaattcgtacctctttcctatactaactgacataaccaaattggaattaaaataatgcaggctagaatttaagaaaaaataatcatctttcctggacagtgccctgctcaggtagacagcacttggttacctaccctttgcaagtttagttttaaactgccaagttctagtcattgaattttttttatatattatgcttccgtaacttctgttttgtctagaagcatgagccttagtttcttttcaacatttctgaaacacttacacacccagtatcagactttttgctgggaaaaaacacttaggaacaatgaataacaagaattcggtttattctgtttctgcctaacattgtgaggagtctgcatagtcagagttttaagaaaaaaaatgtaatttagtgggaaaattaaaactttgatagccaagggtatatgcagatagccttttctgtgtatttccattaaaaataatttatttgagaaagtggttaggaagaaagacatgtaccaaaaaatttaaattctttaccaaaggcataatggaagtgccaaatgttaaagaattgcatttgagcatttgtggttggacatggtttcaggaaagtattcattaagaagtgaagtcaagagcactgggtatgaatattgtatgctaaggggaaaatgtattttaggtaggtgctggtgaaagaatataccattatcttccttatcttttaagtatccaggccagtatcatgggaccctgcattaatagtgctttgggactgcacttgggtaatattttcagctgaaactgaactaacacaaggccctttgggcagacgatcatcaaagtcacgtggctgtattccaggaccgtttcacatcaagctgcatggtacaagacactgccctggaataagtcacatatctttgaagctccttgtgatgcaggaattttctcaccccttgtcagacttgcgacggaggtgccccatttctttggcccaccatgctcaaccttttgcaggaaggagcatatgagtgagcaagggcaggatccggccagctactctgggcgccagcaggagcagactctctgtaggcccctcagccagaccaggtggggctctctgcaacccccaagaccccagagggtgtgttacaatgctatcttagctctgctgtccgtggacagtggtgtgttatcagctcagtggacttgcctcatagtgtgggacagctgccctctgccagtgagggcaaagggccactgtgatagctttttttgggtacttgcactcagtgggtcctgaactcttgtctggtgtccaagaagaattagttacacagatacttgaaggatggtggaggtagaaaattttacttagtgatagaagttgctctcagcagagaggggagctggagaggggtcaggttgggcaggtaatcttccctgaagtccggttgtcactagctggctcttccctgaagttaagccgtctgtcctccaaagtctagctgtcccactgaagtcgaatcatctttctccagtcaagctgcttctctcttctgccagctgagtctggggtctttataggcacaggactgggggtggggtgggccataggtagttttgaaaaagacaacattcgattggtaaaaagacattattcagaaagaactaattgggagacagtgggcaaacaggaatagaagttctcattttgtgctgtggctttttggctcaaacatgggattttgccacggacctacccctgtctgcctacaatttctgtgcctcctgccactatcacttggagttggccaagcattgcctgagagccccctgcatgccaaactctatgctgaggaccatgaggaggatgcaaagaattcaaggaaggattcagaaagggagggccgtgattgattgattgagctttactgtggggcaggcgctgtatgaaacatattccatttaattctcacagccaccccgaaggaaggtacagtggtccttatttgctcacttgggaagcatggttggagagatgagctacctctccagggtcccacagctatgatggaagggccaagggtcctggccacaggactcctagtatgtgcccttactatgacaccctgctctctaaacaacaaaacaatcagcccactgctggggccagatgctgttttatccaatcagctctctggatctctgtataagttaaagggtgtatatggcctctttgcgatgactgaccactaaagtcctaaaccatttactgtctggttatcctcagtaaccagaacaagaaattgttcagatccacatcctagtagcagctgtacttcaaaacacaaagggcagcttaaattgagaaattgtaatgttctgggtggcagaggcaatactagtcctagaggtccgcctcctcctatttaaggcataaatactacaacagcagagacatcctagggtctagaccagagtgatgtggccccacatgtctagctgagctccagcactaaaggaaacctcacagaaatcccaccaccttctctctaacaggagatctgccactgtggccccgtgggtgtcctgtggtggtggacagacaaatatccctggagaggtggggccattgcttggagcagcaatggtacaagtgtttatctctgaaaaggtcgttgttggtggtaaaatttaacagttcttttttttttttttttgacggaatctcgctctgtcacccaggctggagtgcagtggcgcaacctctgctcactgcaagctctgcctccggggttcacgccattctcctgcctcaacctcccaagtagcttggactacaggcatccaccatcatgcctggctagttttttttttttttttttgtatttttagtagagatggggtttcaccgtgttagccaggatggtctcgatctcctgatcttgtgatccgcccacctctgcctcccaaagtgctgggattacaggcatcagccgccatgcctggccaaaatttaacagttatttagacctgtgttctaagatttgaaaccactgatgacttttcacgaagtaagatttgaaaaaatctctctagtgtcacatccctcaatcggccaattatgcatcattgtcttttgctagtttctaaaatgattaattgcacaaagaatagagatagcaggtttgtgtgaaggatgctcttcttttttgccacctcaaattccccgcttcctgcctccagcaatttctggcctgttctctggatgtcagttcattaccacattagtgtgttcattgtatgttctgttgccaggaaggtgctgccacagcggcccctgggaagtcaggatgctgctagttttcactgtaggtctatcaaagagaaacctgtgggattgggaagggatttggtcatcccagacatgttcggttttaaggaactctatgttctaagaaatatgttgacatcaacctttttatttccagcataggaaggaaaaggaaaaaagggaaagaaatattcaaattatcttggagctgtcctctcatttctattaggcacaaaatccatagttccttttcaaatggttattgacccaacaaaagattggatgtactggggctgagtattatctctgttattatcacattcttttgtcttctatgcactttcattcatctcctgtagaggcagatcacagattgattttaaaagatgtaacaatgtctcctcaatcgctgcagagtacattttgtcattgtgttgactgttcgtgcatttcagtttattattgctggtttcaaaagcatgtaatttttatcggaaagtaggttacaattaagggagttgcaggtagtgatcctgggtcctgttttgtctccttgataaatacaacttagaggagctggagaacacgtgtctggatttgtagctctcctgttccctcctgagtaacctcaggatatagcacctgggggaagacaaaggagaagcaaagcggatggatgcgggtgtctttagcaaaatgacaggtgaggcagggcgagaacagaggacggaggtgctggctgctagaagcttttcaagatggagctgtagaagcaagcctgtttttggtgagagaggcaaagtctcatgcccaggggagatttttggtttcttttaaggagtaataaagtctagggtggtctgtgtcatttcaccctttctagtaaaaaggattagctctcgttgaaaatgcctccttgtcccctgaatctgtcaatactccacctttgtcctcacccttgactttaaaaaccctgccacatgacttcctatgaatgcataaattaagcactttttttcctttgtagaaaaaaaaaatacacacacacacacacacacacacacacatatgcacacagcaattaataaccagagtttattgagggtttacagtgttccggccatttctcattgcatacaaaatctcataaatcccacccaaaaaccatgaggtgagtatcatcccacctagcagatgaggaagtcttagagaggcaaagtaagttgcttaatgtcatacagtggagagccaggattgccagcaagcctgcctggcaccaggacccatatttttaatgtttgcgtgtgtcacatgtacagcgtcttccattttatgtgcaaatattcatttctcacaccctctttggagaaagacaaggtggagaggaggaagttgtaagtgttgaaatgggagcactcacacatgtgagtatccaggagcccccaggaggctcagcagccatgtggccccacctacagccacctcatttctttttctgcaacataaaatgccgctcccgggtgctattgaaaatacatgttgtgtggtgctgacacagtccaaacatacctactgagcgtgctcagatctaattaggagcctgtctctgcttcctgagatatgaaagcgtctggaaacatgttttctttttcttcttgctttgtagagatacatctttttaaaaaattgcagaaagctttttggtttcttgttcaaaaaagtatgaatcggccagatgtggtggctcacacctgtaatcctaacactttgggagaccgaggtgggtggatcacttgaggtcaggagttcaagaccagcctggccaacatggtgaaaccccatctctactaaaaatacaaaaatttgctgggcatgatggtgggcgccagtagttccagctactcaggaggctgaggcaggagaatcgcttgaacccaggagtcagaggttgcagtgagccaagatcacgccattgcactgaagcctgggcgacaagagcaaagttccattgggacaaagttgtatgacaaactacctttctgcctgaaatccataataggagctgggtgatagactgagaccctgtttcaaataaataaagtaaaatgaataaaagaaatgttacatactgttttggaagaaagctcactggcactagagaagcttttcggagctaaatcatgccccaacaaaggatagcacaagaaaggctggaggagcctctatcatcaactagttcagaattagcataatgcaggtctttttgtttgtccttaacccagcattttctcctacttaatttgaataactgaatggcctgcctctttggatgatgagaaagcttttatcttctattgagaaatgatgaatagtattggctgagacttgtttcctaatatctatgccttattcaaaatgtcatagatcttttatactaatacattttagtatactaaaagtttagttccttctataatttatctgttctgaattttccatctccaactaattcaaacctcatcaggagaaaggagaaacaaattgtaccccaaccattgttccttcttgagttgtattatgtcagcacagtcctattttaagatcctaaactctaaagctcatttttaagggtatgaatacgtctagactaaaatcgcaaagccaccccagaacaaggaggaaaaaaaattaaatgttcttagaactgttatttttaaacttaaagataatttatataataataattacatttattctgaaagctcctacttgtaaattgttatactctatactttggtttttaggctcttttttttttttttttaaagttttttcatagatgtaaaattgaagatggtggtgagggtctgaggatagttcacaagactgtttaacccatgcttagcttgaacctctgagccatagtgtcccctaatccctggcttgggctctgctgacaccaactgtaatgcagagaaatggggtggctttggggcctgggatggcctctgcaggctgtcctatcctgcctttccccatacgctcctgttgcaatcaaaagaaaacatagaaacaaatctctaaattaaatgttttatttgggaatcacagaatagcaatttggggcatacacacagactgaggtgggctttggtatgtctgaaaaagggaagcttgggagttttattataaagagaaatgtgggccagggacagtggcttaggcctgtaatcctagcgctttggaaggctaaggtgagaggatcacttgaggccaggagttcgagaccagcctggacaacatagcaagaacctgtctctacaaaaaaaatttaaattagccaggtgtggcagagcacacctgttgtcccagctgcttcagaggctgaggtgggaggctcacttgagtccgagaggtcaagtgagcagtgagccatgattgcagcactgcattccagcctgggtgatagactgagaccctgtctcaaataaataaaggaaaatgaataaaagaaatgttacatattgttgtggaagaaagctcactggcactagagaaacttctgggagctggcaagttctgattagtgggtgtcagtgatggtggtaggaaaaaccagtcttggagtcatggcgggtcatttcagcagctactaggtgacactgtttttaaggttacagcttgccattttagcagctgggcttgcagaaaagtcaattcttggagcagatgctgtgtcctgagtgcttaccacctgactccgggccctcgactctggcttagttgggtatgataagaatgactcaatttgcataatcaagtttcacactctgtatcccaatttaggtctctgtgacttctggaccatgcttcaggccactgccaaaccaaggtgtcctacaactcaccctggccatgtcattgtattgctaataactcttcagtgatttcccctgagccagttgacttgagggtttcagagttctccaagtctgctctcaaactgcatttccagactttatctgtaacttcttcccccaaccaacacatctcctgtgttcatgtctaactgggccactcctagtttcctggacataatttaaggtttcattccctcctttcatctctgttgcctgttgctctttaccatccatcaaaatctagcacaaatgcaatttctgtgaaatctttctaacccttcacaccagaagtaaccattctctcctcagaaatctcatagctctttaaatttatttcttattaattgttctcattctattttctattcatttaacagacattgttaggctttgctatagttctgttttcctttatttaaaaaaaaaaaaaaagaaaatacttggccaaccataaagtgaaaattagaaagcatctacttcctaaatttaggaaactttttaaaacttttttctgttcttgagagtctcccatataaagatgaggcaggaagctggaagctgtgtggttgcaatgctgtttctatctgttttgctgtctggattattccagtaatttggaacaggatagagtggtcctggaagctagcaatgtgggtggctgagggaggaaaagaacaatgctattccacatccatttcaaaaacattctaacaatgaaacacaaattcggatcagtttgtttccatttttaagtaaaaatactgtccacaagagataaatctcattaagatcatgcttattctgttaattaaatgaaagtttgccgagatatataatgggcgactgggacttcagatgggatgagtatcaattaggaaatcctcgccctggcagtctttttttttttgagacggagcccacagtcccacaccaccacacctggctactttttttggatttttagtagaggcagggtttcaccatgttggccagactggtctcgaactcctgatctcaagtgatccacccgccttggcctcccaatgcgctgggaatacaggcgtgagccaccacacctggcctggctctggcagtcttaaaaggaagagaacaaattaactcatctaagtggaaaattcagaggtggccctcggggttgatttgagccagaggattttgaagtctcagagttgtggcttgctgtctttgaaaatctcttgactttgtcatcttctgtgtgtgagctttgacctcatgggctttgaccttgtggaagtgaggtggccactgagagcccccagggctgtgcgcctcctggctcctgggatagggtgggatcttctctttcctcaaccattgaacaaaattctgagcatttctctgaatagacaaagttcaaagtatatcacatgtctacctctacactgtgccagaagaaaactgtgattggcttagctcaaccaaggcccacctctggagctgggggtggaaaacacaatgtttatccaatggcaatggctggctggagggtaagactgatgggggtctttgactaaccacaaggcaacataaggccacagtaacataagttgaggacaggaggccaggcgcaagcaagggttcgtttatcttttgacaccctctcattgaggccaactctgtgccaggcattagtagtctaggtgctggtgatgagaggtgaacagcacaggccaggctcctgccctggtggaaatgacaatctattagggtaggaaacaataagaaaacagacaattaagtgcacagatagtttcaggttgtgacaactgtcatggaggaaataacagaatgagttgcagagatggggaagagggtaccttagaaaaggtgactagatttcagaaatcacagtagaagggcaaaaagccaaaatgcccctttgcaattttgcagattgctgcctactgtacatgctgtccgtgcccgagcaaagcattgagactaatttgggaaaccaaaaagcttcccactttgcttggtcttcactgtaccagctagcccagataaatctttctggctctcccaaggactctccatcgttgtccagcccttctttcctaaaggcaaaagggaaggaggtggacatagacaaggagctatatgccatccagcacccaccactttccccatctcccttctttcttatcagagcagcaagtgcaatgtttgataaagtccccagttaaagagtctttagaagatttttctattaggccaggcacagtggcttatgcctgtaatctcagcactttgggaggttggggcgagcagatcacctgtggtgaggagttcgagaccagcctggccaacacggtgaaaccccgtctctactaaaaatacaaaaattagccgggcatggtggcacccggctgaggcacgagaatagcttgaacccaggaggcggagattgcagtgggccaagatcgagccactgcactccagcctgggcaacaaagtcagactctgtctcaaaaacaaaaaagtttttctattaaaaatattgctgctgagtgaaatttccttactactgaaaatgttgtatgatactttgagctgcttgaaatgctgttttaatatttggtttagaatatccatagctctttgtactaccccctctgcacataacacacagctttaaactttaaaaaaaaaaaagtaattggaatcttttccatggatttgtacctatccataaacatataagaccctgtttgatgtttgcttcactggaaacaaaactaaccagatgaagaattcctaagatcgaaatattctttcatgtatataattcactgaagtgtagagaaaaattgatattgttaggtcaatcaatgaacttaagggctttttttgcattttgttatgcttttggcatatggatcacaagtgactttatgcttctaaagaaattatgttggtctgtggtttttagtagtttgttgtaaagcatatttgaattttttttttattttgttagggcatatatcaaagcttgactttggagggggtggatagtcttgttgtagaacattcgtgtgtgtgtgtgtgtgtatgtatagccttcaacattttttagcttgaaattagttttgagggcattaaatatgatatcctgttccttagaaaatattaaaggctctctggttgacattagccatatgggaccaaatagaatctgtataatgttataactttataatttgatcaagacatttataaagtagatggcaatgaaataggaagaaacaagctaaaggtaaaaagaaatgagagagagagaggaagcatattaaatgctaaataatagaaagcacgtctgttctgaggttagaaaactgttcaattagttgtctagcaaggtttctgtaagcagtgcctctgcctcctcttatggccagacactttctgtagcattctgtttaatttgccatgtgtgcctgacataatgaagtttaaagaacatcatggggatgatagaagcctttgcatttctaatcttatgctgaagggcaattgatagaagcaactcatcaaagctttctttcaatcaaaacatcttgttttgattaagcacttcaggtttggtgcttcatttagggtgtgaagttttacagaaattgtttataattgtcactgagaaggctgctgaagagccattttctttccctgccccattcttcccactgaaatgaaacctggtgtatgaaaattttaattttaattatttatatttaattattttaattattatttaattgtttgaatgataaaagaattttcttgctttgcaaaaagattcctagcagtgtcttgaaaagcaggactttgagacctccttatttcatcttttctgaaatgtttggccagcatcttttggacatatgcctttaggatccacagttgtcactgtttcgggggctgaaattgctagaagtgttaggaggccctgcctgtgtctttccataagcagcagccttcacctgtcattgtcacagcaccccccaccgccttaagaactggacaacacctcaagaccacattcaccatgttacagctctgcttctgttccagttccattattctgttaattagtgtcaccatccccctcatcccccaggcttacatccttcatcattcctgatgcctacccttttctctttctcacaatctacgcccacagctgccaagtgataatgcttctgcccgcaaatcacctctaccattttccttcctttatcttggagagagagcatgctatcctgccaggatacagaaaagttgatttgaggtgggtctctggagccctgtgtttggaaggattctgaggccatatccaagcttgcgtaggaaatcgattagcaatgtctgtggtggcaaagaaatagaatcaccatatatgccacagatttgtggcaactggtgtcatgattgaagccttggattttgaattaaggagacctgggtttcacccttggctccaaaactttccaaccctttaactgtgggcaagtcagttaaccttactcggctttagtttccttatgagttcaatagggctcattggttaacttaaaatgcattgaatcaaattaaacctaactaatattaaatacttcctgtgcataaagcaaatctagatttgttgttgactatgataaagaacaaataacatacattacccttcaaagtgtggtaccaaacataaaccgttctattatgttcaatttcttctgccattgctctgacttaggctctcatcacttagttcccttcctcactattctccacacaaatgctccctcaaaaaaaaaaaatttgctctgcataataaagcaaggctttgatcatgccattccccaattcccaagctttctgtggaagtcgtggttggcagtgagtgagtcccctccttggtgttcagtatcttctggcagcatcctcaggacttccctgaagagaatgctgtagcaagcagcagctggtggggcctgaggagaaggatggaggacagcctggtggaggaggctgggccagggtctaagagaggaggcctgtaagagaacacgcaaagggagtgccaggagaatccccacttttaactaccaaacctctggctctgtcttctaaagttctaccctatttcctccccgcaaggccaccccacctccacatcctcatagtctgtctttttttttttttttttttttttttttgagacagagtctctcactctgtcacctaggctggagtgcagtggcacaatcccagctcgctgcaacctccatctcctgggttcaagcaattctcctgtctctgcctcccaagtaactgggactacaggcacctgccaccatacccagctaattttttttgtatttttagtagagattggatttcaccatgttggccaggctggtcttgaactcctgacctcaagtgatccacctgcattggcctcccaaagtgctgggattacaggcgtaagccaccatgcctggccaagtctgtcattttctacttatgtctcctctgttttatctttcagtttttatctccctatttgaatcataatatagaactgaagcatatttttgtaatctactgtttactgaattaattttatttcctctgttcttaattttataagtgagagagaacatttccttatttcttgtttctttctcactgtctcaacacctgccttaagaaaaaaaaatactttgttgagtctttcctttcgctgagtttaatttctccctgtggcataatagttctcatcataaagttccctgttcttattgagaatagtgacctctgcaagtgcccttcagttatgactccatgcacggaatttttatttccacattctataatccggcccttctcaacagaggggattttgtcccccaaggtacatttggcagtgtgtggagacatttttggttatcacagccgagggtgggaggtgatgctactggcatctggtggatagaggccagggaagccggggaaaaacatccttcaatgcacagctccccgaaacaaagaattatctagcccaatagtgcaaaggttgagaaacactgctgtaaagtagtgtaagcttgcgcaatgctcagacagagcacttggtgagtagtttttataaaatgtttatttaggcccagcatggtggctcatgcctgtacaaatcccaacacttttggaggctgaggctggcgaatcacttgaggccagaagttcaagatcagcctggccaacatagtgaaaccctatctctactaaaaatacaaaaaattagctgggtgtggtggtgcacgcctgtaatcccggctacttggaaggctgaggcacaagaattgcttgaacctgggaggcagaggttgcagtgagccaagatggtgccactgcactccagcctgggcaacagagcgagactctgtctcaaaaaaaaaaaaaaaagtttatttagttgaacctaaacctcttaaagctaaagaaatcagctttatactctctccctgattacatttgttttttggccatatgttgtattacccaaattatcaaggtatttctattacctatattcaataattccttctttctcatttattttaacttgacttaattcctgtaacatattcttctacagtttctgtgctaattaatgaagaaaatacttagtaaatatatttaataagataggtatgattttagagaaagctgtacatagatttggtttctttaatttatattgttaaatatatgttcattttttaacccatgaatacatctaaagtaaatttaatttagaaacagcgtgtattatagaatagcaagccatatcttttaccaatagcgttctttttgtcttcatttatatgtgccattttttcaaaattattattactctaaatatgcatttaattcccttcccaccttgtcatttcttataagcttccaaagttgtaagttatgggccaatgaccatagtttatgagtgataaattatgaagatagatttaacactgtacagtgttgtagtaaaaatgtgcacaagttaatctaacacttttttaatgatttacatattcatcactgtgctgcattgtaattagacatatggatagggtaagcagtcctgagaaattaccatgattagtattctttccacatggccaaatcacatttttataaggctttttttcttgcttgcttagttagttctctagttcttgtaatcagtgtcatggctgatagcctcccttgtatagtacaatgtacactttatgtacacttaattgtcttctttctctctctctctctctctcacacacacacacacacacacacacacacacttgtatttctcgttgacacatacttaaaatgaaaaacatgcaagctgctctctctctcatattattatcctggggcttgggaacattaagaataaggagatgattgggatcaatgacgctagcatctcacatttttatcttcattttgataatatggaattgaaatcattgttcttgtttgggaaaagatagggcataaactggaacccagaggtatccctcagtgtcagtcattgcatgctgtccccctataagcagagcatcattttctgcttatcacttaaggaatcaaaacacatgctaagggtggtggctcacgcctgtaattccagcactttgggaggctgaagagggcagatcacttgagcccgggagtttgagaccagcctgggcaacatagtgagactctgtctccacaagaaatacaaagttagctgggcatggtggcacctgcctatagttccagttacttgggaggctgaggtaggaggatcgcttgagcccaggaggcaaaggttgctgtgagccgagatcgtgccactgcactccatcctgggcgacagagcaggaccctgtctcaaaaagaaaaaaaaaagaaaaaacccaccatgttcaagagcacacaaacttaaagttgtaaccagactgtgacacataaaatggcagccatggtcacaccaaccaagagctgccatatgctttttactcattcatgcctgggtgaattttaaagtgataattcacaatttcctttaaatcaaccaggtggtactgaatttttttccttcaatgttgttgcaaatatgcctaaatggtgagatcgtagccaattttgattctcattatttacaaatgaaatctttatagtataagaaatgtttactgctgatgtttcctctcattcattagtaaaagcaagtttttcagacatttccatttaaatgcatacttgcaagacttcattaaatatctttccaagaacttggggtaatgagaagtatgtttggtttctttcctgtagcttttccgggaagactgggctaggacacttaagtgtttagctggcaattgaagagaagtcttactgcttactcttctaggataagacattcattgacattttttagttccaggaaataatcttgtacctgtaattgggacttatttagactttcttaggctttaagtgtgtgtttaaagtagactcttggaagcagtaatgggagggaatcaaagaaaaccaaactcaaaagaaagggattaacctaatcagccacatatgccctctgctattttagatcatatattttaaatccagataatttaatgttttcatatatgtttgaagacctacaatattaataatttatcctgttgctgatggagatggcctcttaattccaagtgaaatttaatttttataaacgcagagtttaagatgaaaaattaaaatgtttaagatacagcaaccctctaagtacgactatcaagtacagttttatcagtgacactctcctttatcaggtgtgtttgcttccattggattacctgaatcaagtttgctgttgttttcagttgcttttgtttttataagtggatgatttaaaatgtttatgctttgcttacatgagaaggtagacttgacctctacccaaccatcactaccaacaaaatcccccaactaatcataaaagtcaaatgatgtgctactttagaaatatgtctgtttctcatttttcttcctatggtttgataaacagcctttaatgggaaaagttctccaagaatatggcttatcatgactccacttgccatagcccaagcaacgttgtccaagaattccttctacatattggtttcttcaccccttggctatttatggagctcctaaaaagtcagatctctctgatccagccagtcttacctcacacctggttcccgccttccattcttgctatcatggctaggtccaggcactcctcacttccctagcacagcacaggcccctgtctggtttccttgcctgcaaccttgcactcctcagctccatcctccacattgcctcccagtgttctctctaaaaggcaaatcgttttagatcaagtcttacttattcttttaaaatattttgttgagtaaggagcctccttaccacccttctcccatcctctttaaatggtcccaaataccctacatcatctggtccttatctgccactccagaatcctcttgattcatcttctgttctaattcaatggcccgataatgaagaatggctggcagttctccttcccacactctctgttctgccttagacctctcctgccctggaccatgctgtcctgtagcctggggcacctgctcttctcttcacctagtttatctctgcacattctctaaggtgcaccgcaagtgttccctgtgctatgagcctccacactcacaaccctcaagatgggttaaatgtccgttttctgagcatctagagccccctccacacacctctgtcttctaccccagcatacttagcaccttatgttggaatgatctgagggtggagttgtctctccctcccctctaaaggtttacctgaggtagggactgcgtcctcttcatcttatcctgccaaggccgagtgcagaagagacacgagggaatgatttctctgtggagctttactggatgcctcaataagacgaactttgctgttttctttcaaagaaaaaaaaatctttacttttttttttctatatatcaagttctaacagcatattttaactttttttttttttttttttttgaggtggaattttgcttttgttgccccggctggggtgcaatggcgcaatctttgctcactgcgacctccggcttccgagttcaagcgattctcctgcttcagcctcccaagtagctgggattacaggcgcatgcaccatacccgtctaatttttgtatttttagtagtaacaggatttcaccatgttggtcaggctggtctcgaactcctgacctcaggtgatccaccctccttggcctcccaaagtgctaagattacaagtgtgagccactacgcctggcctaacagcatattttagagacctcacttacttttacttttctttgttgttctatatactgtctaagcaaagtctctctgaaaattgtgtgttctaacagcaaatcttaccaattttcttccttgtttgaaaataaatattcaaaatattactttccttttggggcatatatacgtttaacatctcatccttgaagttttcctgaataatgatgtcaaaacaaagcgccttacttgtattattctaagaatgtttggaggagaaaaatagcaatttttgttagagagagttttaggtttatgtgaactacaaaaaaaaaatcataaaaaaatcaatctggcgtttgtagaattttttaaaaatttgatattgttggtagtagatgtaatagttttttctattaaaaatttattcattttactttcactgaaaaatatattcattatactaaaagagcgtttactctcaactgtatagagtataggcaattactgttttgttttgtttttttttgctatagtatatgaacactgagttataaagaagatgactgtaaaatggttagtttttttataaaataggtgctttatttgtgttcctctctaaaatcttgtcataaaataatttatagagatagctacccacatgccataaatgcaaagacataattagccacttctgatatcacttacagaagacaatttactcagtccaagaagtgggaataagattagcgtgtgcatcatgtcatattgcactttaaaatagatacaatgtagaaaaatatacctacatgtaatttaaatgggaccagtctaaaactaaatgctgcccccaagaaccatgaagcatccagctactggtattcaattgttcatatttctaaaggtataataagaataattctgaatgaccaaaggaaactttaaaatccatccagtgaattttcatctaatttttttttttttttacctttcctgttagaaaaatacatattcagtgaccaggtgtggcggctcatgcctataatcccagcactttggcctctcccagcactttaagaggccaaggtgggagaatcgcttgagatcgttcgagactagcctgaacaacatggcaacattccacctctacaaaaaaattttgaaacttagctggatgtggtgctgcacacctatagtcacagctactggggaggctagaggattacttgagtcaaggagtttgaggttgcagtgagccatgatcacacaactgcattccagcctgggcaacagagctagaccctgtctcaaaaagaaaaaggaaagtgtgcatcaaagtctacttgaatatgattatctttgtaatcatgccccagtttggagtcagtcttttgttaatcatcattacagcagccaaatatttgaaaatagaggtcatggtcagtgagagtttggagatgaaatgctgccagaatctgagctcttgttcatcttctcttggtcctctctgctcctcgtgcctacacattaatggcgggctcaggagggaagaagactctcaacaaggaagagctgaagtgtctgtgtagcatggcacactgggctgttcactcccacccctccgctgagcaccttctggcgttgtcttccctgggcacctctgtgccttgtgtctttccacatgctgcttcctctttttcttgaggacactcttacacccctgcctctaggcactgctcaaagataagattgtgtagcagagcgaggtgcccagtgcatattagctttcctcccacctgttcccaggctggagtaatctccctcctctccactgcgagagcccttcctaggtagggtgccagttacaccctgggaatacacgcttgggctctggcgtcagactgcaccaagttcaagttctggcgcagatgccgtgtagctgtgtgcccctggataaattccttgccgtgctaagccttaagttcatctttaaaatggggctgcatttgcgcttagctcttagcattaaatagtaaggtcatgcatgttggggaagtacacgttgagtatccctgtccaaaatgcttggggccagaagtatttcagataccagggtttggttgttttttttttgtttgtttgtttgattttggaatatttgcatatacatgagatatcttagcgatgggacccaagtctaaatattaaattcatttatgtttcatgtacgctttatacatataagcttgaaggtgattttatattatttttatagtaattgtatgcatgatacaaagttcatgtatgttgtaccatcagaaagcaaaggtgtcactatctcagccaccccagtggatgatctgtggtgatttggcatcaccatcattactgactctgaatttataggctaccaataagcaatcattttcctgcacttattcacacataagtacttaacagtaaaaaatatgatacaccattaatacaggaaaaaaataatgtgtgcagattaactaagcagcacagcagcatcacagaatacctggatcagctgttaaacagcagcaacaacagacagtgcaggctttagtctccacttaccatgctgtgttttgattaaaaggtaggacactgtgcagtgactctcttggagacgctgaataacctgtgcaatgtacctgcattttgactgtgacctgtcacaggaggtcaggtgcagaatctttcacttgtggcatcatgtcagcactcaaaaagttttggattttgaagcatttcagattttggattttcaggtcagggatgctcaaccagtagtaagtgactggcacacaggaagtgctcaataaatggtagctattgatgactttgtcaaagttgttaatatggcttgcctttcttctttaaggatagaaacggcgttttattcttttttgtatgtcacacagtggatgttcaaaaaatatttgccaaggggataagttaatgaataaacttagaatggtgttgtgagccaacagcaggaatatttcaaatctttctgggaaagctgcttgccccttcacctctgctggactccttgccccgaacccagtacttcagaaccttaaaggaaactactcagatagggtagatgtctttggttttgtctcatttcttcattcaccgttcattgaacaattactacagggctccgcctatgtgtccaggcaccactgactatctgaaagcaaggtgccaaagtgtaaaaaacactgctgaaaacaaatcgatttgtgtttgtgtgctgtcatgtggagagcagagcccatcttttggtatatttcagcgatgcctctttcttcctctgggataccaagggctttccatttatgcttgcagccaagaaaagttttccagaatcatccaaggctatttaccttatgctgaaatatacaagtgaacaggtaaagatccagaggtgtttaacaggaggggctaccagacaatgttacatatagggaacagggaagtgagacctggttgaaggggaaacagcctgtgttaggtgactgtccctttatcatgggagagtgcaaggcgtggactaaaatcctttgctgactgtgaacttcttgagggattaaactatatactggaccatttctgagatcctctaaaatactcaatatattttgtttaattatctgatcactttctactggaaactaacatctaattcgcattttcctaagtctaaagtagagaaacacctcacaaatgtattagtaaattggatagaaaacattgacagtgtttcctgagttatgtgtgttaaagatgattccactaaattaaattacagacttttgctcatcagtgactcatttcggatttgtggaaagagaaaggcgacttaccttgactttgactcatacagtgggggttaataatgtagtgattaaggtaacagtcatcaaaagctgttgggaataatgcaataatgcctatacttttattctttgtgttatattttagtgaaagctcttaaatgattaaaatgtatgaagcaagcaaagtctaccaaggaataatcagtgcaggtgttcaaggagagagggtgaaacagactctctaagaaatagtgattgcataacacggtgtgtcacattcccctcagcaaggtgaggacacacaagagcataaaactgccctatgatatgactcagctggtacccaccaagataaatgccttgaatcattcaagactatttaccatatgctaaaatccacactgtagcatgttatgttatatagcatctgcattgcggtaagattatataatcccaggaatcagaagaatgacaaaaacatagaagggaaggggaaaacccccctccatctgccctgatctctaccctaaaggagagagtgaaagaatttgagaagggaaagaggacagctgagaataaacaaagagggaagggggcctcagacgatgaatccactgaaaaccaaatgtttctagagttccctaatgaagccgtttcctagccggtgcagacgatgctatgacagtgtggtgacaaagcacagcactttactttgcacatcactctactcaaaacacaccacaatttattttttatagcagctctattgagatatgattcacataccatacaattcacccacttaaagtgtacgattcgatggtttttagtacattcgcagaattgtgcagtcgtcaccacaatcaattttagaacattttcatcaccccagaaataaactccatatccattagcagtcctataattcatttttatccaaagagaaaaagaaacatcctatatttataaacctagacttacaatatagtcattttgttttacaaaagtaatgttataattggggataaaacatctatgacttgttataactcttacaaggaaatagtaacttgaaaggttgaaagtgttttaaaaattatagataatccagcttggctctctgtcaactgttttttttaaaaaaattataaaattcaacatttatgccattccttgagactagacttcactatacagtctacctaagtcatctgccttattggtcattttcaggacccataatgccacctacctaatgagaacattcattgaaaatactttgtgaccttttgtttaaatatcatattggatagtctccttacagtaattaatacccagagcatataaaagaacagattggccaatcagaatataaaacaattctatatgacaaaacactataaaaattaaaattaggagacaaagggaaagtgctgtttgtacaaaatgtgtcctacaaaagactacatttcataatatattgattggaatatttgctaatcaataaaggtgaaaaaaaaaaacagaaaaaaaagcagagggatattaacaggcaatttacaagagagaaagtccaaatggcttattaaatatatagaaaaagttttcaatttactaagtagtaaagaaaagtaaactaatacaacagggaaatcccatttttttctcaaacaggtaaggaaagtgttgtcaaagcgtggagaagctcagtctcataccaagttgatgagaaagaatagtgccagacagcatccatctgtcaaaattttaaagacacgtcagtctgccctcattgatccagcaactctgtctctagaaattttgtgcacaaatataccaaagtattttataaggtttactgcagtttatttgtaatcacaaaaatctagagggaaaaaagtaaaaactatcagtagagatctggctaagtaaattactatatatccatttaatggaatactatgctgtcattaataagaattaggccaacctaaataggccaatattgtaaattgtcaaatatagattgttaagtgcaaaaataaaatcaaagttatcaatattatgttttgtatcccatttttataccggaaaacacatacacacatatacatactggtatgcatatttttataatgcttatatattctctgaccttttaggacagaccagccaagaaattgttatctatagcgtattgaactaagagtgagaggaagtgggggagagagagtttttactttatcctcttatatattatttaaattaattctaagatattcaaatgttttaaaatgcaagaacatttttacatttaaaaaacaacacatatattatagaaaattggaaatgcaaaaaaagtaaaagcaatgccttgatctaagggaaacaaacactgttaaaatctgttcggatatcctttaaaaatgtttctttgcatacaatgtgcacactatactgttttataatctacattttttcactcataaacattccacatcactatatgttcttttacaatacatttcaagtaaatatgtcactgttaattacatggctatgatagtctgttagtgcattttctcttcatttcccttcataaataaattggaaggaaaatatttgggagaaagcagtaatcaaggtaataggagaggtttgtcaaaataaatgtcataaatgaggattgggcggtgactcagagacccaaaagctaagttcattctttaaaaataagatgtatcaccaaatcttaaggggggaaagaaaacgatgatggaatgaatcagaattacagaatgtcttctacatttctaacaaagttaacaaatagtcatttaaagaattaaaacaaaaatgaaaaaacaattaagaaatcattagctgactccaaacaaagacagagaaacaagtctgggtcctacactttaaaaagtggttgtccaggaaagacacagaagactgctgtgtgacacagcagggagagcccctaactcctaatttagggtgatttattgcttccttcttttaatatttttgcacattttgaatttttataatggcatataacgtatttacaaaaataataaatccattacaaaccctttctgatagattatttttaaagaaaaagagggaaattatgcatgaagggttgatattttctgtgtatgaacatgattttctcagtgaggcccagcagacctcaggagaatcctgctgttgctaagagaccatagtgttcaatagcttctctcttagctaaacgatgttttaggtttctgtaatttttatcaggtacagaatattccagagagaaagaagagaacaagattatctgttttctaaacacaaaagcatatatttttaaaattatataaatacatctctgctaatatttttggaaaggaaaaaaattctgccatgtgagattgagtgtctttaaacagggcttgacactttactctttgttttggaaataaaagggccaagtttgtcatagaaatacaagtttaccttgcagtttacataccattgcaattaatggggtaaatatttgaagatgataagtctagccaccaacagcaagttatctactgaaataattttgtgaattacttagccaacgataactgccttgtggattgcagtaatgactgatttgtttgatggctgagggccaaatgcaaatagagtatcatctgatttcaggcgtcttggccacaagtcaactgtaatgtctcccttctaaccagatccttttcattgaaagaccacaatccctccaaaagcctatatgctgtcatattagatggctgccttcgtataactacaatatttattagccttgaaatgctataacccagggacttacataagtactgcatggggaattcatttcaagccacatttgaccccttgttgtaaaggtgatcttcaaataggtttaagggaaataaatcaagttttcaacccaaagtctgctttctcctaataaaaaagaaaagagggtttagatgtttctaaccttttcttcttttcttcactttggaattgaagattaatcacatgtacccagagatgtaatttaatgtctgtcatttggaataggagggaaaatagataaattgttcatgaagagggtgctttaaaattaaacaatacaaccaaggattttattagacagttggtgggaaggatacttctcattaaaaggaaagtcaagtaattagagaacatgagaaacaggataataaatactagactttttggcaaaagtggggaaaaggaaatctgaagttttcagagtaggacacatagaattatccttgataattaactcactcttaaaaaatgtctgccttactttggatgaatgtgaaagaatataaaaataagaaattgtttagaaattgttggaatccaggagaactttttcattcgtaaattttcattgcatatgtatgtgtgaacatgctctccactgaagcctttttttttttttttttttttttttttttttttgagacaagatcttactatgctgtccaagcttgaattcctgggcacaagagatcctcccacctcagtctcctgagtagctgagactataggcgcatgccacagtgtctggcttgaaagcttctatttttattggtataactctgtccttaagaaaacaatctagctacatgacataggtgattaaattatgctcacaagatcagttcctagataattgtttgcctttggtttttcacagaataggaaactagaagttttgtttttgaaatgatacgaatggccatagaatttcccaaattcccgtttcttcatcagtctttcccacccagtctcttccttgaaagcaacttcctctaaggcagatgacaggagagggctgagcagcaagtgcagcctcccttgggaattgtgagcaaccagatcacgcagccagaaatccagagaacaggacagcaggtcacttatatgatggcagatatgttggctggttgtgaacggctttaaggggttccaccttgtacttaaagacccactggagctgcttaaatatgcaagtccagcctaacactgagatgttcaccaagagtgtccatttctacttgattcagacattttcaggtgttctaacctcacctccctgcccactcaaacaggtcacctgtggcacttagatcacctgtaatttccccaagcaatttactaacatgtagcatcgttagcaagtatatcacttacgtgactgacaactgtaggtagctggatttatctatgaagacagagtctcattttgccaaaaatagaagcaacgcagaactatttcgtctttccagttggattccaagctaacatttagggcagttgggattcagctaaaaacacagttgctttctcagcagagtagagaatgactgaaagaggagtggccatggggaagcttagaatctactgaagctcctagcaagtgtagtttctagaaatttaccttttagtcatattgaacctgtgagatttttgtctccaggttttctaaatgttttatcctatttaatctttaagtgaaataacctaactttctgttttctctggagcagtgaaaatgtcaggaaaacgactgacagactccacaaaagctgtcctaacatgtgggtgttgtctggttcatgtactgagttatgataaaaaggaaagaatttattttatccctgtttcctgagttctctcatgctgctttcttcaacgagcagcctagaaacccataggcataactgagtcaccagaaactaattcatatgcagcacttaattgaatttctccggtggatctcacatgtggcactcttccgaacacttttagaaaagtggcattgcttgtgcaacatcggggggagctttttctaacatcctttgcttctttagggtagatatttctgcaatctcccaagaagtcattaattctaaagcctgccaatatttagagcagtatctaaaccattgcccagaaacacgattggctgccgtatttttaagtagccccttggaaagaaatgaaagttttcttaagaacctattcgccgggcatggtgtcttactcttataatcccagcactttgggaggctgaggcgggcagatcacgaggtcaggagatcaagaccattctggctaacacagtgaaaccccgtctctactaaaaatacaaaaaattagccaggcatggtggcatgtgcctgtagtcccagctactcaggaggctgaggcaggagaatcgcttgaacccgggaggcagaggttgcagtgagccgagattgcaccactgcactccagcctgggtgacagagcgagactccgtctcaaaaaaaaaaaaaaaaaaaaaaggaacctattcagcctttatctagcagctttccctgctgtctaagagaacttctgctactataattttacatctctcctctaggcagtactattattttaggtacagaacatcaccatcactatagtaatcatttattattgaaaagcaatcaaaagtattcccaaagttttatttcttcagaccacacaatcattattttatcattacttttgcatggtaaggccctgatcattttcatttttagatgacaaatcagcaacctgagttatatataaaaatatgaatttgaaggttttagggtatgcctaatttaatgcctgatttttgtgtgtgttctgccaaacacacatttgtgctacccatcaattccctgaaacagctaagtttcctggcctctgtgattgtgcttatttcttgaaagtaaaacctcttgattaaattctatcccagtgagactttgctcaggagtatgtttacatcactcttcttcagtattacttgatcccctttcaaataagcacagagcttcagcctgtcatttattatgacattctgattactttgtttacacaacaatctgaatgttttgttcccggccttacagttagagtttttgttcttggtttcccacttgaatttttatttgtttatttatttatttttgttctagtatagtctgaagggagaattttttttttgttgtccctaagatgacagtgcaggctctgagatgattttgattggagaaataatcttcccaagtcttgtcttacctcatttacccaaagtggattcaggttggaggtctttctcaggaaaaggcttggctgacttctagccaaacacagatacctcattcctggtggacaatctctgttcccgatcaagcttgatgcccacctcacagaacacctggacaagggtatgtgcctttctggaagcttcctttatataggagcccctccttctaccaagagcctggtcctgttttcgctgacctggtgatgacctgaacaaggcaggctcatcttgcaaggtgctagagaatgtccctagccaaagtgacccaaggtattgggcagcacagaggctgtggctttgttttaatggaataagaatggaccctattataatctaaactatgacgaatcatcatccaaaacagtacccttaccttctgtgaatgacacacctggagttcttgactatcatctctgtgtggtccccagaaactccaaccatttccactttctcagggagccgcctccagaccacttgacctcaacccactggggcatgtgctagagtaggttgagtattggaccaccaaaccgaaatgcatgcttatccttgcttttctgcatgactgggataaagtcaggcttaaaggagccgtacccaaggagacagtgatcaaattttatttcagttcacattgttatgctctttttattgttgttagttccttttgttcccttttcttttctcttggaggaattcttattcattttctagctctccattcttgagtaatttatctatttcttgtttcttatctagctttcagatcctccccgtcttgtagctaattaaagccaggtggtcatgagctgacaatatatatgaactcttgttccactttcaaagtctgctttcaactgggtctcaggataatagttggttgtttttgcaaatttgagttgggataaaaactgaaggaggacagatatttgctgtttttttcaagaccagtttgtcttgctaatttatctcctcatgcttttagtttagtcttttttttttccaagtggcacattgcacaattacttcaaaccctgaacctctggatttcccttggtaattttcttatcaatccacaggagaatggcaagagctgtctggtctgtggatccacaccattgggatcacatgggtttttaatttttttaagtgccccaggttctacctccaatgagtctaatatagtaggttcagggaagggcagggaatctgcatttttaaagagctgggaagtctgtcctttatcctagaggaagactgtaggcctttctagactcttggtctctcctgcactttggcacatgaagccactgcactgtgcaaggctgtcagcaggactcactcgtcagtacatacacaaggagcatatgagctgggattgcatgtctacctgcccctatgcaatccatcctcaagctttgcgaactctatctcctcatcatctccaagtcattgttttctatccgtttctatcacctccatcctaggccatgccaccatcctttctcacccagaataaccactttgcaatgtttcctctacacgccagccagagttcccttttagactcacaaatcagaccataccactgctgtcttagtccatttatgttgctataaaggaatacttgaggctgggtaatttataaagaaaaaagtttacttggatcacagttctgcagactacacaagaagcatgacaccagcatttgcatctgctgagggcctcaagctacttccactcatggtggaaggggaaggggagctggtatgtgcagagatcacatggagagaggaggcaagggagaagggaaggtgccaggctctttttaacaactagatgttgggagaactcttgctggaactaacagagcgagaacacactcattacctcatggatggcaccaagacattctcgagggatccattcccatgacccagtcacctcccattaggccccgcctcccacatgggggatcagatttcaacatgaggtttggaggtcaaatatctaaactacaacaactgcccttgcttaaacccctcctaacttctcatcttgcttagagtaaaacccaagcccctcacttggttgtttcaatcttgacttaatctggtgcctgctttcctctgtttccttcagtgtatccacggctgacttcttcctgtgttcagagctcagcttcaacgtcatcaacaccaagagaccttctctgaccaccaatatagagaaaccactcactcagccactcgctgtcacatcacccttttaattcttggcaaagttcttataaactcagctcttgttcttgtttttgtttgtttaaggctcatttcctccgctggagtataaattccacaaaagcagagaccctgtcaactgatacactacagtatcccggcacgtaaaacagcagagactcagtaaatatttgcaaaatgtatgaatttaagttgagtgtggaggtatgaacagaacgttaaccaggcaaggtggcagtattggggaattgttccttttgcagggaaataaatattccaatgcccagaggcaggaggttacttagtgcagttaagaaactaaaataatgcacccaaagaaaagggagacagaaagctgaagtagggaggggccttacaggctactctaaggatattctcgaagagcaacaaagagtcctagaagggttctaagcagtggagcaacaatagatttcctgataaaaatgctcaagagaggctggtatcaaagtgatgtcatacatattgtagcaggctaaatagtagtcactgaaaggtttcaatgtgtaaatgtgaccttatttggaaaaaggtctctacaggtttaattaagttaagggtcttgagatgaggggattatcttgggttattctggtgggaaccaaaatcctatcacaaatgtccacctaagaaagaggtcaaggaaataacacagacacacagagaagtccatgtaaagatggaggcagagatttgagtaatgtggccacaagctaaggaatgcctggagtcaccagaaactataagcgacaaggaacggattccattctagagcttttggagagactccagacctgccaacaccttgatttcagacttctggcctctagaattgtgagcaaatatattttggtcattttaagccatgaagtttgttgtaatttgttatggcaactaaagcatacactttggaaaaaagataaagagaaatcaaaattcagatgtgcaccattatgcacatgagtccatccaatgagtgtaggcccagcgttagcatgagattggagatgttcacctgctgtttccacagtcaaccttctttcccttgtgaactgttatcatgattctagaagataaaggtgggcctatttcacacgacatgcccctcaactgaagttagctgctttgttttatggtcagctcaagaaatggtgtctatccaagtgccagaggacagactggcagggagacagggtggcactctccaaggtgtcacaaggaataaatgtggccacaaggaactggatgtatgagtaacagaaagagaaatgtaccgagccatagtgccaagtgctgcagtcagctaagggagagccatgtgtgctgtgcaaatcagtgaagaccaaccaaatgagaacaaactaaggctatttattcagagcttgctatagcaaggagtcagccaacatcatctgcattttggcagggactcaaaggcaggcagaggagtaggagtgctttagagaagaaaaaaagggaaggctttccctgcaccctgatggaagcagttggtatggggaagatgtaggcaagctaaccagaagtggggcactctacgggattggttagaggcgcacatttcaccctttctagttggtgctaagttggaagtgcaaacaaaaattagggatgctgtcacttattaagtcctggctaatttaaggtcaattgttacaagggttattgtttggcttcctggaatgttactagagctagaccattgtaatttgttattgatttttctgcaagtctgacttagagtgtgctaccttctggtaggctgtcatagaaagggggtttttccccggcatgttgctgcaggtcgtgagccagagttgtgttttgttatatggtctggccattgttcatctgtatattcagtctctcaaggtgatcagacatcagtaaagactaagagggcattgtatttcggctgaacaatgtggaacatatgacatgtgggagaacaggcccttggcatctttgatttattcaaatctctcactgaagacacatgggttttttatgagaagaagctcagagccagccaaagtggagcttctcaattttaataactgctttactttcaaaaaggtcaagatttggtgaagcttcactggccaatgaaaaggcagcagaccctgagcaaagcccagctgggaacccatggcagagaaaaaacagatgccttctgggacacgttttaatgccaatgaggttgggttcttatggggaaagcaaatgtaccaactacacttgcatttaggattcagaaagataagaccccaactgcaaatcagcaaaaggggtacatgtttgtgtttttgaggcaatactgccaggcttaatgactaaggttgaaaatccccacatctcaataggtaagaaaagcataatctcttgcatcgtacttgcattcaatccaaaatagtgaggaacaccattttggagttgtttccaaagggtcattgtaggggtcaagtggtacctggaagggaaagaaccttacctagagggcagcctgatcacgggccatgcttgtggcccttctgcaacactcgggttcgcacacagcaatgtggaagtctctttctctaacctctgccccatgacattctttatcctccagactctcagctaagaaaccaagaccccatgttcccatattctcaggatggttaagcaatgggtactaatccaattttaacagactattggaagaccttcagcattgtcagttgcatcaactacactacagtgtaaagcccgaaactcagtttatgtctgccagacctgcagaaagagtatacgaatgcattgtttagagactcaagcaggtggttggtgacggtttcattaacagcgtggaggaagaatgtaagagttaattgagggcccctctgggaaacattgcctaatgaagacattggcagtggttctctaccaggggtaatatgccctcagaggacatttgggaatgtgtggggacgtttttggtcacataactagggaagctactggcatctagtggcactggcatctagtgggtgaggccaaggacaccactagcaactggcacaaaaaagtgcaaatgacatgtgggaaaaaggaaagatcagtattcatttcaggaaattaagttctggtagaacaaggaacagatcagcttttcatgcccggtgtctgcaaaccttcctctttttctgctttcccccggggttgaaactcagacaaggcaacataaaccaactgggacccttgtggatgagaacactcaggtttgacagagataagatagtaggaacttgggttaccaagcaatctcccggagctaaaccgcctatccctcaggacacctgcagacctctgcactgttatgtaggaaaagatgaacttttctcttatgtgactgttagggaaaaggaaagggtttggaaaggagaatcattcatactatcagaacagtagatctgagctgtgactcttgagatgttaatacagaaaatcccagtgccataaagccttctgcagatgttacataaggtttctgctcccagcagtgcctctagagccccgtgcaggtggaggaacacgtgggcgccatctggagcactgagctgggtgttctggaagttgtggtggaccagtggaagtgctggtttaaacatacctccctgtatttttagaaggtacttttaaaatcttagtttccgggactttactctccagttaagttactccagctgatgcctttgtctccaattcagtctgtcccatgccttctttttcacttttgtgttttatatattttttaatttttggcccggtgtggtggccatgcctataatcccagcactttgggaggccaaggtgggcagatcacctaaggtcaggagttcgagcccagcctggccaacatggtgaaaccccatctctactaataatacaaaaatcagctgggcatggcagtgtgtgcctgtaatcccagaggctcaggaggctgaggcaggagaatcacctgaacctgggaggcagaggttgcagtgagccaagattgtgccactgtactctggcctgggcgacagaacaagactatctcaaaaaaaaaaatgtaatttttatggttacatagtaagtgtatgtatttatggagtacatgagatattttgatacaggcatataatgcataataatcacatcagggtaaatggggtatccatcacctcaaacatttattccaattatactctattagttatttttaagtatacaattaaattattcttcattgtagtcaccctgttgtgctatcaaatactagatcttattcattttttctaattattttttgtacccattaaccatccccatttcccccccactgcaatgctttgtttttaaaagctgtattttagagtgttttgatcttgattgcttttattccagacgtgctgcgtgtggagcttggggaagcagcagttatttcaaaccccacaggcagtaggatgggagtcttaccatggtgtcagggttcactcagaaaacgggtggagtagaagaaaccagatgggcctcagttcttactagatgcaggcccatcctttcctcaagaagcctacatgtggattttcctgtaatgctgctgcgaagtatgaaaatcataacatttctatagaaagtaaattttagttgtccattataccaggatggctttgttcagctcaaccaggcagacaagctggagactgaggatggagactgagattcaaaaccatgaggcaggaggtggtgaatctcccaggcactgggggtgctcagaaggaagctggaccaccacttagttggaatggagacaggaggagagaatattcctgagttaaggagagagttgactcattaaccattgacagccttgatattctaggagggcgcctcccaaggggagggaagtgaacatgtaggggcaacttactggagaattggagaatcagaattgcaagttctttttgtcattgactttgtgccatttttataaaatgcctctggaactgaatgtgcttcctcactctcttttgcatatagcaacagagaggaatattattccttttacaggctttgtacctttgccaaattaagaggaagcttgcctttgtaatcagggtatggtagaaagcacaaagcatctactgcttatgatggtttcttctagatgaacttgtccatttcctgaacaattcagaaaactgaatttagagttgagatatattaagaggcctctgcctaagagtgcttttatgctggttggtttcaaaaaagagactagaaaagtaaaaccatttcttgttcaaagagtattccctagccaacatgcagcatgtcaccaaggctgtctagacactcaagggacttcacctatgccttgttcaagattctccagaaggtctaagtaggcccctttgaatgcatgatcactatgtgagctcaggtgagccactggtgtctttggtggaattctgcaaccgtttctattcttcagcaccttctataacacttcagcctacctaccaactgtttctgagtggggggaggatctttctaagtggaggttctcctgccaccgggaatgtggccaaagaatatgttccacctcctccttatacatcaccatctgggctgtctctctaaatctgtccatcaaagaatgcccatttcaggagttcatgtcctgggtgaaggtgagaaacatttaacttctataaatccccaaaacatttgtatagatcgtgtggggaatgatacttttcacctcagatgaatgtagggactaaatagagcagagatttaattcaatgttgcttacttgcttgcctgctgtgggaggttcagtcatcagagaaccagttcatgagtttggtctgatttcctgtcctttgggtaggctgcaatctttaggagcaagagaaattaccatctgttagcttccttcaagtggcttacctacagtccttcggtgtcatctttcttaaggagagtctgggtcatccagtttctccaccaccaaaggaaatacagtcctcttagagaattggtcagtgaaatataggggtgccaagaaacatcagagtaaagaagtgatggcccccaaaggcaaatgcccccatgtgagagggggaatggaaggcactgctttcttccttgcctgaggctatgaaaatgtcctttgtgtcaacaaaaaggttttctacattactggccatttaggtcatattattcacaatgtttcaaaattgtggttatcagctgatgtagattttggcattctctctgaagccatgcagcatttgttcctcactgcattttcaccattataaaatacaattcctatttaaattaattaaaacatggaaaatctaaactttatttggaaagatggttggagtttttgtttttgttttttataatttacggcttggcactgcaatattcttcagctggatttatgttgacccattttagaaaacgtagttactataaatctgttgttgttgtttctgtttttgttattcaacccaagcctttggaattattctaatccacaatatgactcatgaagtatcactcttatccttaaggcaagtggtccaagagttgaaatatttgtaattatctttcagactccatgatcctccaagctattacttcattataactccatttctgaaagacagtttgtttctctttttttctgatatactaaacatttgatagacaggtagctttcatatcttgaatttcttatttaatgttgatatgagaacagttgcttgcagttcttcccctgatgcaccatcacccatttgtctgcccctgaccatggacaccgatagacatttcccaggctttcgtcaccatggaacagcttgcttaggccacagcatcagatactgggggtagtgaggaagccaccaacccaagagagttgggttctgatgcaagtcatttcatctctctgagactcagttttcttgggtgtacaatgagagtttgggttagttcagtgaataccaagagttcacacaagtagtaacaggatcagcagcaatttgggccgatatttatcgagcagctacttcatgctttttaatatggcagggactagttagtatccaatggagtatgggagtggggagacggactaataaatgaataattctgactgattaataatatggtgagaactcagttcaggagaagcaagggaagctttggaagcatgataagaggccacaagtttttccaatatttcaaaaacttaatgaaatacctacatttcttctgataagaagagctgcctcacagaaataccaagtttctttttggtacttggaaaagtgtcaactgagtgtggtaagattggttctattatggtgtcctggattgctggttggtagttatagccacagctagcaactctggcacctgtgccaaacagcatgccatgaaccctaaaaccaacttttaaattcacattgtggatcacagatggatattatgaacaatgtgtaccatctgttagctttctatcttaactattcattcttgctaactagatgctgagcttttaaaatcattgttttaaatttatgtgacctctgaatgttcataacctgggacaaaaagttctggtcatctgccctcatgatcatcttgatttttatttaaaatgagaaaattgaatgttacttaacaacaatgtgttgcataaactaacatttttcaaacatgaggtccatgaaataaaaattagcaaaaagaggcctcactggtgaaaagactctatgcaccattaccagatggtaaaggttttgagttccaaaactttgtattgttctccatcatgcctgcagctctcgatgcttggcacgtagtggccacgtgataaaaatgtacgaggaagcatgccaatgggccggcgacattgtggcattccagtttggttgctagtgtacttccaaaaggctaggcagaggccaaagctaggacaaactccaggatgtgttgtcagttgcatggtcagagccatgagctaatctgagatctccttggcacgttccaaagctctgttttgcgaatcaaaatctccacggacaccttgggcgttattgtcccatgggaacggtcctggttttcctattgtattttctgacgttgttaatgttgtttcttggttactcctatcttttaatttttgtcaatattcctgtatgtatagatttttttcttttttttaaaaaacagaaatatcttgcagggtcactgggcaggccagaacagtgacagtggcccaagtaactgttggggaagactgggcaggctctgtaatgccttgattcatttctctttgctttgggctatgaaaacaagtggaggaagaagaaatatcacaaggcagaatttgcttcctcttcttttttaatattccctcttcttttcccccatttcaattcatgagactctctaggacacactctcctccatgacttatctcctgtttgtagtcttataacatctgtatttcatataaactcacatcttttcttactaaacaatttaaactactttgttagtttagatgttagaaaaaaataggaaacgatgtttatataaagcaattcagaatatataagagagagaaacatgttttgaatttagaaaattagaaattgcgtggatagggaagaaaaattttgaagtcaggcatcagaatgagatctggaatgattatgagttctttgttactaaagcgtaaaatgggatttaaaatatataatggaaaagttaaagtagtttaatttaaaactactatactaaaaaggttcaccacatttgaaaagctaacatatttcaacaactacctacaatgataaatatttataacatgatagactaagtgttaaactttcatatagaatgcactcttacaaaccaataagagaaagtaggacataaataagtaattgcaaaagaagaaatccaaatggctaatatgcgtgtgggaaaaatgtacaactttactggcaatcaaaccaattcagatttcaagaaaggaaatccaatatttgtttagaaattggcaaagattttttgaaaatgtaatacctaacctcagtgagggacccagcaaatgaccactcattgtctataaaagtacaatttgaggccgggcatggtggctcacacctgtaatcccagcactttgggaggctgaggtgggtggatcatttgaggtcaggagtttgaaaccagcctggccaacatgatgaaaccccacctctactaaaaatacaaaaattagccaggcatggtggtgggcaccctgtagtcccagctacttgggaggctgaggcaggagaatctcttgaactcgggaggtggaggttgcagtgacccgagatcacgccactgcactccagcctgggcaacaagagcgagactctgtcttgaggggaaaaaaaaaagtacaatttgttggactttctggagggcatcattcagagcttttaagaagttctctttgaactcaccaaatccactttgttcagcaaattttttaattttaatttttttatttttatttatttatgtttttgggatcttggctcactgcagcctctgccttccagattcaagtgattctcctgccttagcctcccgagtagctgggattactggcgcccaccaccatacccggctaatttttgtatttttagtagaggcagggtttcaccatgttggcccggcttgtctctaaaattttttatttaagttggaaaatataaagaagaaattagaatataaggagtgacctgactttctatcaataggggaatgattgaataagttgtgatataaacatattacaaaatatgatgcagggtttagaaaaacagttttgattgctatgggttgaccaagaaagatgattataatatataagtatggaaaatgtataaaatatgtcgctatcttgccatttttataaaaagcaaacaaaaacctggctatgtatatatgtgtttatataagcttagaaaagctatggtaaggtccttacactattaaaaatgttagtgatattgaaggggaaagaacaatatcacaaaggtagtgatattgaaggggaaagaacaaatagctattgctattttttaaattttgaatttataattttttaaaaagaaaagggtcggtaaatatttttgagcacccacagtgtgcccttggtttctggctactagaaactaaatgtcaagtgccagggactaaatctgtcctaagggagtgataggataactgcacactcatttacaaaggtgtcattgagtaattatttataacagtgaaatactgaaagcaagttagatattcaatagttggaattcggttaagtaaattatggtattccatgcagtcagatgctcaacagccattaaataacagagtgaaaatgctcacaagatactgtattgtgaaaagggttggtaacagatcaacacatatgaacaaatcctaatgctgaaatatataaatgcatagacaaaaattctagaagtttctatacccccctccaaaaataaagtatcatttgatcatgggttattgggggtgttttaaaatatgccttatatttttccatctacagtgaacattgattatccttacaagcatatatttttttgttaattattagaagcagtttcttaagaacaagatatgtgggtttgtacagcatcataattggtcaagggagctcactaagagagaaatagaaaactctctgccatttaagatgttcagcattgaatataatggacatgaacactgagaatttaaatctaatgaaagtgaagttgtttcttatcctcaagccacaaaccatttcacagacacagtataaaatctgtggcagcttcatgtggtggcacaggctggcaggatgcccttgcagcagggaaataccacctcttcaccagttttacctcttccaagcaaatgctgtcatctcccacatatcataaagacccacaactatctccgtgaggacccatggcaataaacttggtcctgttgtggtgggcggaatcttccaccaccacatttcttggtttatgaggttgacctttcttctaacattttccttggaagcaacaacagtttatcccaagagacccacatatacagataactcaaggagtgagtagagagaaacccaacaaaacacctctttattagcctatatcactcccaatctagccaaaatattattgtaaggagtgtaacctagggggattgaagtattatttacttccatgtctaagaagcccaccctgtccttcctctttgttttcttggtttcattgacatagacaagaacccagctggtgggaagtagatgtgactgaggatggtcatatatttctacttccaggtttattgtgcattttgagttggtgtgtgtgtgccattaccccataatgatgtgtggtttttgttctttccccagaatgtcgagtggtaaagtccacttcttacaccaaaatagcttcatcatcccgcaggagcaccaccaagagcccaggaccgtccaggcgtagcaagtcccctgcctccaccagctcaggtaaagcagcagaggggattttgaagaaattgccttgttcctgacacaggatgagcagagggtgtgtgaagcctagagtgtgaggtttttaagcgagtgtaggttccggtttataattttagaacatcttagagcggttgaacagatttgctggagtctagcatattggctgcaagaaaaagcattgagcttcaaaaaatgtacttagtgaggactcaggaaacccagatttgcccacaaatagaagaacgttatcatcttgtatcctttctaccaccaaagttaatctttcagattctggaagtctctgttaaagcatttattctacctgagactggcctatgaagagtttcccatttgtattcgctgaacctttattaaacacacttttggctctggcctcagtttcctttcatggctctggagctaaaggtagtgagattgagagggtggagcagggattgctgcagtgaccttggcctgagcctgtctctcagtggattctagtgctggtgttggagaggctgtgtatgcacaagatgagcacctcaaccctaccttctcctttttggtcttaaaactgacatgaagtcagttagaaagtgtcttctttgtttgtctcaggtgaagggtctctattgttattaaagggaattatttattaaatgacacaaattgtattgggaattattaaacgatgcaaatgtcaaagtgattgttacctgatttcatgaagacaagaagctcttataaataagaataaagacctctggggcctacttgggggccttcttttactcaacagcatgggctagggggagtgtgaaaagagctctcggctgaggctgcctaagaaggaactctcaatagggtggatcattataggtcaggggccagctagaccacccagccctccttgattctctaagagtctccttccccttggagttttaccaattactgctattctctagacagatctccaaagaccaccttcccctctgactctcaacctagggtggcatcaatgggctgccaatgcctccttcccacagcatggcctgcatcatagccagtcaggaaatacgtttcagagcatcgctggcacttgagatgcatcttgtttgcctctgtagtttaaaggtgagctgagaactcctcccttagtatgacactgctcatgtagataggatagagccctaaaatgaggcattgctaaaggatgagacagtagactcaaagcttagagctcatgagagtcacttgggaacttggcaaagtttgtcatcctgaacccccacaccctgagattctgactaaggacctaaacctgtgtttcagcaagtactccaggtgattaggatcgggtagtctgtggtccacattttgagaaacagtaggtgagggcagtggttctcaaactagcagcatcaccatcacctgagcacttgttagaactacaaagccctgagctccctctccagaaccactgaatcagaaactctggagctagagcccagcaaattggaatttcccaagccctccagctgattccaatgcacactttgagaagcagggggttttggaaaacagaaaggaagtaaatgcagaaaacatttgactctggataatctggagggaaagatatgacttgttcatcttcatttactggcatgacagagatgacttcctttctacctccctgtttgcctccaagtagcaatgtccatcagtgtccttgcaatccaagagcagaccttttagataccttgatgtgtagaccaaaagagcaatgaacaaaggagagtaccagatgccaacttccttttctccctccttgcaatgacctggcctcagagagtcagtcacctgggagaaaagagaatttctttctgaagatgatcccttccccaggatgtcagggaaagtctctcccttcaagggagataccacccacacacagagaagaggacctccacagaatgacagagtgatcctggaattgctgcatggaaaactcccctggaagaactgagcttgtccagctgacaggttaatattgagctctgtggaggatgttcagtcttaactaaaaaacatttctcactttctctgattaaatctgggctataggcccgggcctggtggctcatacctgtaatcccagaactttgggaggttgatgggggtggatcacttgaggtcaggagtttgagaccagcctggccaatgtagtgaaaccccatctctactaaaaatacaaaaattagccaggcatggtggtgggtgcctgtaatcctagctactcaggaggctgaggcaggagaatcgcttgaaccttgaggggcagaggttgcagtgagcagaaatcacgccactgcactccagcctggatgacagagcaagacactgtctcaaaacaaataataaagaaataaataaatctgggctatagggtgaactcccatggagcaataaaggagaacaaagtcataagcctagccagcttattgcccctaaaattttggctacttaatgcaatcacagaaggatgtgaaagagaatgagagcctatattaatgaaaccgtatcaattagtatattaatgaattaatgaatagtatcaatactattaaaaatcatcaatattaaaaaacaaaattagttctccatccaaaccaactttgacttaaattttacttaacctttcctatcttcttcctctcagtatataagatgaataaaaaaacaagtgtggggcagatgcatctaataatgggtaattagccaaattcttatgtgttttatattacagatattccaagaaaatcaatatgcactgcagcttttaactttttattgtcattgtttttagcagttttgttgttaagagctgtaggttgggccaggtgcggtggctcacgcctgtaatcccagcactttgggaggctgaggcaggcggatcatgaggtcaggagatcgagaccatcctggctaacacagtgaaacctgtctctactaaaaatacaaaaaattagccgggcgtggtggcaggcgcctgtagtcccagctactcgggaggctgaggcaggagaatggcgtgaacccgggaggtggagcttgcagtgagcggagatggtgccactgcactccagcctgggcaacagagcaagactccatctcaaaaaaaaaaaaaaaaaagagctgtaggttgttagatactctagatactccagggtttagggtctttctttttctctttctttctttctttctttctttctttctttctttctttctttctttctttctttttctttctttctctctttctctctctctctccctctctctttctttctttctttctttcttctccctttaagtcaataaagatggggaatggatcagattcttgcgtacatgttaaagaatggactgatgagtctaatcttaaaaatataattatgcatataggcaataatttcattttataattaactggtaatgtaatcactattcagcattgtaagaatttatattcatttctgaaaagtaattttggaaactcaagaagataggcgaatatattaaatgtacttgtatgtcactgccaacatttgtaattattccttttagaagtttaaaatgggtaggacacattgcctcaaaatcaacaggttgctccaaacaagcatttccacattctattttttccttgaagtccttttcaactctagttgaaacctggttgaattgaccagcactaacttggaatttgtgataggtaagtcataccaagtagtatcattttcataaagaaagtagagtccaaattcattctaaaattaatatgttcttgaaaaattagcactttaacttctaggtcaaagttaattatataacactgatcatattttgtttaatgtgagctttttgtgtatataaaattttcaacttgctgcattttgacctggaagagataacatgcaatcattttctgattatataagagattactatatgcactgactatctcttgattctgacttgctaccaaaagtgacttgttaccactttcctttggatggtaccaatttagagagtttcacagggcagtcaactcccagtcacaaatgtgtggattgtgccagtgacctcaggaccacctcctttccctggaaccgggcccagaggttaaggaattcggcagtgttgccagttctcctagaggcaagtgtagctgctggatgtcagggaaacccctctctcagggcccctccactgctctggcccaggtctcctgtccctactcaactatagctcttggaactagtggaaaggcacgttgaattgtctctatatggattacatcacattttcttaaaatagcctgtttagtgtttttcattaatcatatggactcaaacatgaattttacttaaatactccataaacattggtattgccccaaacccaactaccacctgattttttaatgttaaagcatctttagactgggtgtggtggctcatgcctgtaatcccagcactttgggaggccaaggcaggctggtgaaacctggtctctaaaaaaaaaaaaaaaaatacaaaaattagcctggaatgatggttgctttgtttcctgtggtcccagctatacaggatggcttgacactgggaggcagaggttgcagtgagtcgagattgcacaactgcactccagcctggatgactgagtgagaccctgtctcaaaaaaaaaaaaaaaagagtctttgttttcccccaaaacattaacccaaagtttataatgatttctacttcagtgtttaaatttctacttccagtattcagtttcctatattatacagaaattggagcgtattataaagttaagatctgcacaattttcgggctatgctgctatgaatataacatggttaacttatatttacctgaaacattatagtttacatacggcttttatttcttcaatcttttttgatcctcctattaatttcctaacagcaggcaagtaaggcaagttattattatctctgtttgtagaaataaggacacagaggcagggctgggataactgctttgctctgagtcccagagttcagaatggcaactcggggctggcaccggggacttctggtactctagacacacaaggctggcagtccttgatacctatttcttcacctccacttactagagttttgatctccaggaaacaattaatctagtgcctaatttgagattgcaattcacagcatcacagcaccttgcaacataagcctaagtattagtcccttggcaccagcgttccaggaggtgaatgatttaccccaacttcctgatgtatagtattgctggacagaaacctcccttgtaagtcagcattagaacaagaatgggaatcctctgtaagtcttccctttgtcccttacccatttctcttcatagcactaaaagaggttcaaagtgatttattaatgttaggtgttcatttacactttcagaactatcagttacagaccaactagtgtcaggcatttgctaggcactaatgatgcagagatgaaagaaagcccctattctcaagaagcataggagtcaaggcctcacagataacatgattcacatacctgttgaattatgattagtctccataacagaaaaggctgaaagaaggcaaacagagctagcaaagagaaaccagaagccttaataacacatgaaaagagtaaagagcctccagacaaattgcgtgctgagacactggaggatgaatcactaagaaattggaaaatgacttctagctgcttcttaaagaaatgagaatctgtaagagcatcataaggaataaggagtttcatatgggtttgattcttcatacatgtgtatatatttggaacacagatctagtaaaatgtataagttaaaagtaaaattcattaattttatttttgagacagggtctcactctgtcacccaagttggagtgcagtggcaaaagtaaaattcttttaagcaattttttttatctacacagggaaattataataaaataactctaaaaataggaataaaatatgcatcactttggttttaataaagactgataaaatttcagttggctttatattgttttcttaatcttacaagaaaactgtgtttatcttgaagtttcacagctgcagtcctccttaaaacttacaaacttcaaaattttgatcttttcttggatttgggaaagctctggggccaggcatggtggcttatacctttaatcccaacactttgggaggcctaggcaggaggactggttgagctcaggagtttgagaccaacctaggcaacataccaagacctgtgtctacaagaaatttaaaaactagctgggtgtaatggtgcacacctgtggtcccagctacttgggaggctgaggtgacatgaagtcttgagcctaggagtttgaggctaaagtcagccatgatcacaccactgcactccagcttggatgccagagtgagaccccattccaaaaaaaaaaaaaaaagagagaagaaaaatggagtttttttgtttgttttacagtttttatttccatttagatagccaacttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccagatagccaactttttatcatagaatgataccctgtatttagaatctctgtctgtggaacccttagcagacataactgaggcccaatgagtgcctcacacctttcaattccaatatgagataatgtactttcctgcccttcagaagcttatagagtagaaacattcatggcaacaaccattcattcattcagtatgcattgagaatctatagtggaccggcaacgttgggtgctggagatgcaagggcaaacatttgaaagaaggaaaacccaaatggctcagttaatgagcatctaccatgacgaagcaccattctgaacacccagccttaaaacttacttctatgttactccagaaatcctgaagtctttttattcatgctatttaaattttacttttttacagttctataaaaatattttatgcaacatatgcagataagaatcaaagctgaggaagtgaagagaattctaatcagctcactactagtccagtttgtcaaattcttttgatttatatcaaacaccttcaaaggcagattgccagctattaattttgagttcagtcttttcctttagtgtagagaattcagccttatacagtctatggagaatcttttttgctttggagctccaaggaaattgttgagaacaaaatgcatcaagaaaatcgagaggttggtgattcatcccttgtgtctttggaatttctggctgcatgtaaggctcatccctccttccatttctcctttctctgcacccaccaattcttcctagtgttcaccccagcagaacctccaaagatactcttcaaagcctttaaccattatcttgacttactgtctacttgggggcagcaacctacatcaactgcttgtataaatttctcacagttaatgccccaggttaattaaatatttcctgagtatctactgtgttccagacatgcattaggtcccaagggtgcaaagatgattaaaccacagtccttgccttcaagttgcttatattatagtagggagagaaacatatacagccatgtgttgcttgatgatggggatgtgttccaagaaatgtgttattaggcaattttgccattgtgtgaacatcctagagtgtacatacacaaacctagatggtatagcctgctacacacatggctatgtggtatggcctattgctcctaggctataaacctatacagtatgttattgtactgaatatcctagcaattgtaagcaatgataagcatttgcacatctcaacaggtgtaaacatagaaaaggtgcagtgaaaatacagaattgtaatcttgtgggaccaccatcggatatatggtcccttgttgaccaaaacattgttttgtggtacttgactgtatgcatgtaactataatagtgtaataagtgctgtgatgacctagaggaaacaggttagatctcattaatagggtcagaaagctcttccaagagaaaaggatttataaatttggatgtaaaaaagggccaggaggacattccctcccagtgtgagctaaggcacaaagacattaaactatatggcatagttagggaatagttgcttgttcaataaaaatgcaggatagaattctaagaaagagttggaaagatggtggtagccccgttggttgtggtcaaattgcacagggtcgtggaagtatgtttgtgctgtagattgtaggtattatgaagtgaaaggggatttttcacagtgccatgaaagatcgcagttgagttttggaaacagtggcatggcggtggaaaaaattgctacacatgaaaggccaagggccaggaaggctctatgaggccattgtagtcatcctggaatgaaattgtcaagacagaaccgaaagagctgggggagacctcaaagggaaatgaaaccagaaatttaactggatgtgaggctagaagaagagagagggatcagagataggaagcaggtttgttggatgaggagaggtaaggaatgagtttcgttttagacatgtggagtgtgaggcgatttggaaatgtctgtaagcaattggaaataaataactgttctaagtcaggagatctgcgctaacaatatatatttgggagaccctggtatattgtagtgatttgaataatagaaacataaggtacctccccgctgcctcaacaagagatttgtaaagatgaaaatggaaccatgcatgggggagggaagtctgcatttcttttttttttttttttttttttttgagacggagtctcgctctgtcacccaggctggagtgcggtgggcgcaatctccgctcactgctagctccgcctcctgggttcatgccattctcccgcctcagccttcgagtagctgggactacaggtgcccgccaccacgcctggctaattttttgtattttttttttttagtagagacggggtttcactatgttatccagggtggtctcgatcttctgacctcgtgatctacctgcctcggcctcccaaagtgctgggatttcaggcgtgagccactgtgcctggccagaagtctgcatttctaagagcaatcagcagaagcagggaagaacagtaagagtacagggacagaagtcaaaggggcagaaagttttgagatgaaggacggggcagaaatgcttgatgttgagatgtcaggtagcatgagaactgaatggggatcgtaggattcagcagtgaggacaccactgtggcctatgaaggaatgggcaataccagatggcagggggacctggtctgggagtgtgatttttggtggtcaccgtgggtcctttcccaggctggctccaggctttactctagcgggagctgtcctgcagcgattggttggtagggatcaaccccaggaccctcatccaccctgacccttggtgcttgtggtccccaattcccctatcatgaccatagcctgttcttggatcccagctgatagggatcagatccaaaaatttcctaattttacatcacaggactctagttggtctttttttattgtttaattaaattttttttcttgtaccccaaatcatcaccaactcttttctctccaccctgtccacactcagtgggtcaccattctccctatggtgatgccattgctggctggtgtcctcccactttatcttacatctgccctgggcaccaatgtccaacctgctgccatcacctgttgtgtgccaaataaagtctgaacttgttctcaagtgaaggacatcttcctttccactcatgtcccccatttcttctctggacccatgctccatcctagaaacaaatttaaattgtccccagcttgggcttttccacctcatccctttattcctctcacttggcctagctagaatgtcttcctctgtctcttcagctgtctaaagcccactcacccaatttggccctgcagacctctgccactttcccggatcacctcgctgtccagggtcttccccagccctgcagtactgcagcagctgattcacagatgacacgttgcaccaccttgctcagttgtaaagtctgagagcaggggttctttgtgcattctacagtgactgtgagttcatggtaactactgggtaaatgttgaccacatgaatgaattgagaaacactaggagctgttgcctaaatttcctgaggtttggagcctttgtaagtatttatttaaaaaattaattcacagagctgtgtccctgtctccctctcctctgttcctggggcccctccttcccattattctcagtagatggtttctttgaattggacccattgtctcagttcaagaagaggaaacagacatggagaaaatcagagctccacctcacctatgaggtgagcacccaagaagctaaaattagggaaaaagtacgtcttcttccctctgttaggtagttgtctcttttctcttggtctcaactgattccctatgcaccccccaccccctgcattttttttccttctcaataatgtggcaagcaaggaacaaaagctgagaaagagattttagggaatgaacagcctacaccatgattagggagtaaaggagagtctaaggcaggaagccagatctccctggcagcgtgcctgaatcgccacccccaaacccaaggacacacacatatatgcaaacacattctctccccaaatcttgacaagtgcagcaccagaaataaatgagcctccttaagtgctaaaagaagacagggaaacagtaaggtggatttcacgtccaaaaagttgcacatcttttaattagatagtctcgcttggagatttctctaacttcagaaccaatttgagacacttactaacattcagctttcacttggtgtctgagacttttaggaacgcgactgcaaaaagaagtgttaacctacatatgcgtggaaagtcatttaaaagggcaatgaatttgtaaattaagccaagtatttccaaattctagattttttaaagtaactttgatgtttaatcataagcatcttggggacagggagcaataagaatctagcatgtactaagtgtacactacgtgtgctgataggttgatatctagggccctggactcgtggctccagttagtgaagaagagttggttcacctgtctgaaatgatgaaggaaaaggtggatctgcacacttcctgaggagtattattcaacaatgcgctgtgaccggtatatgctgttggatccctgacaggcttaggtgacagctgagtcgaaataaaggagggtcatgtaccgtcgggagggatagaagtcagctctgcagtgagatttcttccacagctctttggtggccagtgatgttaattggtcatcatggtatcagtgaatgatccattttgaagttgagcacttctcattcaagggtaacaagcacagcaaaggatgacatttcctattttttaaaataagaaaatgtacctatacagataaaagcaaaggagaccagaactgggtaaaggcagcggttctaatgagttctttactaattcagagtttagtggattcagattgaaataattaattgttcagccctgcttggctgtttaacaacaaccgtgttagtttaattgttcccattcaagataaagaattgtgtaataagggcctctgaaaaaataatgccattttaagttgaattttaataagttctattaaataagtcacaaagccttgttatggcacttagaaacttctggcattacagagtaaaaaccaagtgtactcagtacatgtgtcaaacttatttatgaaagaaaattatttatcccagcagtgattcaacaagaaggtgtgtaatgctttctggatgtcaagaaccattttaagaagttgctaatgctcttctgtatggccaagaggaagagtctgaacagagctctgaccctaagagtacatgctgttcccaatgttcagacaagttgtgttccaaaagcatttgattgtaaatgacttgtctggcacttgagtttcatttttctagagatggcgatgcaaatagaagcactgagcccagtggttttattaggttggtgcaaaagtaattgcagtttttgctttacttttaatggcaaaaaccacaattaccattgcaataaccttgcctaaaggaggcagatccgagtgtcccggtggtagagagagaagcctaggcatcctcagccctgcagatgctaggagggttctggacatgccctgaggtgccaggaccagccactcatgggaaaagtgcaaagttttttgagtaagacctaaatgaaatccagctttaactctgccatcttccagctgtttgtctttggacaagttacctgactaaacatgtttcttcatctaaaacagaaaacattgcaccaacttacatggcagaactgatgttacctaaggtgcttccgttcaaagtgtccaaactctctgtccttgcaaacatgctcccttttggccttaatcttctacagccaatcaattaccaggttctatagtttttacctcttacatttctctggaacgtttccgtttacctccaccccatgacactaccctagatcagccacgtcagcatctctaccataggacccttaaatgtgccccactctctcctaccttgacattctccttgcacccagtattgtttccctctaatccattcttgacagggcaagagctggagagcattttcaaatgcaagcctgatcctgtggcgcctgcttaaaatctttgtttttgtttttgtttttcttctcattgccctttggataaaaaccaaactccctaacatgaattttaaagcactactcactatgcggcccctgcctccatctcattcctgacattcctccgcctccaaccccacatacttgctttacttagttatttaagtctcttcagtgtaccacactggcctcctttctcgtatccagccctgaaacaggagatccctgggctgaggacacttttccttcattgtgccccccttgcttcaccaggctaacttctgtatccactgccctctgtgaagggcgtaggccaactctcactgttggttattaggattccaattgcaacacccaatacttctgttaatggctgttgtgatacctcggttcttgtcttcttagtttaaaagaatttaaacaaaagacacacagcaaaggagatgcggcagagagtcattcactgcaaaaggaagagagtattttgaaagttagatgcagaatagacagtataccctgagagagagagttcagggtgggctgcttgcaagggtgaggcagtgttgattattgctagagaaaccccctttgtgggagtcttacatgataattcataaggagttgggaagaggtgttgctagtaagcatgttctgggtggtcctctgggtgcacatgcactgtagctgtatgtttgtgttcatatatcacatgtctcattagcatcttaaatctccacccaggggtgtgttttttactataaatgagcaaagggtcagtttgatgacaattaaaatcaaaatgcacatgccctagagaagggacagtccctcctgaagatagctttgcttaaatgagctcatttatgatgtgaatgccaaggcttattgtgttggctgtgaggtcaccaccaatgctgcatcccgagaacatggtcacttccttgactaactatcctgcctcacttcccctctcaaaatactttattgtaattctagcttagttctctggtttacctgtaggttaaagggctggcacagtaaggcaaggtagtagtaagactgcaggttttgaactgcctaggttagattttaggctctgctccatatttgcttgtgaaatgactcatcatctgtaagcctcaatttcctcacctgtaaaatgggtggaaatgatgctgccaatcttatagagttattctgtgagttaaatgatgtaatatatatacatactgatgcacacagatgcatatatgttcatatataaaaggtctaagtgcattgactggtgcataaaaatgccttcaataaaaataaatgtctttcaaaaaatgccttaaaaatacacatacaatggatacttactaaatacttacaggcttttattgttttgttttgctttttaaagcaaggtattcctgagactgttttcttgtgagccctttgtctctttttcttcattttccattagctggataagatcagagtctcaaagtgaaaagtgttaacactgtgtttgcttccctatttgctcattttttccctccaatctatgtagcctttacgtatgacataaagatgtgcagtagaatgcgggtgggtaaagaaaatattatattcacaaaatgtgttctccagccaaccagtaaggcatccctttcttactagttataggctctgcttctgcccttgtctttaatccttttctatttctgagccccttccttagaggctactggctgaggaagtctaatgtgatgaggtccgagcgtgaagttcactcagcaaagacaggatggtggcatgcaagcaaattaaagcattctcagctttccagttcactctctctgcaaacaaacaaacaaaaattcatagctttttaggtttctatttttaggagttgccaaatacatttcaaaagcaaaactacaaattaatgcagcatggggtatgtgacattttttaaggtctttggaggagatgacaaaacaaggagcttcccactttccagggttgtaagtttttgggaaaacatcaagtgcgaaaaatcaataaacatcctaccttgccactgaattgtgtgagggtttcctgattacctggtagtcaccaggctttagaagagttattgtcatttcgattttcagatgagtcactggatctcttgcccccagggccacttcattatgattcagtgcaaagtactgacagcactggggcttccggaagggagtggtgtcgggatgggggttgctgttggcaagaggcttaattgacacctttgatgtagcctaagacagaacctgcacctcccactgctgcttgggagacgtcagctttacgcagaaaaggcatctgctgatgaatcctgcatctcattcagcctgctctgggagcagccttagccatccttaaactcatccaaccgattcccatttccgcgggtgcttggcttagtgctgagacgggattccgccgttggtattcaggtccaacactaagactgtgtccatgttagaactcatagaaggtaagtgaaatgcattgctgctctcccttgtggaaagcatttattttgcaccctcaagaatctatgtgtctcctggttaattctacttcactgactgtggggctgtaatgccatttttacaggtaaaatagaggtgacctgatacatctttataaaaccatgtctttaagtgtttcatctgttgttagagatgatgttacttagagaaaagaatggcttacttgagttctgtggctttagttcagtttagtgaaaatgtgcataaaactcttgagaactgggtagaattccagtgatttgaacttgttagcagtttttcttttcaaaggcagcaaagagaaactgtgaggagtttctcagcgtctgtggccaatgactgtcctgttcaaggcaggtccatcacaatcagcctagggggatggacaagacacaggtggatgcaggacatttttctagaagtgagttattaattatacaaatacagtgatctatttatcaggtcactggaatgtcactggtgatctgtgcttatatttattcctgctgggtagtactaggtagctaaactgaagagttaaggattaatctcattgaaaatgtctcaggaccatacattcctaaagtccctgctggcacagttaaagacatcattaatacattcatcaggaaagttgtgaaaggtacatcttaaaaaataattctgtaacctgctgctctatgaaacacaggatttacaaaactgtgactctctgaaggttacttccccaaagctgttcctcagtgtacatatggaagggtgtctagagttctagtagatggctctctatataattgtttatttcttgcagaagatgatttgtcatgaaaattatttaacgtgccatttttctctgtgtgtgattctttgtatttctagttaatggaacccctggtagtcagctctctactccgcgctcaggcaagtcgccaagcccatcacccaccagcccaggaagcctgcggaagcagagggtaaggaaataagcaagctgcttgtttcagacctgtctcagccttggtgcagacaggtacaggtgccagcaaatcgtgctgctcgtctctaggcgatatctaagctagaacaggaggtgaccaatgaggggttgcttattgctttggtttagctagaactcagggcttttagcttctctgtaaccttgtccaaatcttaactctgagaagaatgcacctttgctacttcacttttacatactctcctctttctgttctgaatgcacaggctttattagcactagtttgtaagccttcttagttgtgatgagtttgattagatatcaccattaagggaaagaagaagtgctgtgaatggaggggagggccctggtggaaaattgcttatggtatggatggggccccagagcagcagagggtccatgaggtaggggatgggaacctatgacacgtgcttttgtggatgaaacccacattgagcaccttttcatcactacttgcatttatggagaatttggctgagcttggagaccacagtgaaaaagttactggaaactgttagcttctccaccctaaggaagagggtgagggttagtgcttctttcaggatggagagactactgttcttatcctgtcacaacctgtactgtttgtcttttccagtaataccaaggcaaaaataaaagtagtgggaagggggcaaagggggaggtacaatgccaaaaacggaaggccctttatggtcctgatttcagacgcaaggtggggggaatgtacgctcctaggaggtttcatgatggtgctcactgaacactttaataagcgagaactccttgcagtctactgcactcaaacacaagattcttgagtttagtttcttttattatgtgttttaaaacaaaacttctgagttccacaaaattacgtgtcatccaggatggaaggccctctcttcaagatttctgcacaggttgtgtctttaggctgccagacgtctaagagtgcggggcggggagattcagttggttcccatctcctttggagcctgttgcaccaaatatcaagtttggttatctttcttcactgattcacctggcatcaggtggaacttgttttgagcgtttgatgaagcctgggatttgacgccagcttgtccactaaatggccgtggtatcttagataagcctattatcttttctgggtctccattggaaacacaaaacaaaacaaggagcctctttccagatagaaagcccaataattccattctacctccatttgagtgttttcactatggtttcttcttggccacagtctaatttggaattttaaggtgttggaatcatttgtgaacaactccaagaattggccaaatttatttactctcctaaaggcctgtccttgagtgaaggaagagctggtcggtcattcttttcttgtgaacatcacccagtgaggcgtcaatctatagggaccgccattggatacagagcaggaagggccctctttctgagaacattctgtctcttagagtgtatgctttggagagtacacctagcatagaaatctgtctttattctttgagctaattaaactcagattaaagatttattggtgtcgtttatgcttagttgttgacattaagagtgattgggaattcccgctgcaaatgggagctcctctccttgcttatttattgaggagacctccagcttagggatgtaaagctgtgctcagatgtccctttcttggcagaatggggctagaattcgcttcttctgctttctgtatttccacttcagtatgattttgtccaactgaggcagaaaatttccattcagctctgtggctattggcttatataattaacatttccagcacttggggaatgattataagatatggctttcttatagattcttcattttaccatttaaacgatcagtgcaaacaccatacttgagagaaaaaaacaatcccatttgttttaggaggacaaagggtttataccatctgaaaacatttattgagcacatgttgtgaggcagggcactgggtatattctaagatggttccatttccaagcttttgaatttaggccataaatgaacctccccatccatgtgctgtgtcagtgcatgaaggcattcccagatgctttagccagaggagctttcatcttggcatataggcaactgcatcaaataatccctcccagttaaaatgggcctagaagatccctaaaaactgatcctgtttcaaatttggttaatggtcttctcaaatgattggctatactcctatgcaggaaatactgaaataagtgaaagatggcatgtgctaaaagaagacacttcaaagaataaattaactctttttactgcagattggaaaacagtagctacttctattttttccttctgtgttgcctagcaacatggccaagaaaatgagttgactgcccccaccccaacacacacacacacacacacacacacacacatatacacacacatgcacacacgcgcgccttgcccccattttaaaatacaggaacatgagctgttttctcaaaaggaaggttgagacatttgactggtttctttacaaataggaaaatctagtttttacttatattaattacaaaatttgatcagctttctttcttctgttaaaatcacatttttatgttacctcttttgacattttggaatactcttatacaatgaaaacctgcatgccagacatttctcttcataagcatattcgtggcaatgtaccaagtaacctatttttccgaagcagagttatttaagttgctgtctacaggcatttgactggtcacagaagcagagcctggagactcttttcccactcatgaactttttttggtcccatttcttaatccatcaggaagaaatgtgttgtgttatgtaggctgaatgaagctccccattatactcccacatcactgacttttgtagattatctgatcagtcagatgatgtgaggagtgggtggtacaaaaccggagaaaagccaactctagacgctctctgcagatctgagctggttgcctggctaccaaccgagatctagtagcaggaaggggaggtaggaaaggagagaggaggtgatgagtgagtggtcggttggagaacagggaaagaacattgggaagggatttggggtgaggtgggttaattttacacgctttctgtcatccaaacataatattttgagaaagcaatgctttcttgggttttatgccacatgcaactacaacatttgagttgctgctctgggaccagaatttgctgaacgccatttgggcctcctgataaattattttattgtgaggtaagcacgttccttttctaccaagaatgggaaggaaatggtcaaggaagaattgcctagtcacatagtagtggagttgacctttacagacctcaggggccatgcaactcaacgggcatcaaggaaggcaaaagattatgagtagaccaagaggcattttcttgccaataaggcgaaaccagcaccattttgtttatttagatggtttctctattattatctttcctcctaatccaagttggtgacttgaaaaggtctaataatagtagaaactggggatgcccattcagtgctgctctcacgagagccacagggcacccaagaaagccgagtaaacaaatctatactgcccttcatcttgcaggacctgtaccgccccctctcttcggatgacttggattcagtaggagactcagtgtaaaagaaacaatggagcaatgtatatggtttgtgattgggtgaaggtttcacatttctgaagcaaaagtcttacagcaaaatacacaaaagagttttgcataccttgaaatgataaaagaccaaatcatccaaaagtaaatatgtatgcattttgttttcgtgatgttcaaccttgaaattgagagatttttaaaaatatctcccacatggatttgattggggagagtttgaacacaaaatgctgagatttttgtacagggcctggctctagatgaatttcatacacggacccaatattgagtacaagaacacactaaccatgtggcaatatagagccagaatttctgcagatggagttttcttcttaattataagtagacatagagatataatttttctgtactttctgtaaagcatattaaaacggcactagcaggcatattttttctaaaggttatattgtttttaaaatttgaattgcttggtttttagaggtacttttattacaaaataataaaaatgcttgggtagattttttttctccctagacagtagaaaaagctacttactgttttgtgggttagtacatccgagagaaaaagaaaaattatgacaacgacacatctcataaagactctgaagttaggctttaggaacttgccttgtttttgttgtcaagtaaattttattttttaaagttattttattagaaacagtataaatttagcttaagctatatgccaatatgaagaacttggccaatggcattgctatagattgtataattttttcttacaatcatatacataattttttaaatgtgtaaaaactaaagctgggaattttttttttttccatacagacctaaaaaaaattgtgtctggactttttccaagaaatccatttgaaaagcaaaattcacttaaatggtgctgtataaatcaggcccagagtatccaaatctccactctgaaaaattctcaatcttgctggtgttttggaaattttcatatgcaaaactccttttgtgttaaaccaattaagtctatgattataacccattgttaaacattaacctactaattctgctcttctagtcctctattttaaaaattatagtcgtctttgcttaaacataaaataatgattttaaagtctgaatgttaaaaattaatttaatgtgtatggtctattgtatttaagccatatcctagtggtcatttacttttactagttcaaacactaacagtttaagacttgtgaagcatggttttgatattctccaggcttgacatatctcagtaggtgataaattaaaaatgtttgatgccatttggaggcttttacatgattttttttttcaaattttacttgaaaacaatttttaaatgttttattcaagatggagagaaattcagttgtcacacgctgttttaaatgttattgatttatctccctgataaattgttcaactagcaaattttaccatctggtttatagttacgtatgttaccatctcactttacaagtgaataaaatattccaaccaaaagaagaggaagaagaaaaaacgtccaggcaatctaacagcatttgaaaacttagccctataataattagtgcctcattatgctgtctgttggagagaaagacacttctctggcaggttattcaagagctgcaaactgaaccattccatcttgaaagaacagttcataataatacctgttccagacttcaggttttaaaactgtttccaatagaaatgaccagagactcctgctgagatcaaaaggctgctttattttagctgaaacagtaaacatctgtgaggttgcctatgctggtgtctgttttagttatgtctttgtaaaatgcattacttaatacagttgggtccataaaagattagtatgtatttgactaaactgccaaaaatacaaagaaagcagtggaacagttactttaaaactggtggggtcagatggtccagaacaaaaataaattccaataattttaacttccctgcactgtcaatcttatggacaactactgctagaaaggtccaataaatgctatttgttctaagtggtagatattgccaattgatatagagcccatggctttgtttagacagggcaaaaagaaactggacttgtactaattgccgatagatatcatggccaactttccattcaagcagttccaagggaagtgctttccacagcatttaatctcttgaacatatgacttctattaaaggactgttcaggggctatatatatcatttactttttgaaagtaaagtccctcagagattgaaacagcacaccatttatagtctttgagatctctttttatgcaaaacataattctattaaactaaagcagaaataaaaatttcttagcaacaaacacagaagttttcagttcattggtggaacagaattggtgatttataggcacttatgattgagttacttatagaattctttataaaaaaaattcggcaatgaatttttaaattgttctactgagcggggaatgcttcagcaaaagccacgcagttttgtcctaatgataatccttaaatgcgctctgaagacatcgtgctgtagttcaaagttcgatactttttcacttgcactcacttttttcttagatgtagacattgtagaaaaagatattaggaatatttccctgctttcagcattttagaagtgcaaaagttaaaaatatataaagtatgaagttcagtgtgaactcaaaagactatagtgctgaaagccacatggtgtgtttttgtcttgtttaatcaactaggcagggggaaaaatctagacagtttctgtactgccatagaattttaagaagtgtcaggttctctcatctgtatacatccctgtgcgcatatattggctcatctaaatattaagaacccaaaaaacattttctaaaaccatttgaaccagcgctgatgtactatatatatatataccctacataaccagccggggaatttccaacacatgccctgaagatctatacatgattgggctctttttctttctttctttctttctttcttttttttgcttaaaaacaatgaagtgtgcaagtcagatttcttaatgaaagtgaatgaatatatagaataatattcctgaaaattccacatattttaattcttggactgctaaatttttcatatgtggccatatatctatacaggtgtttgggtgtttatgtaaatttgccaggcttggtgtgtatgtgggtatgcttctgtaagtatctgtgtatgtgtataaaccatcaacagtaaagtatagtatttgtgatacagccttataagttactggctcttgtggaattatacataaaatcttcatgtaataaagtgttactctgtgacatattagttggggcatgtttaaattaaaaagcagtttgctcaactggtatggcaaatggttcaaaatattcagatatactgatttataaaaaaattgaaattcagctaaatccaatattgtgttaactattaaatataagtaacattaatgtttatattgatatatctttgttttcaattattaacaagatcgaatactatgatttttttctattgtgtgtgtatggatggcttgtagtggttgccaatcactatactctaaaaaaatgaaacattgatacagttgcagattgtcaagtataatgttggaacataaatagaagaaaatccagagtatatttgatatgaagtaagtttaataacaaagccagataacctgtaaggcgattctgtatgttctttcaaaactctaaactgttgacaaattttgaatatacttgctgtatgtgtgtatatatctacataaatatatacacacttgaaaatgttaatcgaatgaatttactatatatgcatacatttgctcatttatgcatatttgcattaaccttgctagcatctctatttgtgcatgttagtgacaactgtctttgattgaaatattgcacagaggcatagtgtgaaaaatagagatacactgaattcaatataccaattgcctgatatagcgtgttgtactgtcagttgaaaaatatttgtaattttgtgcctgttatgcatgtggaaaaaagaggaaatcagaggccctcactataatttttaagggtgcatgacatatgatgtctttaaaatgtggttcattttagtagattatggataaattccaagatagtataaatgatgcatgtaatacctgagtgtttgtattatatatggccacaaaatgtttttgaagccagggtagtagatatctaaaagttataggcaaagaagtatgaaagttaactttctgtgatgtgtttttgaggagttgatactcatcagtaagcaaggaattgagtttattttttctaagaactctttactttgaaatatattatgaatgttgtaaatttggataacgtttttataaagaggttacatactttctgctcacagtttcagttgattggatgtgtattctctttaaaaaaaaacattttgtgttaaaacatttgacacagcaatatattttttaaatccatcaactaagtccatcagcagagctttatagagctaagggttgacaaaatgtttcattgaactacccaattttgaaagttcagttactttgtgctgtggtttcattgtaaaatgttgtaccttgtgtttcacactggaccatgttattcctcttgaagttaactttgtgacacttaccaccttagaataactatataataaacaggaaaaactgcctatgttgttcagtgagtttctttcagaaaatttgataagtagacactgaaattgaaatgaccacatgtgggataagggtgaccttcacaatcacgtgtatggcattcttctgttgtaattagcatcaatgagtgatatttgagagactgcagaatggtaccacataacgtctaaagtataaaatgctgacagtaataacaaaataagattatttgatgaaaaattctgtttcaggtagttgcgttaaaatcaggactctaccttcctttcagggttgccttaaaggaggaatttgtcagacatatcgataactcattgaggagaagaaattaacatgcagttttaaaaccactaatggtgtcctaggcttgaaggcatttttcccaaggtgatctaatttgcaggggaaaaaatgtgcatgtgtatgtgagcatgtctgtgtgtgtatttatacaagctatttcttttaaaatcactggataaatatatagttttaaaaataaagttaattaaaataatgataataaaatacttgactctaactcagaacaaaaatcataatatatttcatttccaaaaggatagaaaaggatgttaaagaggataggaaattctgctgaccaagctagaaaaaatatatacatatttttctgagacagagtcttgctctgttgccgaggctggagtgcagtggtgcgatcttggctcactgcaacctccgccttctgggttcaagcggttcttgtgccccagcctcctgagtagctagaattacaggtgtgtaccacctcatgcagctaatttttgtatttttagtagagacagggtttcgccatgttggccaggctgttctcgaactcctgacctcaagtgatccacccacctcagcctcccaaagtgctgggattataggtgtgagccactgtacccagacgaaaaaatattttatattgcaattaccatttaagttccaaattctggttttaaatctaacatttttactagttttactttaatcttcgaattacattaactttaattggttctctttattatttccatgataaatgtccacagcaatgatcacagcaaaatataatccatgtccatagcaataatcattggaaggaatgtttccaaatttataaaaatttcaaattgtagttgcagtttcttaatataaccagagtttaacataaaatgtagcaggtgcctagaagactagtgagctcccttcattacaggttgggaatcccatttgaggagtaaatcatggagggaattattctatccagaggaaatacagtggatgacttcctgggctgcttccaaactacgatttcatgaagggtgtaactcatgagaggaggcttgtgactacccaatgacacaagtctccttgggacaaatggttcagattatcaatttatagatcttggcttgcatgagtatagtgattggacaattgaggccagaaaaactacccaatacaacaaacagtacagatctagttgtaactaagtgcatttgtctttgaaatcttggctctcgtggtttcactaacatagccataacaccactgtttccattcgcgttttctcctcctttcagtaaaccaacttcatgagtaacagttttctagtcttttgaaaaaattatccaaatctttatgataacattttacatttttcagtattcattcttacttatgctcatgcttatctgtgccataaactttatttaggctgaatgtactactatgaagattgcagacaaaggaatttggaaaaagcagttcctttgtgccttgtttcaaatagtggagccttattagtaattgcagagtgatgccttcaacttattgttctatacccagttgggaaataaataaatgtctggcttttctgtatcatatagaattctgtgggtttcaagctctctacaccaagattattatttaattttgttagagattatctttagagcttctgtggatctaaagtcaagatcaccaagacaactgtttgagtttgttaaaaatgtattgcttgtgtttcctttataagattgattcagaaatcatatgacagtgataacttgatttctaaattatttttaaccatttttcaaatcaatatcaactcagtaaggtaataattgtatgccaagataaaatgtgaagtggaaatggtgcaattatccagccaaagctaaagttgtgtggtgagatttttctaccttgattagatcaattctcttaattggatattttcaaaacctttatgcagcatggaccccagctgagtgacaacattaatacaaatggcaagagtaactcacaccatttaaagtgaactcttttccactacacagtcatcagatacatcttgataaaatgtggttagggttgttatgtcagctttctcacttacttcaaaaagtgtgatatgttctccatctgttatatgatcccaagctcaatagctacacttaggatgtgttcttacttagggcagtgcttttatgaaggtgtgccataaaagcatccaggtgccagcaacctgcccaaatggttcccattaaatctgcttgggggtgatgacatttcaaatgtcacaatatctctcagagcagctaattgccctaaattctaaaataactgtacgttttgtactgtacacccagatgccttggaattagcgaattgaagcaaacataaaatcttgttggcatgtggactataaaatggtttatctgctcagaaaaaccaaaaaggtaaattgattccatttacaagcaatgaaaaaatataggtgggcttttcagcatccgttggttgtaaacaaaggctggttaatctcattaagttaattctaaagagcaagcacttacacattttgcctttactatgttcgaaatcctttcgttggacttaaggataataatagaaatgttccagcagggtctaagttagtctatttaggtggtttagtgaagaattggtggattacccaaagagccatcctgattactgaaatggcttcaactggtagacagagcaaaaacattaggagaccagatcagaatctaaaagataacagactggaaggatattaatgtaataaagatgacatttaacgtgaggaagtgtgaagtcctggacttggcccaggacaacctttcaaacacacaccagggagacatgacatagctgtgggctcattgtaaaggtgaaatgctatggcctcatccacataagccagtaagatcttgaagtgaattaatattctattcatgagaaagaaaaccctatccttctctgctttgtgctagtcagagcacacccagaatattgcattcactttcaagcaccaggttttttttttgtttttggagagacagggtttcactatgttgcccagggtggtcttgaatttgtgggctcaagcaagcctcctgcctcagcctcccaaagtgcttggaagacacagacggagaccagtagctattttcaaacacctaaaagcactgtcatgtgaaaagtggattagacctgtactgggcaactctagaaatcagagataggaccaataaatggcaaacatggagggacataatttcaacataacttacagaagaacttctttttttttttttttttttttttttttgagatggagtctcactcagtcgcccaggctggagtgcagtggcgcgatctcggctcactgcaagctccgcctcctggattcacgccattctcctgcctcagcctcccgattagctgggactacagacacccgccaccatgcctggctaattttttttttgtatttttagcaggagaacttcctttattttgcctcccattaatgatgaagggctgcctcaggaagtagtatgttcagtactagaagtatttggacagaggccatctgaccacccactgggatttctgtagggggcatttggtctctgaatggaagtggggcagaataggtaatatttaaggtccatcccagtcccccaaactctttgaatcagcggatggtcaccatcttggaaaagtatttagtattaactatcttacttctttgggaaaaaagagataatactattagaagtttaatacatttattttactgtctttgagcataataaataaaatgaaagctttccattttcagagaactctgtatgaccgtaagtacgtttttctcttgactgcccatcatctgttactctcaagcagcagaaaatttgaaatgacttgggatacattttcagaaacacaaaaatacagttgtaacattgaaaataagcagttataaacataagcaaacttgtcttaaccctacttttttttcctttttttttttccaccagagcctaaaatccttgagagatttttgttcagaaagcagagaaaacccagctggcattgtgacaagcattcagggatcagccatttggtggcactgttaaatccaattcattagttgataaggcggttgagtgaaagcccacaagtttatagaatgttacagtttaaaagatgttttcatgtactatgggtcagagctctgtatcgagtacctgatgttcttactaaaagaacaagcttttgggactgagtgtctaaattgtgaacatctttgctaggaaacatgctactgctctattaatttggtgaaagaatgtgtctttgtattctaaatttaaaacgccacgtgacaaggcagcacctgctagcctaaaccacaccatgtgtctccattatgaaataccatttgtgctgctgctggaagaaattcaaggtccagaaagcccagaagagaaggtctacattgtagacatttacttagtgcttttctgtttggaacaccattatgtctgcagcaaaaacaatgacccagaggatgaaggatctcactgttctggaaaacacacaccttcccctcaaatgtggttatgtttattttcttcggttattgacataataaatctgccttgtgtcagcctcatactgcaatattataaacacaaggttttcacaaaaagatgtccatccataaaagtcagcagagggtggcttagaagctcctacatttatagtcccttccacagtgtgggttatgggtacatagtgtcacactaagaaaaactctgtgtcaaggtgacaatctcaatccgtttttgtagcctgacatatgacaaatgtgtgctgctggttacaaaagatagaaaaacagctcaagtcaccaggcttactgaggggggatttttatagtattggaaaataatgggcacattacacaaactgtgtagtattcaggggtatacaagggtcatctctcaacttttagcctgttctgtagaaaagcaggtgtactattgctattactttaactttcatcccaatggtgtcaactgtgagctttgatgaacctgaccaatgggacatgctcatcttagtcacacccaggaaaacgttctgtgatgtttgacttagatggctctgcagtgacttaggcagcatttccccaactctattaatctttttaatgaaaactaaaatctttgaatctcctatgcaggatactgtagaccataatgaaattacatcaaacctctttcctcctactttgtacatactttaaggctgaatgggttggggaggaggttgaagggaaacaggtaagcagaggaaaaataggtcagctttgcttctcgccacctcttcattattaattcaactacagatgctctttcccttctctctgctccacagacagccggcaccatgagccaatgccgcccgccccctcaccgcctcctgctcccatcaggccaaccaagtggataaacccagggaaacagaaggaagatcttttaggacaagctgtgttcactatttagaaatagcattgaaatgtgcaaattgttttctcaggaaatagatgcagagatggaaacattcattgttaaagtactgccccatagccaatcataatattaaatatttggtactgttttttcctctgagctctctcatacagttgttaccctgtttgctttcatggatcttgggtcaaaatcaaacaaaattacaaggcctaggcttttattgttgtctttacttcagacttattatgtaacgtttaacaaaccaataacctactcagtgcttatgttttgatctcaagatggaaatgacaaccccactctttaacctttctcctaaagttgtggtaaggtggagcatttaatttttttaaggatattttataaaaacaaactgaagagaaatgttttctgtcagaaaaatagaaaaaatagtggatgggatcagtatagtgccacatttgagggccatttgccgatagtctgtggaagagtgaggtgagatgcctgaactctgccaaacccaaacagcgagctaaaggaccccgattttgagcaaaaggaataagaagtcacggaacattcaagttcacaataaccagcttgatcctgttatcacagtctattcttggttaatagggagagagggagatgtggccccagttgaatatgctgaaggcgtctttttccaagtgttaagatcaaatcctccctagcatgggcaaagttttctcctgagattccgggctgggcatggtccctggaaactcaggcattctgacccagtttttgaattaccggtttctgttcccctacagagctctcagcatggcggctcctctacgtcacttgcgtccaccaaagtctgcagctcgatggatgagaacgatggccctggagaaggtgatgagcttgggacttggtatctgaggaggcagaggatgggttggctaaatttactccaagaaactgtggcttctcaagcggaatgacatggacaaggctgagcagctcctgagggtcaatcacaaggggatagggttgaatatggtgcccaccagggattggtatctgctctgtgagaatgggaaggggaagttggcccatttcggagacatttcccatcctctgagggcatatgtatcctaagaaggccagctattgcctgctttggaaataagaggggatcgctgggatcgtggctgcttttgttttcccaaactctgttcacttttagtgttactttaagtgaacaaaggccaaatttaaagacaatttattcttttgactgttgtagtctcacagatgtactctaaattaagtgaactcaatacatgaaatatggttttacaaaaagaattggtggaaattgcaaaaatattcttgaggtaattcactgcagaatgtctctgtgatgtggtcaaatgatcaggattccagaaatgactttttcactaactcactggattgttttggacaagcattttcaactctctgcgtcttacttcctctcctatgaaatggagattgtgaatcacacctatttccttcctgaaggctgttaccaggttcaaatcaactgtggggaagtatttggaaaagataaaagtgataccatcaagccactgttaaggaatctgcttctcttacttgttttaaatgatatgatttaattttttttccgaaaaaagtaccctttgggaagtgcttttattatattcagtgaaatatgtgatttacagtataattattttctgactacaatgcaacttcagaattttttgtatttccagaaatatgaaattcagccacatagaagtctcatttgttccaaagtgttttgtatcctttgaatgaaatgaaatggttcttgatttaagcctttggctaagccttttttttcttttcttttcttttctttttttttttgagatggagtctcgctctgtctctcaggctagagtgcaatgacactatctcagctcactgcaacctccacctcccaggttcaagcaattctcctgcctcagcctcctgagtagctgggattacaggcgtctgccaccatgcccagctaatttttgtatttttagtagaaatgggatttttccatcttgggcaggctggtctcaaactcctggtctcaagtgatccaactgcctcggcctcccaaagtgctaggattacaggcatgagccaccacacccagcctggcttagccttcttaaccaaaagtgaggaaaggtaccttttatgaatagtcaaggaaaaaaaatcccaagccacgtgctttgaatgggtgtctcagtgaatgctcccaccagaaggcagaatggaagtaccttcttccatttcccacctgcagggtcacacttgtacccaacagccaaggagggttcctttcttagccacatagtaaagagccttaagattgtgtcatctgggagctgttttgtaaatttgggtgctttgcagtagacaaaactcccctggctgagtccttcaaacagaggcaaaattgtggcttctttagaggggtgagatggggttagggggattggctgcagccctcactttattctagagaccacctagatggcttctagcagggtaagagggaaatgtcacctataaaggggtgaagaggctgtaccaatgccaaggacaaaagtagcagcagcaaatgtcctacatttgttcaacgctttccagaaatttcatcccctctagaattcagattgatgccaactgagcatcatcataaatcgagaagaaaggccctcatgcagatatctgatgattatgagtctccaacaatacagagcaagcatgaatacaaaaactactaagaaagcccattcaccacctaaagttttattttgaggagagatgtttagtctcagtttatgacgaaaggtcggaagaggagtgcatttagaaaacacaccggggttccatcacattttgcattcaggttgcctgagggagagctgggatttatcactttaaaacatgtacattttagagcccagctataaaagactttttacacccttaagatgttaaaggttattcagtatatttacgtgacctaactgtggcttatttagttttatggccttagatatttaaagcattattaggcatttgtaaaatatttcaaaatgcattttcagggggaaaatgtgttgtgttagtggcactaacataattgaaactacaaaactgttccattcacagacataatagatagtgtagttttaactcaacatctgctatgcagattgctggtgagaacatttgtctaaagtctgctcgttgataccgaggacgggtggccatcagtgcttagttcatgaggaattttacggagatttccatttcaggatgtagtaaaactaagtgtccaaacagcaggcaattttcatgcttgtacagtgtcaagcagcccagagtcccttgcgaactgcggttgcctcctgcgccatacatgggaatgctatttttctgtacacagtgggtattcagtaaacactattgatcaaattggcgtgaagtaaaaggagcaaagcttcctcctgagaatccctacggcatcagaaaactcaagtttctcttatataggtgggagtggaccccttacgtttctttttattttatcatttgtcttagtaaaaactgttgagtatatacaatgtcagcaagggtggggaggcagttgcctcactgtacagagaatgacatattgattctgaatccattccagtcaattagatgatacttttaaatgtttccttgtgcaacatctgtgttcccttttcaaccaataaaaaagtattaatgattctttcagaagtgtcggaggaaggcttccagattccagctacaataacagaacgatataaagtcggaagaacaataggagatggaaattttgctgttgtcaaggaatgtgtagaaaggtgagaaggatatcatttgcatcaaaccttaaaggttacatttggcgttatgttttccaagattgtgtctctatttccagtctgtggcacatatggaataagttaatgtctcaaccccaaatgcaaaagaattttttgcaaaagaaagacccatctaacaacagatttgaaaaatgtagtgatacctggggacaatctataaattaaagactttgatttttttaaatgtactcagagagacgttgccagctctttcaggtaagcctttttattgttgttaaaaaccatattgaatagtttttctcacacactttttatgacattttgtagaggtcagaaagttcttgtgagagtatatgtctgtaatgcatactagcataggatgaaatacatacacgatcatcttgaaaagctttaaaatgcatatgtattgaccccaacagaagtggtatttaacacattaagacgtattaaaatgaatgaacccggtactctgtggcccaaagggaagggtttatcctgaggttctagatacctaatggaggacgttagctggtggctactagacggaaaagtgacaactgataaagttacaacccagctacgggggcctcaagccctccactcggtatcagatttgggtttcttttcctgagcagctgcttgctttaggggagctggtcagccagcagcttctcctcagggctggtgggcagaatactgcaaagttgggggaacttgcctcattccttgagggactgtgtcctctggctttctgggggctggactggggggtacacacttccctgtcacctttctctgcccgcagtggggctggacaccctgcccattcttaatcctccgagaatcacactcctaagctccactcagagaggacgactgaggagagaagacagatgagaaggctttggcctggaagatctagaccttgcctcctctacaggctttgatttagaagcacaggttcctgccatatcagagctggtagtctctacagggccccacatctcatgagggttcttcatttggccaatagtcacttatgtgctcctggcaccccttgcggctctttggaagctgcttccccagctcaggtagcagagtcctccttatggacctttgtgcagaggatctcaaaccttgttctactccaacacttcagcaaggctaggatattcccaacagggacagagacccagctgagcagccactgtgcatccaggaggggcacgagtcatagggagcttgaaaaatctgtgagttgatgctgccaggccaccgttctcctctctccctctcattcccccacctctccacgaagcttggccatttggcacatttgtgccaaacatggaaaatgtccattgcattcctgggcctcacacctcccaaagcaggagcaacctcattttgctgagcataaactatctacaaagtccttaatttatgacatttcatttaattaacacaatactttcataatatcagtattgttgtctccacgttatagatagaaaacatggacatgttaagcgcccaaggtcagtcaggtaagaagtacttagcaagacataggtccgagcccagctccaaaaaccacacttttaaccactttactccactaataaggagcctcccataagactctggcttagctgagccaaaatcacacacgttccctttggccctgtacaaataagactaattaatttgggaaagccattcctatggtaatggatagaagcgtgcatgcaaataaatgtgtgcttatataattttatatttcattgatgcttttactgatagtaaatctggctttttttggctttatttctactgtagcagaaaaccccatttctagcagattgccatgcccctgagctgtggggtgtctggtgatttgccagcatctatcatctgttaagtctgacatggtggcatgtgctgtttctcctagctagttcttggattgggctggtgtcttggtccaacaggactggccttctcacaatagaaatttcccatttctccatccagaatcaatttgtttctttctaacttggattgtgtttgttttgcgtgagttcacatcttgggtctcactgtatgaaacttcagaacctaaacaccagattgctccatgaagttagtattcggctcctgctgaacgaggacatatggcatgtgccctctgtccccagaggtatcagaaaacattcttctaatattttccagaggtccaagaaaataaaaagcgagctaagaatgttgtgaatggcacacattgcttgcgggtacattctgctgtgtttggaaggatgaatatgtattaccaagggtgaatatgcctctcctctgctaatcatatcctgtcacaggcaagatttgtctacaacaatggacacaataacgatgtctttctgtggtcctgttccggcatagtctttggcagctaggtccatttagatttctgcccatgctccaggagtaacttcttgagtggcctctggggtacctgggacatactaaaggaagttagtggactgtgactccagctggaagagacatgctctactttgaagctgtttcgtggagcattttgaggccccatagcaaactcaaagagcagaaaagctctaatgagcggtcagagcataagtagagggcgtgatgtgagatgcctttcatccctaactttcctggctccgtgtggactaataactacacgagccaagggttggggtgatatagtcatgagcagggatggtgcccccggtggctcttggtcgtcttccccacctgcactgctggcattgcttagtgatataggcaccagagatgaattaaaatccttgctgcggatgcttctgtctctcccaccggcacctataagcctgaggatgtgtgccccaagctgctggctctagcaatgaacacaagcaggctcaaatccagcagaacaagcagagatcttagggtcaccaaaatgcattgcttccacctagaaaatcttcaaaattctcaataacctcaacaaagcgaccatgtgtctatagtttgaaagcatttccatcagaactggaatttggaggatgccttgtgctgaaagcttagatcactgctcttggctagtggattactgttcttccttctttccttcctgaggagcctctggctcctgagagccatggggcccttgtcaaattcaaaatcaaattccacttgggagctgtctgacaagacactgtggaatgcctcagttctctgctctctgctcttggcagttatctctttatggaggaggctgagattgggctttgttaggattacttggtaaacaaacggtgtgttactaactcctttttgctagtgttgagggtggtattcctgtcattgtgctaactgccaccatcctctggagtttccacaatatatgcagagcacctcctagttcaggcttatgctgggcacttctggggttacagagagagacaagacacagccccatacagagaactttacccacaaacaaggattgccatgaaattcaatgaatgctatgggagaggaatgcttgggagctgcttttccttctccatatactctttttctaaatccttcaaaacatagcaaacaacagcaacaagagaaaccatgttagcttagagcatcccaatctttgctagccatttccacaccaccacctttttttgacacagggtcttgctgtgtcacccaggctggagtgcagtggcaagatcatagctcattgcagtctcaaagttctgggctcaagtgatccattctcctgccttggcctcctgaatagctaggagtataggtgcacaccaccatgccttgctaatttttttgtttttattttttgtagatgggtctcactatgtggcccaggctggtctcaaactcttgatctcaagtgatcctcctgcctcggcctctcaaaatgctgggacgacaggtgtgaaccaccatgcctggcccatttctttttttgacaagcattctgctacactccctgggtgaggggtgcagtgggcagaagactggcctgagttgggaatcactcagttgaacaagacagctgtctccaaaccatttttagcacaaacaccaaaagttggatttaattaaagtttgtaaaatttgaaaatttccctctagtagtttgggttctaaccttgggtcacacttaataagaaggcagccttacaaattgatttcccttagtcaaggaggaagacaaagttttctgttgctgctggttttgttgtggtaaagagggttctgtaaaaggtcaagaacataatttcaaaaacaagcaagcaaacggcctgtattcacctcaccagtaatcagtcaggtcatctagtattcttctgagtacactcaaacatagacaccttaaagacaaggatcaggtctcgttcccctctgaatccaccaaagagccctgcgtcccactgctgaataattacacaggcacagcagtcctcagagttcgaggtatgcaggaaggcgaattcattatataagattcgatttcttgccaagtgttttcacttaaagcagacacttatattcttattcttatgacacacatttagtctcctaacacctgttttcaggcacactttctagactagctactttcctataaacctgtgattctaggaattaatttttattatgtggcttttattatggattttattatgtggctttgtagttcggccctcagggaatcaaaaaagaaaagatgcaacattaatttggtggtcctctgtggagctcattgtccactatgaaatatgagtagatgtaatggaaggtttaatcctattacgaaaggttgtatagtggaaatccacaaggtctttgttcctagtaagccctaggtttgctgccctcttcccctcagctgtaggctcaggacagaacctgcttccttggcctgctgggagccaacacaccctctggctcactggggatcctgcttcttgtctggctggctgtaaagggggttcagccctcctgtgctctacaccagccctgaggattgagtgctttaaaattactccttcaagggaaaagagcatcaaatggcaaacatggggaaatcaccaagctaagaaaccactttctcttctgaccagcacggtcctgtccatccatcccctttgtggaggtggtgaagggaacggcagcttttatttttcagtctcacaaacatcccttcttgctctctggccttgcctgggattgctgatggttacccaggcaggcagtgcaatggtctagattccctgccatccaatgggacatgttaagccagataggaaattgctcatgtattccaacctgagatttgctttatcataattttttagtaatttatgaaaagcagaatccagaaacacttgagcttttagttttcctcgattaagtattttcaagtttgtagacaaactctacaggagcctcttaagaagaagctacttagagggaccctgtggtcttataggatatagagcttctacaatgaagaatctcttcacacgtgaatcatttcactttctcattttctcatttatgtttgctcttacattttaaatttctctgtcgcccaggctggaatgcagtggcatgatctcagctcactgcagcctttacctcctgggctcaagcaatcttcctgcctcagcctcccaagtagctgggattacaggcacgcaacaccatgcctggctaatttttgtattttttttttagtagagtcagggtttcaccatgtttaccaggctggtctcgaactcctgacctcaagtgatccgcccaccttggcctcccaaagtgctgggattataggcatgagccactgccccaacccacgttttaaatttctaatgttaaatatttggtttacactccagtgccttctcctcctctaccccacagtcttgctggtggtctagtgtttatgtgggaacatctagcacaccaagccctgcatttagccacagcctggctcacaccccatcatggcctctctgcccagccatggcagagtctttgttgaaagatcaacagagacagtggcaggggcatccttgggcttctagtgcattcccttcctgagtgacagctatgggaattcctctggacagccgcatatctgcaggaggggagccccgaagcaaagggtttaccttctaccacctgaaccccaaagccctctagtgaggaaaagaggcttcgaagtcatcatcttgtgattttattcagcagatagaattataattcagtgttcactgttttttgaggccggcaccatgaaaaagcctggaagtgtcatggaagaagcatttttaggagtaaatgacatgaaaaatttctagaatgccctcaaaacacattaacgcctggtctcttgattcgcttagaggcaaatcattttcttgctgtaaccatataaccaggaaatcccacttaattcaccatactgaagattttaaagtcctattttaaaagcatgttcttaattaacctcattactatttgtgtccattggatccacaaaattggcttttatctataggtaaaaagctaggctctcccgatttcacaccagaaataaaacagcaatgcttgtgaaatcgtggtttactatgattatgaagtatgcattgtgccctttaataatagacgtgttcttgtgtttgtcactacagtttcttagcaatgttagcacaaatcaggaagctgtttaaaggtagcgatacgactaaatccttcctcctacacctatcacagaggaggggcggcgttcactgtgctatgcagggagcaggggcctggagaactcagagtccaattttaaagctgccatgtggctttgggaagtgagtggatttccactgtcaccttcattttctttcaaagaaatgagacagcccataaaagggcccaggggtccccagggagctctgaaatagattttatccctttctttacaccttgaccatatcatctatgagttctccagcggaactcacacaggctctcacactgaactgaggtctaaagagcgtggagtgctttctctagagtcttcagtgtaattgcatgaacattcagaaaactgtcataggtgccctgggtggatagagaacctcaggagagacttgaggaaaggggaagggcggaaactcatctctgctttaggctgctgctacatcacttcggagggaaggggagggaagagtaacctggcagcaggagaagctaagacacactagcaatgctagtgttttgttttgagagcaggagtggaagtttattagaaagttttccaacagtaagaaaaggaaggaaagtacacttggaagagggacaagtgggcaattcgaggaacaaagtgccagtgctagtgtttttattacaagtacggcaacataaatagcccaagatttctctatgccagcagacttactgtccttacacttggtcagtccatcaacgtttacatatttatttgtttttttttaaaaaaggaaaggaaatcctttcacaaaatatttacaacatgatgcaagatctatggggtaggaaattgatccctgacaaaataattcaatagatttgaagttaagtttcattttaaaaacatgaactttctcttcgcagatcgactgctagagagtatgctctgaaaattatcaagaaaagcaaatgtcgaggcaaagtatgtataaaatttgttcttatgagataagagtgttcaagaggtcaaaagaaacacaaagatcactcccaaacaaatacaagttcaccctaagggttgaattttggtggaatagaatgttatacacttactagaatataactttatgtatatccctgggataaaagttatttggaatgattagatatgacttcacttccttatctttttgtttgcttactctcttcccttcttaatgtgatctaagtttcatcccattctttgctatgaaactgtagttatcatgattggttctgaatttgcaagcattatgtaaggatctccatatctattggcaattctaggctatatctgaatatcagaatataagacaggcttattacattttaccaaaatgcatctctcttgacccttacatagtatagttgtactcatttgagttagccctccacatgttttatggaagctgatgaagataacttttcctttggacaggagcacatgatccagaatgaagtgtctattttaagaagagtgaagcatcccaatatcgttcttctgattgaggagatggatgtgccaactgaactgtatcttgtcatggaattagtaaaggtgtgtattttggaaagaaagtaagtctttattgatggcaccgcacttgcctatattctagagctctttcccttattttctcccatcagtattcaggttctcatttctgtacattggcccagtgattaggaatgttcacaggagaatggtacacaagggctcaagtcccagccttggcacaaagaggcccatgactttgggtctacctctttatgtctcactttcaacatatgtaaagtgagaatattaataatatctgcttaatggtgttattgtggggatgaagagatggcttccaccagtttgtgtgacacacaaagcattaggtaccaatacaattgtcgttgttgtaatggaaaatcattcacttttccatgaactatatccaaaggtaccagccatcttgtaaaaacaagctttaaacttttagtcaccaacataatgggaaaatagcactgtcctaataatgatgtgaatagtgtactgactttcagtgaatgtcgtaatctcatcctgtcacataatattaccttcttattctatgaaaacaaactatcgggatagccaattgttgatgacggttgaatggagatgaaaggtctcttacctgttctctctccttccatacatttgacattttcgggaagtagaagttttaaaaaatggcatgcttcattttcatgaagctgttgtgttctcaagtcttttctagtatattcatcaaactgaacgtgtaagtaatgtctaccttagttggagaatgttgtaattggttgcaccgccttctgcatcagctgtgagcaccgccagggggcgcctcaggctcccagggcatgtttggaatccctacactgctgacttgaatgtgaggttttctcttttaaaaattcaagacgaggaaagcatttagtaagctaatctgcgatgatatgaaaaatgttcattctagggtctttaagtttttgttatttagaattgcttcaccttagacatattggcattttttttaacttagtggttatttgtatttataggtgaaatttatttttagtctacttcaaattaggacttgtttctttctttctttctttctttttttttttttttttttgagatggagttttgctcttgctgcccaggctggaatgcaatggcacgatctcggctcacggcaacctctgcctcctgggttcaagcaattctcctgcctcagcctccctagtagctgggattacaggcatgtgccaccacgcccggctaattttgtatttttagtagagatgggatttctccatgttggtcaggctggtctcgaactcccaacctcaggtgatccgcccacctcggcctcccaaagtgctgggattacaggcatgagccaccgtgcccggccagacttgtttctttcaaagaatgggagcctttttttagtaacaagggtattgtcatgtttgaggctgagggaggtaaaaatgttaaactgaaaatccaataaagaaaagtcggctgggcagtgtctcatgggccaggcgcagtgactcacacctgtaatcccaccattttgggaggccgaggaaagcagatcacaaggtcaagagattgagaccatcctggccaacatggtgaaaccccgtctctactaaaaatacaaaaaattagccgggcatggtggcaggcgcctgtaatcccagctacttgggaggctgaggcaggagaatcgcttgaacccgggaggtggtggttgcagtgagccaagatcgcgccattgcactctagcctgggcaaaaagagcgaaactctgtctcaaaaaaaaataaaaaagaaaagtcgatttcatttgaataaagaaaaaatatgaagattttcccgttggtgctttattattaaattatctttttaccaacattgtaaattatactttccccagtaccaaggagtctttttacaacaatgttaatttttaaactaacaacttcaagccattctgttgcccttctatgtgctgttagaatttgattaccccccgttattattgacttacccccactgttggctgatttttggagtgctgagactaaatgaaatttcaagatggcaaaggctcaggcactctgaacgcatttggtgagaaatcttagtctgtcaatcgtgtgcttggttaggagactatggtaaggtcctcgttgcacttaactgcctttgtgaattctctctacatcaccaagataccctagaaaggccatagaaggtctctgtagcccagcgctgggaccctcaattgtgctgcaagaccatacccttcgatttaatctcacccagaacgccctgaggacagctcgagaagcttcccagggaagtgaaggccagccccaggcttgacttgaaagactcccaggacttttccactgagacatgtgggtggggtatgcttctcaaaccctcagggcccagggatgtcccaaagaatgcctgaagctctcagacaaacaaggctcatgttccggacggcagtggatcggcagttaatgagaatgaaattccatgctcatcaggcacaggactttagccttctgcctccagaggcggtgcacacgcaggctgcctatgtgttcagaggaaggcaggcctcgtggaggagctgggcctgcagctgggccctgagagagcaacgggagttagaaaactgaaggggaggggatgggacacttcaggaagggcgctgtcatgaggacaggcttgaggacagagatcttggcctgtttggatggctagggaagaaatatcctggagtgtgagggtcactatgttaagtagtggcaagacaggaaattaaacagggtggaatgaaggttggggcagaatatagaaagcctcctcctttcggctgtgggaaaagaatggtgatttcttgaagagagaaagaaaatagcgacataatgtgtgggaaggtagcagtcggtgtgcaggatgctttggataaggagctcacggagggaagcagaacggattgtgagaccacatgacaacaacccagggatgaggcaacaggagcgtttggcggagtaggaaggcccagatggctgcgaaggaaaaacgtgtccaagaaaggaccgataagacctgttgactgcattgttgaggacaaagaagaaaggagccagacgcagtggctcacgcatgtaatcccagcattttgggaggccaaggcaggaagatcacttgaggccaggagttggagaccagcctgggcaacaaagcgaagcctcatctctacaaaaaaaataataataattagccaagcatgatggcctgctcctgtggttcccgctactctggaggctgagacaggaggatcacttgagcccaggagtctgaggctgcagtgagccatgattgtgctactgcactccagcctgggtgacaaagcaagaccttatctcttattaaaaaggacattacaagatgccaggagcccagataactgggactggtggaatctttgcagggtctccatatacagccacacatgccctgtggtggaactccaggggtgctgttcacatagaccacggtgactgtcccacctcctcaagtggcacagagacaacctgaaaacctgtgtgtagcagccttacctttgagagaagcagaaagttgaaaaaactatttgctttgaaaaaaaaaatttgtgtggttagcttgagaaccgttgcagcttgggggacagtgagagaagtctccagagtggagactgtacaggggcacagagggcccaggcccgagaggcagatttgaaaatcatcagcctacaggggctatcttttgctttagctattttaaaaagaaaactgagttccttagcgcattaggtaacagacgatcacagttggttactgtgcatagcggtttggtacactgtaggcaagcatgatgcacatattgatagtaaatcagaccccaattctctgaaaggatttttgaataaatggaacttaggttggaacttaaaaatcattccattttaccaaaaagcaatatatttaaaaaggaacaaaggaaacaaaagttcagatgaatgacagtcctagaaaactttctttgagatttcccccccttcctccctccttctctcactcaactttgaaatgaagtttctggtctttttctctgttccttacaaaggagcacaatattgaaaaagaaaacactatgcccactctcagagagctaaatctagtgtatgaaggggattgtgtgtgtgtgtgtgtgtgtgtgtgtgtgtgcatcctaataatttcactaggcagtagaacattttcagtgtgcagtttgcagtattacctgttcctcactggaggaggtgaaggattacaaatttgaactctggctggcagtcagtgtgaggcaggtagcacatgccactgggatcttcacgtgtcacagtcctctgccctggagatccagctgcatctcctcgtcccctagctgggatctgtggaaatggccatgtgtctggtggtggagaatcctcacgctgcccctttctttgagctctgggggagatgccactggtttttgtagtgggtggagaaatcaccattcagccttcgagcctttgaaaggaaagtagcaggaaaagcctttaggaacccaaagattccacatccattcttcctgtcctttggggtttgtcaatggcctctgcaggtggccccactggcccgtctgttaatgtgctgcttcaccttctgttctcttctcaggggggagacctttttgatgccattacttccactaacaaatacaccgagagagacgccagtgggatgctgtacaacctagccagcgccatcaaatacctgcatagcctgaacatcgtccaccgtgatatcaagccagagaacctgctggtaagaggaattccacctacagggcatcctgagttccaagcactcatgaaggaatatgaatatttcttttttcttttctttctttttttaaaaatttacctgaaaggttaatttccagttagccttcaggagctagttggaaactagccttttaggttgatctagatgagttaatgcgcccttaagaacacctgatttattagcaaacaaaaaccaggcacaagaatgggaattgaactcgcgaagggtagggctgtattgaacaccttgggctaggacaagatagcgacaagttacacagacacaaatgtcatttatcttaggcacttttatgttagaaagtttttacttgccagttggggcaacatagtgagacccccatctctacacaaaaaaaattttttttaattagccggacatcgtagtgtgtgcctgtagtcccagctactcaggaggctgaggttgctggaggatctcttgagcccaggaggtcaaggctgcagtgagctgtgatcacactactgcactccagtctgggtgacagagtgagaccctgtcttgaaagaaagagagagagaaaagaaagaaaagaaaagtaaaaagaagtttttacttggggaaaaaaaaaggaagcccttttagacttttttggagtctcccaactttacagctcaataatatgatccaaaacctaaaagaaaaaaaaattataattggtttttaagactctagccccttagcataaaaacaattttgaaaaagactaatttttaaaaacggagacatccttcccccaactttacactatttggtttgcttttcatttactccacatctctggggaaaccttgagagatctccacaaaagcaaatgggggtccttcctcacccagttattaaggggaatacataggaaaaaaagaggaggtagagactaagtatggggtgcttcactgggaaatatgggagtaatataaatgttgctggctcttcaggctggaatttaatgaaatatatttcatttctatatactgtgcatatatatatatatatatacatatatttatatatatatcttttcccaaagatgctagttcttcctttcattatccacccctgagcattatgtataaatatatgagttctgttactttgcccgtctcttcagaaatctgggaaaagaggattctctttctaaagtagtgtttctgcagggtggtctaaagactccctgaatcaaaattattcccagatgcctgttaaaaatgcaaatttctgggcctagatgcagccctaccaaatcagaatccagtgactgatgacagcttgcagaaatccacaaggcagccacctcccccaggtaacccgcatacacactcaagtctaaaagcagatgagccacccaactcccatgacacaaataaaagctagtaagatccgccatgatggagaaccatctatgtacttggccctgtgctaacgtctttacagtcattatctcgtttcatcctcacagcaaccacattgggtaagttctattactgtttcatttcataggtaaggaacatgggtacctagaagttaaatgacctgcccacggttgtcacagctcttaagtagaagagccaaggtctcaacctaattctgacttccagagccttagctcatactactacactacagtaagctctgcattaaggagaggttaactgagtacttgctatgtgtcaggtactgtgccagggaacaagagagacacatgtcttcatgaagttgacgctgaagcagaaaagataagcattcaagaaacaaatatgcacacaattagttaattgcaattatgctggtaatcttgtagctactggctaataaaaggcagctgaggtcaagtgactgagccctgacttaattgcaccttaaattcctcatcttcacagtagcctaaacatattcttctgcatagttacctccatcaactgcagcaattttctctcatctgcactcatttttcctgtgtcttgaattatgtaggattgtctcatgggaacagacttacaactgggcctttgtttaaaaacttctctaagctcccaaacttcagcgactgaaaattaaagtttcattttctttcctttttgcttttgctgctcagttttgtgtacccattgttcacttactcctcgctgaagtgttatctatttctgtaaatgccataagtgattacattggagtgcacttttactaaaattacagtttacgtgatacttctaatgtattatgctcattcaaatatattttactttaaattaccacaaaagaaaaaaaatgttctctcctttctttttcccttctcttctaatttaagaagctgaactatatggagaaacaattgcagtcatttataatgtggttttaaaatatctatatgaaaaactaacgagattttattctcctttacagtgatttctgatggtagggattaggggttggtgaattttgcagggataagtctattataggataaaatagttcaaataagtttagcaaaacttaacacaacttattctgtcctggtttaacaaaactaggatgatgtcactaattgcacatgagaccactgttgatttcacattctattgagagttgtggaaataagagaaccatcacagaaggtagaccctcacacacccaggatttatagtcagatggacaaaagttcaaaaccaagcggttcactcttccactgcctggtcttatgaccttgaggaaggtacctccttcaagcctttatctttaaggggatttgatgaagataacataactattaattttcttttgaaaatttcccctttctttgtaattaaaaatgaaattaaagtattccttaaaataaaactgcctaacgataatatatgtagtgaaaatcactttttaacccttttttttttatattgctttagaaattttactattcacctgtgcatggatttgccacctcatggcaaaatgtaaagctatagactattttttgaaaatgttataataaagttaatataaagatttggaatccatttacttattatagggaaacttatcaaatacataaaaagacctcacagcatactttgttttactacgttattaaaaggcttataaaacccttctaaattgtaagactgacaacaagatttttgttagctaagtgttagattaatatttgttataactagcaaagtatttttaatacatatctaattcagctatagatttcattgtacacagtataattgtgtatgtagaacttttagcgttttttatttttaattcttatagaacagcataaaaatgtagcctggtcttaaggatctatattgattgtatgaatgatttatttaactctagtgtttggttgggttaaagtattttgatgagaaaatatgatttgacttacagggatgttttcagccacattttaggtgaaaactgggcattgacccaataaaaaataccccttataaatttattgttgtatttaactaaagtttttccccccaaattgatcatgcccatgattttacatggttcttgttgctttactggttgtcatgcctggtacttaataattgtatggacaggtggacgtcagagtggatgagtggagtgagtgagtgaatgagtgatacttctatgaacagaggacagagccgcctggcaagcccaaaacattcccaactggcctgttagacggagttctcacactggcctcagtgtaaacttcactgagcagtgggagaaagtatgatgcttctccagatgggcttaggcatgggaccactgtgtatgtatgcgtgtatgtgtgtatgtgtatatgtatgtgtgtatgcatgccatgatggttcatgactaaaggaactttttgcttaattaaaaaaaaaaaaattaataccttcagtttacacaagtcaccactagatggcaagcttgtacccttagcaataaaaaccatcagtagcagcttgtgtttctttcaaggacctgggcaggtctttcaaaaatgtgtacacagatgcctcctccttatgaaaattaaatctttactaaccaaactataactcacatcactagtttttattagattccagaaacaaacatagtcgttttcttcaaatataaacattcaaaaatcttttccctcccaaagtccccaagaccctgcaggagaaaaactgcctctccttggctagaaactctgtgttcaagtgtttgtgcctgctcccagctgcccatcaaaatgacacgtgcaactcatggtccttgttttcacgcagtggattatatctagcaataagctagtcctgttccacccaaatgacgatgacaggttgtgctccagctcttcctagttttcaattccatgctcacaagataacatatttccttcaccttaatcccatgactcttaattctccaaataaatccatttggtgataggatagctaactgcactggtggacaagatgagtgccacagagagaatgggtctagaggtcatggacaaaaacacagaacttgagccctcagagtgtattgactaatggattggaggttacccaaaggaagggagccagtgatcttctgtgagtctggccccaatcctgccctattcatcattaccagtgacttcaaatgaagatgaattataccaatgacagaagtgaaatccaaaaatatttttggctctataaaggtccaaaactggtaagaagaaattaaacaagagataaacataaatccctagagactaagttagttttggtgtagttgtgttattgtcaatttcagaaacagtaatggaatacttggcctgactgcaggtcaaaaggctattagttgacctggagaaggctgttcgttcagtgtgagtctcagtatgacaagcctgctaaaaatattcatatgcccttagacttctttccctgaaagagtcaggagagtccttggtgtggcttaccatggtaccccttatggtaatactctgaacacattctgtctgggcctggggttgacccagagaagggatgtaccacttggggcatggtgattctcatcaaatataggaaaggctgccacatggaggacgggataactttcttgtactgtatatgacagcatggaactaaaattaaagagaagatattagtgggcaagagatttagggttaactttagaaaaactttttaataatctaatttctttgaaatttaaatgtcctttattactggtagcttgtagtcattgtgagtgtccgggcagaaactgaacgatcctttttttgggggtgtttagaaaaaaaattctactctctgaatttgcatggaagttgagggaaaatagaagacgcaacattttcccaaagcattatttagtaccgtaattggccagttactgtactaagtgtttactgggcctcttgttcaaagacctgtgatttcatcagggagatgaggacaggaaggaaaaggtatccctttaagaagacattgattttcaccttgtgtcaccttggtgggtctgtgtttgtctaattcactgctcctttctgctgtcattaagagatgacactcatttctttctaaaatggcacagccttatcagactagcaaaaattaaaaataacatacaatgatggcaaagttaagaggataacagttatctcatatgtgttggtgggagagtcacttggtggaacctgtcagagaggcaatttggtaatatataaccaaaaccttcaataacatgtgtgccttgtgaccaagtaattctacttctagaaatgtaacctaagaggaagaaactggatatgtagctatccagagggatgttcacatcagggttttgcagtatgaggaaaaaaaacccaaacggtatatatggagataagttatctcagggcactgatgaattaaatagtggcacaatggtggttagaccaccagtagtggcaggacatcctggttagactcttggactcagacatatctgagtttaagttctggccctgccacttatttgctgtgtaacactgggtaaattactttacatcttcgaatctcaattttctcatctgcaaaatatgagtaagagtgctaaattaatagggctggtatgaagatcaaatgggccaaaatgcacatgaagtcttcatcacaatgcctggtatgtcctgtgtgtacaataaatgacagtggtaatagtaactgttgggattactaatatggtgccatatggaatatcctgcagccactgagagtaattgtatagatatatgcgattcacttcggaaaaacattcaggatatgttgttcaatggaaaaagaaggataggaaggagagaaagaaagctctggaagtccatgtcccaaaatatgaacagtgtttatttctgagtgtcaagattatgggtgagtttagttccttttcgtctatagtgatcattttcctactatgacatattggataataattgtgtgacagaaatgtaataacgttttttaaaattgcagtggcattgagttcccacagttttggcaaaatcctgggatgtataattcctaacagaatccggaatgtgcatgttttgtgtatctcgctgcagctgcatagaactccttttaagatagtttcatgactattttaaattgagggtgagaatcaggtttcctggagtttccgttcacttctccatcttcccagatatctccagtgtaatattgaagagcaattttactttttagtttaattacctctcttctgacttactcctttctaacatctgcacaacattcattatttttattatttcatttaatttttgatttcataaatattttacatgtaggtataaatttttttattatgtttttccaggagatttaattcaaaagtacatgggccataaaatgcattctataaaataactccctgcttaaatgttgttatatttcatttcttaaagattaaagatttaaatttaagccattttcctcagaaagcatcataaaggccatataccgtagcaagaggaaaatcaatgtctttttaaagggataccgtatatgttaaaaagtaaattgacgttttttcatggctttgtcaatttcatgccacttttgttcaattctatttggtgaaataatttttagttcctactgagctcctctgtgaaatagttttcagtggttactaataattcattagccaacgtttcatcagggttacccttggattcgtagaaacactgagaattacgtttgttccaacacatctgttacattagtcagcttttagtgccatattatgggaatctcagaaaccttttgactgggttcaggttatctgtgaattttcatattattttatggccaccagctgcattttatgactatatattaaatgttttattttttcaaataatttttccaaatggtctcagtttcccatccaagggaaatcaagcatatgcctaaagatctactgttcagtaagttgtagctaatgcaaaaccccaaataaacaaaaaagaaacaaaaataaaaccctcctttcaaaaacaatcctgtgcaaaataccagtgtgccccaaaatctacatacctgacctttcgttatatctgttcttggttggatatgccttcaggttttaattggaacctttttcataattgttgccatttaacacatttagtctgtcaaatcataggatgtctttatagccatataataaaccctagagaacaacttctccgactgtagccatctgcaatgatcccaagagtagcttacaaaatactgacagtctttatggtaatatgatacatatggcagcccacaattatgtgtagctgcattcaattagtgttgtacaattacacagttttattgcttagttaaaacagtgaaagcactacatactgggtaatttgcactaatccctgtccctttaatagcccctcagtgtttaaaatgtgggggaacatctatagtacttaaaggaccagggatgaacattaaatcatacctcatgttgtgaatactccttgactgacaattaatgtactcccacttcacgtgtgggtcacattttatagaggctttaaaatacagttatggcaaaaagttcttacaccacagctccactagctggaccagcctgtccaagcctgcgcttgcagcctgctcatgccctttctgaaagatggtcagaataaggaggaacgccaagtaacaagtcaatccagagagcagtctaagccaaggatttggcattttcaatgtgaacttgttagaagcctttctgatttctaacttttaattaaaaatttagttcaaagtggatttatggctgccatttggaataatactttctggagatggttttgtgaggctgtgtgtgtgtgcgtgtgtgcgcgcgtgcaggctttaaatgggtgtatttagcaatctgtgattttttaacaaaggtttaattatattttcacatggcctcagtcatgcccctgtgtaactggctcagtaagagataagggtgcacgtagctcaggccgtagcaggtgctaatgaagagtccccgttgagagagggcttcttaaaccactgagggaagggctctcccactggagaagaaacactgaagtatattcttctccatcctcctcccaaagtgttgacagagaaaaaaaacagagtgaccttgtttcctgccctgcctgacagtgagttaaacagaattccaaactagaggactggacatttattcacctgcaaaaacatttttttttgcagcatttcaaatgtacttgtgtctagatatggtttcaattacatggaattggcctttgtctttaagctcttattttctctcctgagtgtcccttgaacctctttatgttcacaaaaatcctactgtgtggtttttaaagcaaaaaaaaaaaaaaaaaaagcggggcggggcactgtgcaagtgattaaaagaccattgtacagggaataaaaagaacatcacaattatggttctatgtacttcaatggttttcattttcgtagacttattattacttttaataatcattttgtattagtactcattttctttattttaaggaagatttttagtgattttttcttagttattgaaactttgaactatattgttcattcatattaaatataattggtctatggctatatgttagatggaatttctattaaaatgtagatgttcgaaaagaaaacttttcctacatgtaggagaattacaaggtcatatttagaactaaaatgggacttatgactgaatccaccaacatctgcttttgtcaaacttttgagtacagttaggtggtgtagatactgtgtttaagaaaaaagctacaaaattcctgcatcaagtgggttgaataaattacaatctgcatcacctcacaaagcacacagaatgaatgtttggacctagcagaacatcaaagcaggagattattttgcattttagaaaggttattgttaacaaaatggaattaaggaagtaaacaattctgctctgcctcggaaatcaacgagaccatctactagatgtttccatctcagatttcttttcatgaaaaacatttgcttgtcatttggatgaccagaatggctgacgtggtaagactacaacttagggttttcttttgcctaagaacagttaggctggggccgatgttgtgttttgcagctgtgatgcctcaaagtttttaacttaactctaagtgaccaaggctggacagctgcttcattaagttaggaagaaaatgtccgtcccagatgacagctgggcaaagccacatctgtgagggacatatggctgtttttgccctaacaacccaatcacaggtgacctcacaaatcttcggatacctgccagagggcagcccaaacttgatcctgatcaacagctcctgggaataagactccatgctatgagtgtggagaaaatgtaaaagaatattttctgctcagaaaagatgcagtctttcagataggtggatctgactgcctgcttctgccaaaactgttggatccaagtgatcattgctgatattgcagcttagctggccaaacatctgcattttgtgttgcagtgaaacgcaaagttaatctactttttccaaaggaaggcagacgtgacgtgtgaacagtagcggtgcccctgatgtgtggagatgtgccttgctgtgcaaaagattcaaactactgcagcaagtaacagatgatcacagagtgagaacaggagaatatgcaagcctcggcttgctggatcaagtattttgatgtacatggaaaacttagctgcttccttgaggcatttcgtgaagattgcccttgctggaattactagccttttactgtggttttcttttcttaatcttattcattccaacagaggggactcaattaggattctgaacgccctttcatcttttctttgaaataaaataagttatttgggatactttttagagcagctccatttgttttgatcgtggctggaattaaaggagtataaatacttgcctacagtcacatgcatccttttcttgatttgttgggtgaaagagagaagatttttactgccttaataagggaaacctggacaggatgctgactctgcacctgataaatctttccaaattgccacaggtgaaatgaaatgttaatatctctttcaattattaagaaatgtaaatagatcatgttgaaaatacgaggcactgaaaataaagtattttactataagtatagtttttttgtatttagttactaaagaattgcatttttaaagtttctttctttttttttttcagacagattttcgctcttgttgcccaggctggagtgcaatggcttgatctcagctcactgcaacctccacctcccgggttcaagtgattctcttgcctcagcctcctgagtagctgagattacaggtgcccgccaccacgcccagctactttttgtatttttagtagagacagggtttcaccatattggccaggctggtcttgaacccctgacctcaggtgatccacctgccttggcctcccaaagtgctgggattacaggcgtgagccacagctcccggcaagttttcttaatatattgaaacaaagagattattttcataaatcggagacactgcactaggggctttctatacttcattttattatgcaaatcagttttaattatagacaacatcaaagacagataaacaaaaggattaagaaaacctgtaatcctaccaccaagagacagatacatcggcactgtgttctttcagactttttcttttttttttgtatgtactttttttctttaatggacattttataaaaaccaatctgaaaattgctctgctcatttcccaaacataattcaataactataaacctgtatcgccattttaaggtcatgtaacctctcgttgtatgaatgtactataatttatttaatcaatttccatttgttaggtgttcaccatgattccagttttgcagtaatctaaaggaagtaagctattttgtatgtatatccattcttgcataattgcctaatttattttttacctcctatacattaaatttaaacacagtgttcctcatttcttcaagaaagggcttttgagctcttggttttcagacaattgtgatttttacctttgttttaggtgtatgagcaccaagatggcagcaaatcactgaagctgggtgactttggactggccaccattgtagacggccccctgtacacagtctgtggcaccccaacatacgtggctccagaaatcattgcagagactgggtaaatgcttctcttatgtttaagtgctatgcttgcaaaagaactagcccgcttcgagaataggaaaaatagtactgctgtgccctatccagacataattagctatcaggtttcttccactctttttaaaattgtattttattctttaacatttacagtgggagccattttctctgttttcccaatctgttttgtcaattactgcaatcttaaggcttccatttggtctttgttaaaggtagaacagaagttattaaccccagagtaaaaaatgttcagactaacagaaacacacagcgatggtaattaactctcatttggagataaaagaaacagacactgccgtgtgcggtgattacagtctcctgcagttatttctctctgctgcccttatcctccagtccaggtcccatttgggacctcttggggatccattgattttccgtggagtacaaacacccttaggcatcagggaccattgggaatttcctggtttctgtgtgcagaatcagatgaatgtggggagaagggtggggtagcctattccttactaagaccccacaatatgctaggcctgaaactcctttacttcttactcttccagtcgatggtttgattcccattttgcacttcaataaattgaaactctaatgggttagataccatgcaagctcatgattagttttagtggttgagtcaggatttgaactcaggtcagcctgagtcaaagactcctttggtaagaagccctatttcttaccaagggccataggcaggctctgaggtgccatccttaagcagaaggaataacagggtggggcactgaggggaggcagccctactttttcttctcattagcagtttcagtccacagctgggaatctaggtggcactctcccctgtgaccagttggagatagtttttcgaggttttgttttgttttgttttttgcttgtaccatagaccacaagggcagaaaaaccaaatagatgagaagggaatcccaatagggaaattcctgaggcgagatgtgagggaatgaggactttgctacttggcaaatttgaatgaggtgggagcccacatccatagccttgtctgacctccctcaggtggggctgcctggggcacagacacactttctactgggacatgctctgcttgctgctgggaggaagtggtgggtcttgaagaccatattggggaccagctctgacactaactgtgtgatcttaagcaaaattactcacccatctgaacctgttttctctcttctgtacaataagcaatacttgtcttgtccaacctacagagttgctaggaaaacaaagtacgatcatgtatgtcagtgctctataaattggaaaacgttctagaaataattattattcctaaagtgagggagtttatctcaagggtccatccttatctcagaattgttattactataataaacctttttgctgaaaaccttcatttactgatatttacaaataagtccagcaatgcattcctttgatttttattcctgcaccttggtcttttttaaaattattattttttaaactttttctttgaactctgtttaggtggtgggttttagtttagcgtttgttgttgggattgttattttgtttggttttatttttggcttggaggaggaaagtcattgattttaccaagctgcataatttgtccgagcctgaccctcctaactctaacatcccttatttttccagatacggcctcaaggtggacatctgggcagcaggtgtaatcacttatatcctgctgtgtggtttccctccattccgtgggtatgggcaacaatcttttattcagcgccgacaaagcatttctctactctctgagtgatccattagcccttcttgcacaaaggagcctgcagcaggaaaagagcacaagaactttacttgcaatccctgttattttttccctgttatgtcatgcatgctaatttatatgccttccatatttcttccccatatcattaaaaactcattctttctttttttttttttctttctggttttgagacagagtctctcttttgctcagtctggagtgcagtggcacagtctcagctcactgcaacctctgcctcccaagttcaagcagttctcctgcctcagcttcctgaatagctgggatcacaggcgtgcgccgccacaccagttactttttgtatttttagtagagatgggggtttcaccatgttggccaagctggtattgaactcctgacttcaagtgatctacctgcctcagtctcctgaaatgctgggaatacaggtgtgagccgccgcacccggcccaaaaactctttcttaatttaccaaaacagatccacattgacatttttcaatcgattaaaaatacacatttttacacatttatggggggaaaggaagggctccagtgcctaagactgaaaagatgtacactgagttgatatcttagtgctgtttttccttgttgtcgttcacctaaacagaagtggtgatgaccaggaggtgctttttgatcagattttgatggggcaggtggactttccttctccatactgggataatgtttccgattctgcaaaggtaggtgtccagtgccttcctcttccctatattctgtgtgtcttaacggaattatttttccaaatcattgtgtgcaaagaaactaatgacatcataagtatgatttctgtacacattttagttgtaattgctaggttttccaagatttcacagtcatcaagtcatctgttcccagacatcccaacaagtacttatcaagtgtctccatctgctgccttcatctctctcaggtgccattccagtgacattgctatagcctcttgctgtgccccaccctcgccaggcttgagcccagctcagatttctatatggcctgtggtttcacctctctcagctcttgacttaatgacttaatttcccagtgaagccttcccagaccatcctggttccaattgcatctcttaaaccttacctggcttgctgtatcctacttgtctgttttatttttctccagaacacttaacacctgtgtgtccatctggtgtgctatctaactacctatctctctacccaaaaaaagatagatataaataagtaggcatgtcttctttatatagttcatttccagactctctccactagaatgcaaattctgcgaaggcagggatttttatctattttgtccattgctgtactatccctgcctaaagtatgaccagcatactggtgctcaatgtatactgaataaatgaacaagtatatgaatgaatccatcaattaatcagaaggaagaaaactcaacctcaacgtaggttgaaatcatcaagaaagactttatggggaagctatgatttaagttgaaccttgaataatagccaggatttagaggcagagggggaggaaaacacaaggttcattgtttttatcccatgaaactaaaagatcagtccttaacatggatgaaggtgatggttgcacaacaatgtgaatgcactgaatgtcagtgaactgtgcacttgaaaatggttgaagtggtaaattttatgtatattttaccacattaaataatatttatgataaatcaacttctaagaaggctataaaaatcttacattgagatgtttgtagaccttgaggagaaaaaggaaaaccttttcattgctctttttaaaatttatgtctccgagtgctgacttaaatgtttaaaaatttgagaaaaatgttctcaataattatcttgagaaataattatcttttgattgctcaatgtttatgcctttgcttttgtcatgtcctgaatgtgagttccctttaaaagccaacccctcagacatgaccactttgtgtagaaaatgatgcatattgagtgcaagtctctcattttcttcaactgtccaggaagctgccagaaagggagtgtcagagaaaggcgcaggctaaaggagatgggacgatacagctgcagggccgggggctcttcaggaacctgtccagctccccatgccatcactgcaggatctgagggctcacagttactgacaaataggaccatctcctacacctccatagcacctgcaaagggcatcacacacagcagatactttcacgagttctgatccaagttagaaactgaatgaagaaggctgagtgaactctctccctcaatgaaattaaatcacccccttcccgagtggtactataaagcctgtgtatgtaaggaactggataatgcatatctaaccattttgtgacatgggaacttctaatccagagtggacaattgtatagcatactcatcgttaagacccaggtagagcattcctggtccaagtccatttgagctcatgaggaagttccattaatttcaggatgatgaaattgtttacctctcaatagttctatttttctttgtattgatttgtctggaaatttttcaagcaattgtaacatgtttctttagaattctttagctactaaaggatcaattctatcttgccacccagaattggggaaagacccaattctatgtctttcctcatacctttctttcaaacctaagtatgccgtcttgaaattagggggaaattttcatttttcctttcagctgctaaagtgaaattttaagtaaagtgtttttttaaatgtgacttctatattaaactaattaataaatctgtctttaacatgcaaaatgctagacaaagaaaggaatattaattccttaacttgtataatttcttttctattacaaacatttttatgaaaatgattctgatattaatttaatttttattcaaccacaagctatgtatttacaattccaagtgcttaccatttttaacttttgaaggtgataaatagccacaggtaagtggagttgatgtatttaagatttagagcttttacaaatgcttttcgaaactaaaagagaactcttgcatttgcacacatacagcttttcaccttaaattcagataaatggactctaacgttccccttcacaggagctcattaccatgatgctgttggtcgatgtagatcagcgattttctgctgttcaagtacttgagcatccctgggttaatgtaagtgactcgcaccatttcctttgttctctcctaacattccttttaaaaatcagttgcagattttctaatgttattgcctccttttgaaagtgttgtgggccaggcgcagtgtctcacgcctgtaatctcagccctttgggaggccgaggtgggtggattgcctgagctcaggagttcgaggacagcttgggcaacatggcaaaaccccatctctaccaaaaaatacaaaaaattagctgggcatagtggcacaagcctgtggtcccagctactcaggaggctgaggtggtaggattgcttgaccctggaaaccagaggtggtagtaagccaagatcgtgccactgcactccaacctgaatgacagagtgagacatcatctaaaaaaaaaagaaaaaagtgttgtgttccattttgttcctccccctcatatgtgccaggacagttacaggatcttatacttgttccacgagggcatctgatgtatccattacattttattctgatgagactgccttctaactggtgaggtgccagtggtctcaatcttctaccccgcaacctgctttctgcggtccagattagagctgaataatcatcaagaaggcataacagactttctgagtcagtcctgctttttgcatgattcctacccaaagtgcaagtgacctaagggtttcgacataaaccttgggctactccatttcagcacttctcaaacttgaatgtgctcacaaatcacctggagagcctgttaaaacgcagattctaacacagtagattggaggctctgcatttctaaaatctccccgatgctgcctctgtggctgttctttgagtacacgggtctaatgatatttcattaactatgaaggaattctccagagcagagtcattattttttaattctgtgtttctctacaaccgatgggtgaaatttgttttgattaataatactcatagttggctgggcgcagtgcctcacgcctgtaatcccagcactttgggaggctgaggccggcagatcgcttgaagccaggagtttgagaccagcctggtcaacatggtgaaacgccatctctactaaaaatacaaaaattagctgggtgtggtggtgcgcacctgtaatcccagctactcaggaggctgaggcacgagaataacttgaacccgggaggcagaggctgcagtgagctgagattgtgccactgtactccaatctggacaaaagattgagactccatctcaaaaaataataatagtaggctgggcacagtgactcatgcctgtaatcccagtactttgggagcccaaggtgggcagattacttgaggttaggagtttgagaccagcctggccaacatggctaaaccccgtctctattaaaaaaaaaaaaaatagctaggcatggtggtatgcgcctgtaatcccagctactcgggaggctgaggcagtagaatcacttgaacccaggaggcggaggctgcaatgagtggagattgcaccactgcactccagcctgggtgacagagcaagactctgtctcaaataatagtaataataataatgcttgtagttaatactgatagaatgcttaacttctagagtctgccagaagtattttaagcatcttatataccttaactgtgttgtgtttgtacttattgtgttcttcccaacaacattgtaactttgtaatctagtttctatggtaatccccactgacagatggggaagctccatcactaagtctaatagttcctactgccagaatagaagacagatataggcttgaatatatatatggacgtggtcatagaggtggacaatcataaaattgtcagctcattgatataaattttaccagcctccctactgcactgaatcatctggctgtacattgaaggccacaaaatgttccatttctctgaattgccaccttggtgagtagtcgagtgatttgttttgttttgttttccaaaacaacaaaagcttgaggtcaaggcatgattgaaagcacagtcaatgtgtcaggtgactacatatggggggacaagaacttgggatctcattcatgttgtgccactagatggccataggtctagattccagcattctacatgtctgaatgtgattcttcacactccactgggaggttatatacaaataacaggagaatagacttgaaaatgagcatgtagagctatgcactgaggtttgttttaaggcttctcatatagcagagttttctaactggtgtacagacatgcaaaaatagtaatccccatggccctagggacagggggctgtacagccagtatccaggagtggtcacttccagcctcaacaacatctgcattcaccccagggtgctaagcaaaagttatccttttctatgaagctgaaaagattaggaagcatcttacttgagcctcataacaagcctacaagataagcaggatgggtattattgtacccattttacagatgaggagactaaggctatgcagggtgattttctcaaagtagccaagcttgcagttgagccagaatttgcagccagatatcctcactttcaccccaggtgttttaaagtcccatgcatcacattacatctaccccaccctttgttacacatgaaaacatggtaatgttgtaaacaggcaggtacaatatggacattgtcatcactgtaatgattgctaatacaagtcagcaacctttccaaactcacttacccaggtcatggtacctttttcttagctgtgcggggaggaagaggcacaagccagctgcaggctctctgggtggcagtggttggttctgactgatccacatgttaatgctgtatgacaaaatgctctgattcctagtgccaaaggttcaattcagtgtatataactgaacacactcatccatttgtgctacttttttttaatgatgcttaaagagctcatcctttgcaagtcatccttgttgttatttaggcattttatctttgctcaaattgttgaagaatggtggcttttttcatggtttttgtatttgtgtctaatgcatgttttaacatgatagacgtaatgcgttgtgtagctagttttctggaaaagttgatcttttaggaattgtttttcagatcttcaataaattttttctttaaatttcaaagaaaaaaaataaaagcttaccatccataaattgtcaaattgcatattagctctggagaaactgagacagggtgaccacacagaagaaactagacaatctgaatttgacatgtggccttaaaaggctcctgaagagccatagaggaaagatattcataggtgacaaataatcattttactttttttttttttttttgagacagggtctcactctgtcacccaggctggaatgcagtggctcaatcatggctcactgcagcctcgacctcctgggctcaggcaatcctcccgcctcagcctcccaagtagctgggaccccaggtgtgcaccaccacaactgagcaatttttttgaaaaattatatgtagagatttctaaatacatttttatcagagagacactgtgtgccagccctgccttctaggaacaaagtctgatacaaccagacagttccagggtagtgagaacagcttccccagtctgctctgtggggagacttcccagagcccagagaaggaggtgccagagctcaatcctggagaagactgggaagaagatatctgacagtcagttccagcagaatgtgcatgtttgctagaagataactttgtaaatgtgagcaaatttgtttatatacatgaggggtctggaatgctgttgggaacgacatgaatcttcccctgattccagaccaaatggccctatattaataatatcccaactcaactgtggtaaagaaacaaaattaagaaggcttctggctgttaccagtgaaaaaacaggttgctcattatggcaatatatacgtgtctcagcagtaactttctgcctcttctacctggttttgtgcacagttttacacatggtcccactttgctgataattatgttccattgctccctctggaccttagacttctgctgtccatttcagtttttcctctctgatttcctacaggcattttctaaaagcagggagagaatttaagtaatcatctaggagatcgaaaactaaaaaaaaaataccctttctgtaattcaaacagacttaccatcctagaaaaaaaaatggtcttaataaaagctttttaaagactcgattaagtgagtgcttaacttttgaaattatctttatgaagtaactaaatcagaaaacggattttttcttcatctgaaaataatcaattgttaaaagtaagctttcacaatcagcatttagcatttgttgatgtctccaagtacaacaaatgaatggccaagcaaatgaaataaataaattagggatttcaaagaatatccatttagtaagacattttgcatttggcaatcaaattatatctgattaccacaaaggagagaagggggaagaaaagtactaataattatgtgaaccgtaaggacgttgtcaaaaagcactttctctgctctcattagttctaattttctctattgcttataccatgacttttttacttggcatacttggaattgaaaaggcagtcttggccgggtgcagtggttcatgcctgtaaccccagcactctgggaggccgtggcaggtggatcatttgaggccaggagttcaagaccagcctggccaacgtagtgaagccacacctctacttaaaaaaaaaaaaaaaaaaattagcccagcatggtggtgggtgcctgtaatcccagctactggggaggctgaggaatgaggatggctcgaacctgggggcagaggttgctgtgagccaagtttgagccactgcactccagcctgggtgatggagggagactctgtctcaaaaaacaaacaaacaaaaagaaagaaagaaaaaggaaaggtagacttatataaaatagacagtaaagcatagggcagcagaaaggaaaacctactccgcaaaagtcacttgttttaacctcatccaggagcttcctctaagttcacctttatttttcacacgtcctgggtccaaatcccaccatgctctgccgtattcttgccctttgctctgttgttgaaagagtcatgagcgaggcctctctatggatggttccaatgagccacatgaacaaagccatcgtcagtaagcagccacgtctggaagaggaatgtagacccacgggaggagcatcagcttactcacctgtgtgaccttgggcaagtcttttctctcctttaaacctgttttcctatctgtgaaatggagaaaataggattctcctctccacttgctataaggatgggaaaaggatcatatagttgaagagtctgagagggcaatcttaagtcctagcaccttgtaggtacttagcaaatatttggtgaatttgagtctgagccagatgacaactgtttcatccattgctatgtgctcatgaaatgcaaattgtgattaatgttggtgaatgagaagcttgattaaggaagaaagactgtcatcccccaacatgatcctgtttgtgtgtcacagatccagatagataatatgtgtatcaccagctctgttactttctccagcatcacagctactttgtttaatgtagttacaaaataccaacaaaattatcccaactatgtttccttaccctattacccatctagtggagaacaatatgatttaggcacatttattataatataagaataaaataggcaataatatatcttgacctttccaggaattagaaagggggttgagtcactttccccacaaatgacggtttattgatagaaaatgtaggttcatgataagttcataaacagaattgacatttccagaaaaaaattcttatatataattaggatcaaattatcatcattgtgatattttaaatatattgctgtcattccatttttattttcaaaatgctcatctaccttatcccgagttattcttctgatactctaggatgctataattttatgaatctatgttttacatcaaattattttgccaatttaatagattaaaaaaaaactgagggccgggtgcagtggttcatgcctgtaatcccagcactttgggaggccgaggcgggcagataacctgaggtcgggagttcaagaccagcctggccaacatggagaaaccttgtctccactagaaatataaaattagccaggcatggtggcacatgcctgtaatcccagctacttgggaggctgaggcaggagaatcgcttgaacccgggaggcagaggttgcggtgagccaagatcgtgccattgcactctaacctgggcaacaagagcaaaactctgtctcaagaaaacaaaaaaaaaacaactgaggctcaagcctgaagcccactggagcctctaatacaggtctgatgcctgggttttgcccccagacattctgatttaattggtttgcactggcttcctggcatcaggacttttaaaagctcacagatgattataacatgaaatgaagttcaagaactttggtactagcagaacagactggtttaaataaatcaaatacagttatttagccaattcaagactttctatcaccttcctggcctttacactttagtttacctcctatatcccacctacatactcttttgaaaagattctgctaagtccagatatccaaaaagaaaaaaagaacaagggaaagaagaaaaaatagaagcctggataatctcccaagatattccatgttgactaataaaactcagccctacccacacacacaaaaatgtaaacattcatcttattgtgctggtagaatttgttagcaattaagtgaagcccaatgacactgcaataatatataaaaccacttattgatattcacaaattttaaacgatgacatggaattgcagtttccatatgggcattttatcctgtccttgctctaagataaatctcaacttgccttacattttctcccaaagtgcagtgtgaattgtagacagagaatcatagggccatgctgaagagagtcaaggggactgggggtgccgtgcaggtggggatggttaacaggagtcaagcacactgggaggtgcagcggaactgctattgaagagtcctttaataaccttggaatggttttaaactacgtgggaatattttagcagtaaactgctcaagactgccatgcttctcctgagtttacagatattaataatggagtctggcaatgaatagactgcaaaccagatccatgattcaaaaccaaaaatccgcaaggggatgagaattttttaaagcatgacgcctgaaatggtttcccagaggaaagcgaggaattctacactacagagtgacttcacatccgttcccccacaagcctccccacagctcttccccagtaacccctagagaaatggagaccaggaggccaggtctcctatggacagtggtgagagttcattttccattttgcaaactaattttgttcgtgtcagttgcaatgctctgccaagtggtggatgggaatttctaaatcaaaaactactaacctcaaaccacaaccagcctgtgtcgaacttcagaaactaccaccaaaccagaacgtatggtaataataccgtaactatttgtaaaatactgccagatttgtcacgtttagaaaattcgtagcacatttttggcacataatctattctgaataatggtgataaagatgtatatatataaatttatgtttttaacgtccctatttattttattgatgcatgacagtaagttagctaaatctctatcatccatctgtatggcgcaggtacagattagagccctgcaaagccaattgtttaagtctttttatccaattatgctgaaaaccttcaaaatttatataaaaacactgcagactttttcattgtcatggggtgtgtgtgtgtgtgtgtttacatgtatgtgttttacctactccagctgagacaccttatttcattggaaaaaaatcctagaacgttttaagatttatgaagtcaaaagcctctctgacaacttgtttcgctacttgcattgcttcaatgtgaactaataacccaagggaagctcaaaccttcactggaatttaaagctggaggccttcacctccaggccccagtatctgaaagagttgctaggaaccttgacaggagattaggaccaggacagggctgggaaatgataaggaaatccattgtgaggtggctggagagcaaactcctagctcaagaactggcagtggagggaaagccaggtgaaggcaagtttctgaaaagatgccaatggtggggagtgaaaagaaggtggggttattcagcaagagctgaatctttctcagtaagttaattaggggctgctcttacgaaaacccagctatctttccccatatttacacctaggctggtaaacacagcctgtgccgatcatacggcaaccctgttggctccgtgcaactctatgctgcccagtgtcagccaggccttgctgcactgcttgctgcacataggatcctagagtcccggccctaataggtcacgttgacacatcccagattagtggacacccagtctccacttgacagagaatttctaactgtgttccactgggtccctgaaatgctcagcgtctcttttattgaccaccagatgattcccaggctccattaagtcgtgtccaaatattctctggtttgttcagcccctaattcaattctccttccgcctcaccactgtgccactttcatcatggaaaagatgattcactgagtatttccatttatcagttaagcagcccttttgtagctgatgccatgctagtgagcatcctcaattgatgcaacctggtgtgggaaaaagaacagagtttcaggcctggttcaatgctgactcaaccactttctagctatgtgacgtggagcaaatgaattcaccttgctgagcctcattttgcccatgttcaaaatgggactaataaatggactgaagtttgaggaggaaagagatcatacatgtaaacagcagttaacacttgtgtcaccttcctcgccctgccgtgctcttctaacttccctcccccgcacctctgctcgttccctctttgtttcatctttgcctcagagaaagaggtaaacctatacctccccaaggcaaaccacttcacttctaccctccgtccctaccctgccctttctcgtatctttcaactctcccttttcactagcttcttatcctaagaccacaattatgctcaagtttctttcatcctaaaaagaaaaacctttcctcaaccttctccacaatcatgtttttcaaagtatctcatcattgaaagctcatttgatcattttgcccgaggtagcctggaactctacaaagagatggtaagaagtacttgtgtaatcttgggggtgaggccagtagagcacccaaggtggcccctttcattctggcagaacccgacactctgccaagacatgatactaatattcagaagactttcagtatcattttatcccttgtcaaatgtggaaaaactgtcaaaaattctaacttagttcccaaacgctattgtccaacttaaattccaggggccttttgtttcattcaccagttgttgttggttttttgttgttggttttttttttttttttttttgagatggagttttgcttttgttgcccaggctggagtgcaatggcgcagtctcagctcactgcaaattccgcctccgggctcaagctattctcccgtctcagcctcctgagtagctggagctgggactacaggcatgcgccaccatgcccagctaattttgtatttttagtagagtcagggtttctccatgttggtcaggctggtctcgtactcccgacctcaggtgatccacctgcctcggcctcccaaagtgctgagattacagatgtgagccaccgcatttggcctcattcaccatattaataaaaacattttttatatacaccattcaattcacccttgtgtttagaactctggacgcataatcctaattctttgtaattatcatctgatttctctttcacttgtagagtgaaccaagagctggataatgtactataaaaataccacagtaaagggaaggtagtccttcacatttcttaaacttacagtcctcttattaaaaagctctattcctaatggagatgaaggcttcaattctgggatcttttgggtattcatttatggccagtcttctgttttttcagctttctctgccattaccatggcacataaactcttaactagagacaaactgtttgacttcttgtttggcagagatgactttgtggcttcccacttgcacacaccgcacaccaaatatcaccacacctcctctctgcctgtcaacacactctccatcattaagggccaggtcaagtcccatatccctcatgacgtcagctgtaactgttcacaccagaaaatatgccctttctcctctgaacttctttggtgaatctagctgagccatccagccatgcagccttgtaacagctccttttaatcttgttggcctgtttcatgattttacatagtgtgtgcatgttttgtctcccaattagcctgcaaggttctggtggacagagatcacatcttcctcccacactctgctattcctaacatagcccttgacaaggtcggcacttcatgtggccctgcttctgttccctccccaagtagcatccccactctactggaatttcactttgtttctaacaccaaaaaaatagaaatagtgcaaattgatataatgaaaaagcactgggggtttccagtaaagccattagaatggactgtgcttaacttggggataaatgccttggaacaggcccgttagacccaagttacgaagaaaagaaatggagcagagggtctaggagagcagggcccatgcctgtctttgctcgccatcgtttctcccccacgtactgtagtacctggtccatgtaggcatgcagttaatgtccattgaataagtgaatgcccaaatgctgaaagaaaaagcaaatgccatgtggagggaccagctcgtgcaaaaggagccagcacattatgcttgagaaacagcagacttattttcctgggtggaaccaagaaattacctgcaaaatgatggagaggaagaagaaaagaaaaataatgaatggcatcgaagtgattgccaggagtttctttttagcagtgagttacaaacactctattatctgttcattcatttattccacaattgagcatctaatatgtgccaaggcactatgctaagacctggagattctatagtgagcaaaacacagtctctgccttgaaggatcctgcagccttttcatcatgaactctagtaagtggtggcacatacttatgaccctggttattgtgattctaacagtatttagtacaagagaaccatgtgtccagcctcagtcatagatggctccagcagagaatagagaccttggttaaaataagctccaatataaactatgtcataataacagatgatttgaaggcagcaagaaagacttaaaatttaaggaagatctttctgcctggaaggctgcctggaattttagaatggccaaatgagtaactgtggaacagcctgagtttatttatgggccatgcagaagcccaagcttgccatccaagacccttggctttgggtctaaatgatgggttaagaggaaaaaaaaattaaaaagaagatgttcacattgaattttttttctggtcatctagattaacttgctttttgacatgttcctagagccgtggttggaatagattttattagaaaccaaaaacagaaatttttttttttaatttagagacaaatctctgagggtcagatgacacaaagcaaattaattttagagcagatgtggaaatgaatgagaccttggagcagtacttccaacaatagtgtttaatgagtagacattggttggtttatttctgacatcttatgaattctaagatcactgcctgtgactagaagatttagccttcatttttcatttatctcattttctttctttttctcttctctttatttctttttctccaggatgatggcctcccagaaaatgaacatcagctgtcagtagctggaaagataaagaagcatttcaacacaggccccaagccgaatagcacagcagctggagtttctgtcatagcagtaagcatctgaaatatccacctataactttttttaaagcaacccacctaagagacaggcattactcaggagattctccagtcagagacagcagaatgggtcatttctttagacagctcagccacttaatgcactagaggaggtatgggacttatatatattatgtgtttctgcagatcatttccctgggcatcacatcattatccaacacctccagggtgtcttgcagtatatattaattttatgatttatttatttaaaaccgaaaacctcccccatgctggactctgtgccaatgcaaacttcttggctctaagaaaaagagttcatagtgtccttttgctaggacctagaaaggaaaggcaagctgagagagacgacattgcagggagagcttggaacactatagatcttgatactagacctaaattaaagtcaaagcatagcagaaagctacgcagtgagattttcagtgaaattgaattactgtgaacacccaacgaagtcacgatgtcttgctccttagaaatttctgttcttaaagttgaaagtcttttaacatttactattttattgatgcgtctgcacaaggcctttcttttctgttctatacatgcagacatacactacatgcaatttgatcgcagctctaggcaaagattaaattgggccgaggaataatgaaacctcatacttcctggtgtcatattctggagtaaatatattcaagttccaattacttgagtttttaataaattcctctttttttcagagtgtgtaaattttaatagcatattcaatctgaaaatcacttgagctgtttttcttctccaaacaaagaatttaagacactatgatgtggactttttcaaaagtatttatgctattaaacagcacctctcactcatgagcagtactgaatatttaaccacttctctgggtgtttttagtttctttcctttttttcttttttggttgcgcgagagctctaaaaaaaaactgaagataaacaagtgatctgtttgatgccaccaatcccagatctgggttactgagtatttgatatgaggttccagaatttgcaaatggtacgaatgcatgcatacacaccctcgtactgtttgcatttcgtgtttctcgattgaaccctttcaatagtgatttacatgcgtgtgagcaactggcacatgtgtaaagtgaaagggaatgcctactcttccagatgttcctcagtgccgctgaagttttaaaatttcaagttgttcttgccctctatctttaattctttctgagaaaattcaatgtagaagtaaattaacctttacatcttccatagatggtcagtgttctttgttctgagctgatattcagtcagtaagttttgaaagcaacaatatcatagtgattctctactaaaccagacattctatactctgtttccattgttcgttcaagatatatgtctattccaaacatttgattccacagttttcttttggaatggactgccagcatgcttgtccatgaaagggactgtttttctcctgctaagggcttacagctgctagagagagtgcctttccacctctgtcattttgcttttgttttctttttttttcctggtcttttattttaatcagtctttggttaagtttgccttggttgctcaatatttgtttgttcacagtattctaggagtcttacaatgactaagggcaggaacgtcagggcaattttccaattgacaaacaccacatatttgaggggaaatcctattttaatcaaagttggataaattctgaagcgttatccatatgaattcattaaaacctcatctagctggatcttaaaacactcattagtatttgaagatcaaagatccacttttttttttcctaaatgtcatgattggaccactttgaatgcaattttgaatgcaagtttctcaattcatcactaacacggtttccatggaaactgcacaaactggtaatatacttacaaattgtaaagtgggctgtgtaatgctgagttatgcattggttgcatgcttgtttaatctttactgctgcagaggtttttttttttttaataattatcaacttaattcagattcaaaataattggctggtttcagaaaactgtatcttaaaaaatgcctgtcagatctatagcacaattcatatgttaactatcagcattaatatttcaagcataaaagagaatatcaatgtagatttcagagattgttttaagagaaactggtctaccatactatgtacatgaggcaccttctccagaatgcttttccctcataaatatctctaccttctagaagaacctggctgaggtcagtaaccaaagggtggggctgggaattagaaactggctattttggccaccttcattgtgatactttcagaatagcactggatacatccaattatattgcataaccattttttcattcttaaaatgcaaaggctgactatcaggggactatcacaagaaaaagaaaccctggcattaaataatattccaaagtatgactgccaagaaagattattctgctatgaagcaaaataagtgggaggtagaagaaaaattttttataaatggtatattctataaagactatttgataatttaataatttaatataatgattaatttgctcacatcattaaaagttcaggaattgatataatacagtgatgacttctctttgatagatttacaaaaactggtttcagcataaatttcattcaaacagaattttcctaggtatatacgctctccccagaggctataaaataatgtattttaaaccgcctttaccatgggactaattttttagaattacatacaccctttagaatgttttaaaaattattatttaggacatagtgttagtttgtggtttggtggcagttggggaatcaacaattaaataattaatttttaactagtacttctcattccttagttagaaacctaactacctgctggagatcaccaatgctcatcagagaatctgtgacactctttctttcttagaatgacaaaagaaaaaagcatactgtcataaccggcagcctctctcacaggtgtaatttatgatatgagagtagtttaacatgtactcatgttctgaattgtagtgttttttgttcatgttgtcatttttttcttctgcttcacagtctgtacattattaggaccaaagaaaggacaaatgacaactttatattaaggtcgcaagagggcctcgagttggctaggacagtaattaccagctggaggttcacagggatcacacaccctcctgaaggaggaaaggtgctctgacattaggtcaagccatgggattaggtggaaggcattgcattccttagaattgcagcattctgtgcctctcagagagacgccattgtccctctgctgcctttctcagtagttgggggatttgaaaaaaaaaagagagagagaaagggaaacaaaaggttattaaaatgcaatttatagacatgaaatgaattagagatgacattttaacggtgaactttttgagagctgagggaagagagagaggcattattagatttgctcagcttgatgaagaaccgatgactaagatgtcagttccaatttatttttcctcatttaacactgtttattattttaaccaataattttcctaatgctttaaagttcttcttttgcattttgctcatgcaaatagagcgtttcagtctaattgaacaaatccatactaatcagcatgcatataattgtgacactgggaagcttagttctaaaatgagacctgttatatgacactttgcctgtagatggcaatagaaagctaattactaagtagctgtctttgtggccaagcatacaccttcatcttcctgagagccagtatactttgatttttttctcaataaaatgaaacacacatttttaaaaagattaaaacttcacattgcattttatgcacacttggatagcctagtttataatcagagcacaaaatcctccaagcagtttttagtttaaatgcctggtgccctggcatgtttttgaaatgcctttgtgaatttagaagcagaaactgtcatcagcatcataccagtaacgcacttgaaagaacacatgagcccctctgaagaaaggtgtccaagtcgcatcctctcgtgggcagaatggggaagcgggtacacagcatgattagtgtccttcaggtttgggggattgaatcttttatccccaggtacccaaaagctaacatcttattccaggatgaacaactttgagaacttctcctgtcttctatttattgtactttgtgttaatcaaaagcacttaactgttcatatgcatttttattatacaaagaaaactattttttgttttatttcactttccatattttcatagagaaaatttattgactgttttatactctatcttcttagtttagaaatgtaattaagattcacctttaattagatcatataccttttataaaaaggaaaagaaaagaaaagattcacctttaagagtagctctgcttttgaagattaactcagaaatttaaatgctgtaattgatgaggtttcaaaacctgattcttttcctctttcatttcatagttatgaagccctcaaatttaagccttatgcggtaatactctatggggtccaatctgctttctcttaagtggctaatgctcatttcagtactttattgaattgtgaagcattttctattctatggcatatgaagaggtgtttatatcttttgaaattgagaggacatgattaaaatggtcattcaaaaacttgtttgaagaactagatctatttgagcaaattggcctccaaaatagtcatgaggtgtcacttcctgcctttttgttgtcagtatgcagacttaggatattagctagttaccctgcagaagaggcatcgtaactatatatacatatagaatcaatgaagaacagcttggtctggagtcttaattctttagcacaatgctgatccactgagttgccccatttctctctgctcagctggaccacgggtttaccatcaagagatcagggtctttggactactaccagcaaccaggaatgtattggataaggtatgagatggtgcagctcaacagtcagtgtttccatggcaacgtgctggcagtctccattaaccagttccttcggtggataaacatgcttttgatttgttatccagtccatatgctgctttatcagtttcattttaatcttgattgagatgccacaccccctcattcctttttttcacccattattcacactgacatttgccagctttctttccattgcacatgctcagtatcaattttccttatggttaaaaggacagtatatttagtgctaatgccaaagcattttcctgacgttgctaattaaaacaatgatttccagtgctcttctgtcccttaacaaatggaagaacaatagcacgctagtgtgtgttctatagaagtatatactgtcattttaaagtcatcaagcccaaccttgacctgattagatggataacaatgcatttacaccttagtagtagaagcgcctcaaagtacaatgggctatagaatgcattgtgtgtgttggtaagcttgtgttttcaaattctccacctttttgttttgtttttgttttattgttccctcttccccctggaaatccctctatgtattagctattgcatgaatttatttttcaatatcttgtaactgtcagattatttagctggcttatctgctcaagcaaaagggattatgggaggtatcgatttttttaaaactgggttaagaattctatccaatcgttttctattccagtcaactgccctggcatttccttcaaggggcattgtttgtgtctctttaagttatccacaagcaggatggtttttgatggtttgagaaatgaactctgagaaattctagggaggctgttttcgccatcttaatgtttctgaagtgatctccaggtaacactccacatcttagtatttgaaaaaaaaaaaattccactggttttggcatttgttttttccaaactgtggagcctatctgtagtaagacagtagctgcctgatgttgtttcatggttagactgcaaagttttaccaaaaaattaaaatatatatgtatgtgtgtatatatgcacatataaagtatatatgttatacataatgtgtatgtgtgtgtatatatatatataatatatatatatgattttagccccaattgttactcctggttatttttctataatcagacactcaaaacatagtacataggaaagcagaaaggggcataccttgacaaatgattcagatatactaaaatcatgatcatttccaaatctgtttaaagcaagaaaacacccaaagctcaataaaattttctaaggtcattttgacatagaaggctatttgtgtcttctccatttataatgcatgtaggagttgcacattcatttatttaatttacctacataattggccttatggatgtagaaagaacttaatttttgaccttattttggagggagaagggtgagttaatcataatctgcctttgtgcagacccttcttttttgactttgtaacacagaagaggattcatccatcttttacttttacctgaaagaatatatacttccagaagagtgcacctatcaggaatgcacatctctataaattttcacaaactgaacatgcccctgtaggcagcacccagatcaggcacagaacattcctagcaccccaggggctcccttccaggaggggtcacttcacctcgagggtaaacactgaccctagagtccagccacattaattagctttggctggttttgtactctatagaaatcgaatcacaccatgctccatcctttttaaattatatgtctcctaatgtcaggaatattaaccagatatatatgtgtaaagttaatatacaattaaaaataggcatcaagtatatctaattatagttgtgcatatttgtgttataaaaattacacatataaagtcatctaatttcaaaaacctctggaaaattaaattactaaatttgtaggattaaggatgggaactaaaccccaagtaaacacaataattaataaacgtagccaactataaaaaggccatttaactaaaatcctagtgatggttcccatcagcagacaaaatgacacatccctgaataatgggcaggagcagatgggagataatctcttttttcttgcgcacataaagtgctctgttttccagctggggcagtaacaacaatgtttatagttagtgctgtactgaacagtgcacccagtatgtaaagctaaattggagaaatgatgctaaaaactcatcggcatatatgcttaattaggaagttttataatgccatttagccccagaacgtacacgctctccttactgattgcgagtgcttgccttttatctccgcagaagtgggagcatttgtctaaccatggtggcagccaactttctaacacaaacaatcattacaggcgagcatccctgctcccaattgttgtgtttaaagcgctcatggctgtttttactgctgtaagccgaacacttgggagtcgcgcttgctttttgtaaagcagatcacatgagggcacaggctgggaaaaccatctcctcagggtgcccagaattggtctgtctctcttaactggctttttggtgattgtagacaaatagtggggatttgttttcccctttctctccattctccagcctcataccagagagctgcttccaagggagcagcatccttcacttgacccacgcatccaggagactttgctcctgtcacccagagtccagggaggacgctgccccaggtgtgagctcactgggctattgcacactctcctgacctaagaagccaccatttccccctgctgcaagccactggagaacatttgcatcccgttatattttccccttcctggaaatgcatccttattcaaaggggacgctgtcacacacatttctaccttcccaagtgaagctgtcaccatggcaagtgctatgccctgtaacacatggagaagaatcctgcaccttcagcacacagaacagggcaacagctagaactgggtaacccgattaaataaaacaaatatcaaaacaagacataagctaaacatgagaaataagataaaatggggaggtgagctaggacaaaagggtggttgagttctcaggcaagatgtgactaaaatgtgcatattggattcaagcaccgtcctgaaacagtgagtaatgaggcagagcggtgatggccgcgctgtcatgctcggttgttaaaaggaatggggtcagttaaacgcatcttgctccgtgcaggtttgagaaaactgttcccctggaagccagggaggaacctccgtgtggtgtgagaagggatgtagggcccgcctcggccagaagcagccaaatgtacacagcaagttgcaatgcattgcaggttgctcggtggctagttgtcctggctttgctctgcagagtgagaacgccgtccccggggacagccagagcatggttggcagccagggcagatgctccacccactccagaggctccctctgtaacacagaatttgggggattcagtttaacacatcgaaaagtcatagatttaaacttcaaaaccactcaaactgtgattagagagaagtctcaggaaagtagttaggattggtcttgcagttgtaccttgtacccaagcatgagctattaggccataggctcaaaagatgagtgatactatgcctgttgtggcgtgaaggtcaccaagggtcattggaaagaacatgggaatggtgaaacatctgcattacatttcccaactcaaacaggttgctcactgaggttttattttcttttattttgttttcagaggccccttaagagaggattccaatgacatataagtctttttaaaatttagcttacttattactaaaaatgagaaaatgtcatggcattccaagtcttaatcattgagtgtaaactgaagagagattttaacattttcctaagattcctgatgattctagattgactgaaaattgtgtagtatcatatttattctgcccttgcctcagaatctctttccctcattttgacttaaaagtaaacatctatgctcttttctacatattcattcctgccatactttgtgaatgctccttagtgaggttcattgagaggatagaggctttatgaggtataaatgcacaggaaatcatacataaagaacgtaattataagtatcaacacaccttttgctaagaaagggtgtaagtattcataggctgaaataaacaattctcaaatatatgtcagacacatgacacttttagaaattaaacagtcttggaggctgggcgcggtggctcacacctgtaatcccaacactttgggaggccgagttgggtggatcacctaaggtcaggagttcaagactagcctggccaacatggtgaaaccccgtctctactaaaaatacaaaaaattagctgggcatggtggtgggcacctgtaatcccagcaactcaggaggctgaggcaggagaatcatttgggcccgggaggcggaaatgcaatgagccgagatcacaccactgcactccagcctgggcagcaagagcgaatctccgtctcaaaaaaaagtcatggagattgagattcaattaacttaattaaagattggcagcccagtgtacagagagagtgtggctttggagtcaagaagccctgggtttggatctagtccgccccatttcctgcagtaaccttgggcgagttacattctctgtctgattttccacacctacgaaaaggtgaagagtgttatccaccttccaaatttgtggtgagaattaaattagctgcttgtgcaaaagtgctttcacacaccccagcccaaagaagaaactaaaaaaaaaaaaatttgctttctgtttccctcacttccaagagcaaatcacccactccacagattttcctgagaaaactgatgtctctccagagagaggcatttgttactaaagtagaatcataaactgttttaatgctctgattagagtaaaccgctcagtaatgtatatgtttatatttcttgtgagcatttgcggcattatgttttacctgaagtagctatagccaaaaattctgatgaagtataagtttaaaatgtgatcctctaggacagggcttggcaaactatggccaatgggccaaatctagcccacttcctttttttgtaaataaagttttattggaacacagtcacacacattcatttacaaactgtctatggctgcctttgccctacagcagcagagttgagtagttgagtcagagaaacatgtggcttgcacaacttaaagtattaactatctggccctctccagaagagttttccaacaccctttctagggggaaaatatgtctaaattaaaaggcaccatctgtacaaatgcaaattccacaagaacaggattagggcttgttaaaaactatgtctccactgcctagtagaagaggccttcaataaatatttgttaagttaacaaataaatgattgaactctccgaagaagggaccattttttcactgattttttcaggatagacatgtttttgaagaatttgggatacatcaaagtttgggcaatcaaatcacatatgagatgctctaaaataacatcccacttttagcaatccaggactaagctttttggcaaggttaaaatggtttctgcaattaaaggaactatccctgacttacttgctttgtaggcactaaattttcatagattttcttaaggcagactgtgcttttggttcatgtttagtttactgatatgatggagaacaaacatggcaattccgctgaggttgggctcctataagaaaatcaggggctgtcgggcagaggaagcacacaaattttgtcctgagctcaaccgccaccaattggctgtaattttaactgtctgatgggaggccatcagaaacccactgcagagctaggccaatttaagactctattaagaaccaggtcagcaggagaagcctatgtttaagattagtagtgcagaagcataaggtcagctctcccaggaaaatggggaataatatttaagatagtcttgccaagaaagtaagcagcttggaaggctactcagttgcatcccaagaaggcctccttttgccattttgatggtcatctttaagaaaagccatgccctgtcttcagatactgtgtcatttctggcaagacctcaaaaggatatgaaagcaaaacaaaacagaactgcaataagcctgagagtaagcccaataaaatgaggagggtggatatttcaatcgatttgtcagtttaattttactagcaagcaaaacatttccaaactgacaagcaaatcgtaatgtagtccccacagagtaagggtaagcaaaagaaagggttcctgagattaatgtcccagcagctgcatccccagttcagtctcctaggtagcatgaataatggatgggctaaaaggcaaaatgcacaataatgttcttttattaatgaaatgaagactatatgtgatggctagcaataaattaagaaaagcaaaaaaggaaaagcagtcaatgtttgcctctgaaaaatgcagttacttaaatccaataattactgccatgacagaaaccattgcctcacaatgaaagtgagtacatctcttgtgaatcctgcaagcattgcggaacagaaacatgtttggtccatagactgtaaggcctattgtttgctaagagaaaaacataacccattaagtagattgatggtgatattaagaatattcatagaatttcataggtgaaagtttccctagggattatgcacaataaccccctttcagtctatggacctggaaattggggctcgatgtggttagaaaacatgtccaaggtcacataattagctgaactaggacaaaaagctaattctcctgacttccacctactgctgcttccaaggggattaaacttaagctaccagacaagacaagcatagagacgtggggtgactcagaccggcaaaacctaagctaatgcttcaattcatgttcttgattattcctgaccttcctcctctatgctatgtttttcctttaacgttagacataccagatgggtagttcatatgtctttatactgattttcccaatttaatgtcagaacgaaggatttaaactatctgagcacatgtggaggatactgtcatttcattgtaacagaagaggccacaggccaaattcagtagatgtatcctttatgggaataaatctgataataggcaagcactgtcttttatttatgtatgcctggtgttacggcaggcaccaacacgatggggatggatttccctaagattttcagctaccacatgtgcagccacctgagttgctgagatagctggcattattttaccgttcctctgctttcacacttgatctagcatctgctaagggctttgtgataagccagggcttacagattgtggtaggaatatgcggtgtttcttctggatagggcaggtttatattagtccatttctctataccattttatttaatcaaccatgtgttctctctttaccagcttcccccaagccatcattactcagctctcacccagtacccagcatggcagtcactattgtgcacatatctgaagtaactaggttagagctgcatccttggttaccactggtcaactccagaatctcaagagatttcttgcttacctctaacctgtgataattagcaccaaaatgtgataatgcactcttcagagtctcttaggatctcttagtgaagtggtaacttactaaggaaacacttgggaattctactgcaagcctattcatgtaggttccaacaaagctacaaactgtgaacaaaataactaataaaataataaatctgttaggaactcttaagtgttcatggagcctcaagcctatacctgaggacatacttaatttacaaaaataggcgttctgaagagaccctatttgcttgatgtctggggatttttttgtgattgataaagagtaaagctagccatacacacacacacaaaatcaagttgactcttgaggactcccctgcctaaaaaaatagtaaagctgccttttagaaatggttgaaagggctcacactctgaagttgtgatgcaggatttcagaggaacaaattatgtttcaaatgcttttttttttttcaggggcggggaagaaattttcaattggattacatgttttatgagtataccttgtaaaaattatatattagcctacagtgctatttccttggtaacttcatctgtcccaaactgcatatatgggctacagaattcaattggaaaagatgaactgcatatattttagagtcaagttaattttgtagccacaaacttctaaacatcatacatgacagtgtttagtatgataagaaattagaccacaataaatgcttgtaggatgagtgaattcataagagaattttaactttatctgacataagaatttggtcatatttgaagcataagttatagtcttaaatattgactcttaatactttttacttcttttttgtgttggagttgctttgaattctattttttgctattgttattattcagaaagtatatagtcccctaaaataatgccgtattcactaagaaatgtttaatacacacttaatatgtgtgccacagtctactaatcatctggaaaatgcaaagaagtttcaaattctaccatagagtagttggcaaggtatttggggaatatgcaaagaaaaataatagaaggtcagtgtgcaattaattcccaaaagtttggtcaaaacaattcttgcctaaggagtttaggaagaaaatatatggtacaggtggtaaaatttgatcaagtcttcaagaataaataaattggccgggcgcagtggctcacacctgtaatcccagcactttgggaggccgaggcaggtggatcacctgaggtcaggagttcgagaccagccaggccaacatggtgaacccctgtctatactgaaaatacaaaaattagccaggtgtggtggtgggtgcctgtgaacccgggaggtggcggttgcagtgagccaagattgtgccactgcactccagcctgggcaacaagagtgagactccgagaaaataaaaataaataaataaataaatttgagtgggcagagagagaaagagaggtaatttcatgttggcgagtaccttgaaccaagaggtagatgtgagaatgattaaagtacattcagagatacatcagtttggactgtttttatggcaagtgaagaaaaccaaaaccaaactggcttaagtgaaaaaggaaatgtattcttttacatagcctgaaagattcacaggttgagtctgagttcagtgatggatggatccagcactcagttaatgcttggtttcttgacatcctccaaccctgcctccctgtgttggctttagtgttggacttcacatggttcccaggatgggagaagcagctccaggcctgccagtctctcaaaattgggattcattataaatgtgaagttccagcaaaagtcttaccatgtcctattgatggggtcgggtgcccatcttgggccattcatgggtattggggaatgcagtaaactcaggcttactcctgagtcacaagcccaccccaaccctactcccagagataggagtagggtcaacttcatcaggatcatggaatgtgggagtgaggaggtatgcaaagggaaattaaggtatagttaaccataggcagagtaaacagatgctgtgcttgaaaatcaagtgtccagtaaaggaagacaatgagtctactgatgccataggatcattttgagtaataataggtatacaccctggaagtttttattggaagcacattgcaaaggctgggacaaggaattgggctttatgaggagctgtaaataaattggaccttgtagaaattgacctgacagctgtgtgcagaatggaccggaaggtgggtgctccagagagaagcagatcacctctattgtactttctcatatctcaaaagccacaaagtttttgaagagagagaaacagatcacttccattatactttcccatctttcaaatgccacaaagttcgtagaatatctactgtgtgctgtgaactgtggaaaacacagagacaatgtccaacgcttgaccttggtcctccaaagagtctacaaagtggtagggaaaacagttaattaggatcaattatggtgcaggcaggatgaacaacgataatggtactagactgtcatggaaacagagaaggaagaagttcctaaaatactttctctaagcagagtgggcgggggcccagaaggagagacctgtagtcagagacaccctctggaacatctctgagagcaggtcagttgggaatcctcaatgctggtttgagaatattatgaggacctgaggggtggaaaactgcacctctgtcatcagactcaggtctccttaggaatttatgagcatcaaaattcagaatgtgtacacgggattgtgtacatggtggatcctatctgctctacaaagagaagtttctctgatcatcaatgtggagaagccactgtcttttggtctttgatactacctgtggccaatgtctttccctagctcatgctggctgggaacagagaagggttgagctgctgggagtgcagtgactttaatttatcatttcaataaacttcagagtaaatgggaagaaactgcttgggctttgcacaggagaagactgagttctgttcctagttagcaatgcacatgggcaagtctctccacatgcctaggtctcagtttccctgcctgtaaagacagaacattggacaaaaatgctttataaaccctcattcaactttaagagtctgcaaatccaatagagacaaccttgaaccactcatgacacatgcccatgaccgtgatatatttccaagaatacgtgtcatgaggatcctggggatccatgcacctgaaagctcaggagcatttgtgcatgaggtcttatctacaaaggtgaacatttagaaagctgctgagtagggaaatctgtaggagtggccagaactgactacttcaacagggacaggggaagggctttctaggcaggacaagtaaggaagagaatataattgttcttacaaggatttgcagaaatgaaggtgaaagtgagcgtgaggggaccatccaagcatgggctcaatattaagtgccaccagcttctgcataaactgaattacagtatttgtggagaatggtgtatttcagtggctgcagccaagagtgtgaagtattgagtggataatggggaaatgaagtaaatatcaagaaggtgccagtgaaactgaaggaaagagggaaagtactgagttaaattctaatgtgagctttgtgcacattgcttttctatgacctgcagttacttgattttaaaacagtgtcttacatcaaattgtaaacaaaagaacaccttacatttctgggagtcttggctgtttagaaagcatttgcacatccatttctacctacagcaactctgtgagagtggaaaggtgcttcttatttaaaagatgagaaacctgggtggatggtcagcaatggacagagtgggacgcaaaatccctgaccacaaacctgatgtgcttttcttccccacatctgactgcctctgttcacaagtcagaattcattccaatgccaatgacttttttctttctcaaggaggtagaaatagaaagattttttatggccaagaggtgtttatattacttttggattaactacaaaatgctttttatgtaagacagactaaatagacgtctgttttttttacaaacattcaactctacacaaacagaacatttcagtttgctttgaaagcaaaataccatgtgtcgtaactttacaatgttttaaataaagttaggaatttgggtttatgatactgaaaatatcataaaatcaataggtttaagactaagaactatatgaggatccttaaaaattcaacaagaatcaaaggtagacgtttcaacagaccagttactgaatcattgtattaacaatctagtgagacaagaagtgaattattgaagtttatcttcctcattggtttgtaaccctgttcattcagtgtgtggatagtttctgaagtagagcagttcagcctaacgaagccatttactgtactggttctacacactgcctctctttatctctttattacttcattttggaactttgattggcctattttagatctaagattgccctaatgctatactgcaattgtatgaggggcttagttttcactttgttctcagaaccaggctggctgtaaatttatctctgttctttgaaggagctaacagtaaattttcaagaggaaaaatggtggcatatatccctgtagaagaaaagtaatctcttaaaagcagaataacctccaggctacatcctttttaagggggattttcaaataagaacgccttcaacttttatatgtgttctatatttttcttcagacctcatacctactcttctgctttctgtgtaaggtttctctgtaatgaccccatttttcccccacacccattaaatctgtgatgaagtcatgctgtcccccattctgatgtcatgataacatccagagctacaggcagataacacatccggggaatcatcggaggtctcctcaggaaattgaggcatagagactgggagttggaatacctacaaaattgaatctcagtttcataaattaccaaatactatgatgaaaatgaactttgtaaagtgaaatccgtgggaaggtttccacttggtttaattgcattcaaagcagtgttcaatttcaggcattggtttcattaaaattaaaccaatccttcccagaaattcagccacactccctcatcaacagataataagatcatttagagtgaggaggtgctaaaagaacaggatgagccgtggctccgtttccatgtctgactgacaacttcatcacctttcatctgtattatgcagctaccctgagctgcatgttaattgaagttgcccagggagcatttttacacacaggactcaggcaccccttttcagagaaggtgggagtgtcctctggctagcctaggagccaccaagggtaaataaatgtgcagctagcaaaagtctggggaggagtggggaagggtcaaacccagtacaccatccatcctgcctgtgcctgcagatgtcatgaccaggtcccttaaagacctggatttgtggggagcagagggctccctgagagtggtgactgtcaacaaaaagtgtgccatgatggacaggtgaacttggccagtgtattttttctgacctcagaaagttctagaaagagtttgttttgccatttccctcgccctaattgtcctctttctcattttatgcccctgctagaccaccgctcttgataaggagaggcaggttttccgacgaagacgcaaccaggatgtgaggagccggtacaaggcgcagccagctcctcccgaactcaactcggaatcggaagactactccccaagctcctccgagactgttcgctcccctaactcgcccttttaataagacccttttactcaaagtcctagcttaaccctttgagactctgagatttttttcccccaaatttgtgtaaaacagtttcatctgatctatctagcgctcaatgcttgaatggcagaactgaaagtgttttcaggtatctttgtagcggtttccctttactgaataagatgacacgtggtgattgtgaagatggtaatttgctgctaatagagtcctcaaagggttaaggccaatttgcaatttttttttaaacttagaagcaatgaatgttttcatcagtcaagctaggatctgcagtatgtaatatagcacttgttaaccctctgagtgcatagaattttattgagaattcttgtttgggaatttttcaggcctttggatgtatacacacatgtttcttgattttactgcagatcaaggggtgttgttagatgctgaaatgtccagaaaagaaggacatttagaatgatatcttgtttgtccttttctgtgggtttagaacgtggcaggtttataacttcgacacacgcacggttctttcttcttcacaatcctattcagaaacagattttttttttcattagagatatgactgtcagttgcagtgagttctgcatcccaagtggagggaattgggtttgtggcaaagagcttgacccaggaaatagatggtgccccccaaattgtctccacatgaagatgtactgatgacgccccagaaatgctgcttccatatcagctgctgctagcgccagcgcagactctcagggagtcaccacagcttgtcttgtgcttggtgagtgagggtctctctactcagtgtcagacatctacaggaaagaaacaactggtggaaaagagcaataaattgcccggtgctctgcagggctggaatttcaaacagaaagagggaataagatcctgtgatttttctcacctgcttttccacgcactgtggtcatcactgtgcaatctacatctagtatgaaatccacacataggagagctggggcacaaggggactggaggcagttgctttgcaagatggctgaggagaaagcacactgggaacacaatccagaatgttctaacaataagttttcagtgaataaaccactggcaagacaattccatgtgcacctttaggttacctatatagtctcctaggaagatcaggatgaaagacctagatgatacccctgaggataaaacctccatcccctaaaatgattttttttaaataccactgtctttagctgtccaggaggtcagagtgttttttctgtctttgggccaagtcctgtctgagacctgtattttcactcttgttaccaaatctatctccctagtgcagtgtctccaggcctgagtttcttctggaacagattccattttagaatggggattcacaggttctgtgcatcaccacagtgctcagagaggattctcctggggtgtcttagaggcaggtgcccaactcaaatgtattcccaaggtttgctgggctctgggatccacgagacaaccagagagggatatctcatgaaatttgcatctggtggctgaacagtacctatgttctctgttttgaatatactttaatacctgagagtcttaaaatttgtgaacaacgtttctatagtcctttattttcaaatgcacgttgatcttcacttgctgcatttttactcttcaaccctgaaactatggtctacattaatatggatttttaaatcacatgtcattacttttgcaacaccatcaccaaaattttttgctcttttacatttaggttcatctctgtggtctgtgttgtcctgacatgtaaaaagcatatcgtttattgaggtttttttcccccccttttagagcatccggaagtgataacacgcaaaatcacaaagtagcataaatcagtaaattagttgagttgtttttgggggggaggtgggggtagggggcacagaacaccagaaagagtgttggtgtgtaggtagattccatattaatgaggaacactgaactagttggaaattactgctttctctagaaatataaagcaaagcactattccaaggctatggagtagctctacagcctggcctcaactctaaaagtgtgaagaatgcaatgggcagagacctacctgcagtggactgtcattttcctttctttctctgaattactgctttttctgtgggcattaactatattgctacagcatctagtgtactgagcctgcggtgcatggctcaggccttttcccatcgacgtctagggggactctggaccgtgtgaagctagggggtgtttctcagcacactgcagaagggcagctcagaagaatgcagggcccattcagcatggggatcccagcacatcactgtagaatttgagtgatctatgctgaataaacagtggaatgtgaccagtcaagtagaaatcttgagtaatcagatggaatgcaatctttctaacattaagctaccaagatcctgaatgtcagagatgtactcagagggttaacagacaagcacaaggcatgctgactacattggtgtatccagattgctttgcttttagccagtgctttctaatttttttctcgacattcttgggatagttcaagtttgaaataattaagtggtggtgttctttaaggaatttctataaccaaattgatcttatttttgatttcacttatcatagaacaaatatgtatcattatggcagtgtatctatgtaattatcaatttaatcatcaccaccggtgtttccatattttttcccaagtatttaatatagctctcttatggtggtggcctggtgatggggaccgtctttcttttactgacacatgaccaatcatatggtattttcaagggaattttaagattcatcttttcagtttgatagtagactagttaaggaagaactctttcattacttgcatcgtgtaaatcatctctgtagacatgtgttcatattaatgaacacattttttctcaacattgtagcagaaatcattttattcgtcatgatcaatgaatatgtgatttgctccagatcgttagaaggaaaagtaagatttcagtcatcaaaaatgtttttaccgtagccctcatctaacttacacgtggtgcatattaaaataagcagagaaaaaaaaatgtgaataaactactgaaaacacttggtgttttgtgttcaatgagaccttcctgcaacctgctccccatgggtggcagttaacaggcccatcagatattgttgaaagaaagcaatatatccatgaatgaaggctaaaattgcaatcctttaccctttgaggcatatttcagttgaaaacaaaaagaaaagaaaatttggcttagagggtcacagagctcccatatgaccaagtctcaagcacattaaatcatggttgtttactggccaagggcgtccactagacaactctatcccttgcgctgaagctcaatcgtgctgagggagagctttcttaatattactgtgttgctcttagcccttctctgggttaggatctgtcagcatttctatgataaactcctattctcaaaggtttttaatttgaccataaaaatgtgccccaggctgaagtttgctatacagggctgtaccaaagagtgaaggtttacttccttctctttccaacttcttccccattctccaaggaaaagaacaacaaaaaaatctggtatggtccctccttaatagtgatttcagaattttggaaagcaccaagatccaagatggtagttttaatgtagttactcattcgcacacattttttaaatttaatgggtcacctggcatatattgtagataacatatcttttctataatttgtaagtcaataatttttttaactgctacatgatatttttttttgcccaaagattttaaaagacttgaagttggtcagttcaaaactcagatttttctacacattgtctgccatgtccattaggagtttggggaaaatactctcacacagacccttactttgcatgcagtttagagggtaagatacgtgcttcttttggggataaagatttccttacttaattgtcaaatttcatggagccattctagtctgttggggaaaatagtgattaaaagcacttccaaaattaacattttttgacaattcagatatgataagaagcaggggaaaataatacactttactcttttcttgcttaaaggcaaacaaatcaatgaaacttgaggacacactaaacatttgataactgcaaatgtgctttaaaaattggttcaatggtgcttacacatgaaacggtaacaaatggggttcctaggacgtcagaaggaatctttagtttgtatgtaattacacactagaggaggaggtgcttttaagccagtcttttatttttaatcatctcaaatatgcaaccatacatgcagtaacattaagggtcgtaaactggtgggaaacaggaacttcagtggagaggcttaaatgcctctggttagagtgggggtttttgtttgtttgtttattgttgggtttcaacactgagcatcatttctgtgatcaagtttctaactggcatgtgttttgatcatgaggtttaccatatcttgcccatacagacaaatgagagatctagtttcattttgttccctaaagaaagaacactctctaaaattaaatcatacctgtaaatttcttcagcatttgtttctgttcaatgaaattgagacccttaatgttgctttaatgtaaaattgaatattttgtctgtgatatactttaataatttaaagtaagtaatagttctaaagtcttcactgttgctactaagagaaaatagaattttaaaggtgatgataaagatgctataatgtcagttcactccagtccaatcaaatgtagtaagaaaaagtccttgaatagttctctagggacaatttctcacttgccattgacattaatctttggtgtattctcagaaaaaataaaaagaaattgaaactggtccaaggttatagtcatatcctcgataacttttgaaaaaaaattttattaggaaattaatactagcctttttcattctggctgaaagaaaattattaaaggattagttgagtgtgaaattcaacagtattttgctcatacatactaaaaaggtgcgtagggact

SEQ ID NO: 12416 - DNA, 76985 bp, Human
atattcaaaatcaagtctcagaagaagagggctgttttattaatgggttatcattctcatcagtgaagttgtgaccactggtaaaagtctaactgctttctacaataaattcccagagaacatttaaaattattttctccaaataattgcactttaaacaatcaagaattgtgataggccaggcgcggtggctcacacctgtaatcccagcactttcggaggccaaggcaggcagatcatttgaggtcaggagttcgaaaccaggctggctaacatggtgaaaccccgactctactaaaaatacaaaaatgagccgggcatggtggcaggtgcctgtaatcccacctactcgggaggctgaggcaggagaatcgctggaacccgggaggcagaggtcgcggtgagccgagatcgcgccattgcactccagcctgggcgacagagcgagactccatctcaaaaaaaaaaaaaagaaagaaagaaagaattgttataacaacatttaaataagcgttacagggagaaaacaagctattgaaaggtaggcatttcattatctttgaaagttgcttttgtgagcctgagatgctgtcaatcaaagacagcttggcctctgttcatcttaagttcaacgtttcttccccagcggttctctaggcctttgctcggcccctcttttccttctcccctatccctcccaagtcgtccttcggctcctcagcacccattttccctgctgcacaccctcctgacaactcctgccctgaagccctgggcccgggtcacggcgggaaggtgagtgctcacaggcgcgagctcacgttaccaagttgggtcagcgtgcagagaaaagggaattgggaattggagggctgtaaaatgtaaatgtgctttaaattttacatttcctggcgtggccaggacaggctgaccttccgattacaatccgcgtcatcccgtcgcttctgcccccagcctggcgaggtcgggaaccgtttcccgcaggactttcattgggagttacgagggcgccctgtgcctggaggtggcgcgggctggagccctcccggaggagaccggcgcctggcagggggtcgtcgcggccgcagcctggacggtgtggaccccgggttctgcgacgccagatcggccccagcggcccgcacccgcaccctgcaagctcgttctcccctgcgggccgccgcaccgggccaaggggggctgtgtgcacgcagctgcgtcgtcctggaagtcggcccttctcgggatgccgcgttagtggggtgcccggccggcaggtgcagcggtgctggggcctaggcttccgcgtccaggaagctcagcgtggcctgagggtgatggatgtgggggagccgggaactcataccctcgcccagccccgggcaggtccccccccggaggggaccccctcttcgggtcgacccctactgggcgcggcatcctccccggagcgcccgcttcccacggcccctgcgggtggagctgcggccggagcctgaggggtcttttcctccaggtcctctttccggcgggggccggaggggtggtgatggacagcccgggaggggcggggcaggaccaggaagatccttccgagacggagcgcggggggcggggcggggctcgcgttaagggagcgcggaagggcgggacaggccgtggggcggggcctgggtggggcggagccggtgggggtggggaaaggggcgtaaccgggagggaccctccgaggcggagcggcgcaggggggcggggaaggcgggtcatggggcgggggcggtggggcgagtcatggggcggggacggggcggggcgtagccgggagggcccctccgaggcggaactgcgtggggggcggggcgggccgtgggacgggcggaggcgcccgagtcccgcttccccggcgcccttccaccccgagcccgactcagcccgcggccacctgcgccccgcccctgtcggccgcgcccgagcccagcgccgcgagccgctccccggcgggctggctcctggccccggaagcgcgagcgttcacttagcggcgagtggctccgtctccgcggacagagcgcgcgccccctggcccggcccgcgaggggctcccggcgcggtccccgagcatttcccgccgggtggagcgggccgagcccggcaggatgaccagccccgcggccgctcaaagccgggagatcgactgtttgagcccggaagcgcagaagctggtaagaggaaagcgcttccgaaactttctttcgtgactgcggcggggtttcaggggcttccagctcgttccgaggtcaatggcaggcgcaggtgcccgggaggcgtggggtgggctctggcgggaccccagcgcggtgggagcgggcgcagtgggcgcgggtccgtgagtggcccggcgagcggcgtccctcatgcgctaggaagcacgctttattgtgggacgccacctccaaggacgaaaaggcacatggtctctccccgcccgaggtgatgggctgcagacaggctctgaccaggtctgcgcctggcctggagtcacagggagctgctagtttgctattttacaaaatacagcatcaaggaccgggtggccagagccggtgccctcacccgctgttggaaccaccggggagcggctggggtgctttggagcactcaacccgctcagcacctggggaccacctccgccgaggactccagacgccaaatccactttggctagtctcccgggtccgcccagcgcggacaggatcctgcctctaggattttgccgttgtccagctcaatatgcagtcgtggggctacggctgtagtttggcattaaaattgggcaggggatgaggcggagagggtttgcaaatacacattttcatgcagcttgtggttgaacatgaatgggaataaaagtgaaagggtgcactttggaaaagaaatataaaaccctagctttccacttaatcaggtgttcgtgggatcttggtaaaagtatgagccccaaacaatcactctttcatcaggtagaaattaatcatctactgggtgtgtgtgtaagatttaagatgaatcagactgccttgaccttgggagagcttattaggaaatgccagagagaggtgtagaagtagagtctgatgaactcatactgaaaagccagttctttgcttgtcagatggttgctgttttttaaatgtccattttagtgtggtttttctgtgacttcgtttaaaactctggcagtgggccagccctctggagccggtttttaccccttcaactaattagttcctaggggcctgggaagagagacccttgaatcaccatcagggaagggttcttgaaagaaggaagggtgggaatgtggttgagcggtgccagtgttctgaggagcagcctgggacaccatagatggcaggaggaggatggaggtgaagagctgcctgctggacttagagtccttggagaagggaagagtaaacattgagaacaggatgtgaggaaactagggacaggctaatcagaggagtaggtagaggcacacctggagcagctaaggcactggctacagggtctattacttaaggctgggagcctcctgggcgggtctgggttcagatgacttcgagatgctgccgggaggaagggagaggaaagtctggactgtgtccaactgagtagttatgtgatcagcccaggcccactgtccctcacccccagttccagaacccaataagctttgaagaccggaaggtttgtgttttgttttgtttttataagtttgtggcagaattttggcagtgagacttgccctgtccaatggggggctagttttggtcttcactgatccctctgagtgtgaattttcttacgtttctctgcagtcttgttgatgtctttgattaagggctgctactctgggttgtaccagaatatatggtgtatgcatcttactacgtttctaatgtccaaaaatgctgaattctgaatcatggccccaagggttttcagagagaagttgtgaacctgtaggagcttttcttggtaaatggtagcaaaaactgtatcagagtgagacatggtgaacaaaagcaaaatgcagttcctgttaagaggctaatgttcaggtagggaaggaaatgtgctgagtggtgatgggaattgggggtcatcatgggtggggggtagggcgtcacccagcggctgccctgggccatgggctgggtataggcacaggaaagtggttgtgggtgtttcacactggtttgtgccagttcttgctctgcattgtgtccgtgggttcagggatgggtctcctgcggaaaggagggactgggggccgcacccatgcagaggagagccgggttggtcagaggaagtagatttggcaagctccacctcaactagaagacaaaagcaggatctgagtgggagcctgggcttcttcagcaagtgggcaccagccctggagctgtaggagagggtccgatgcggacagtggagacactgtgcatttctgcagcttttgtaacttccctgtgtttgcgatggcttgtgtcaccccgctctctttccacatactgattagcattcagcccttctaaatgaccagcactgtcccaagaaagggctgttaggggagagcgtggacacacagtctcccaagtcccatctcattataggtacctgggccagggtccccaggtgtgggagagtggagtcttgaccaatatggggatgaatcagttggcacgaggcgggctggccctgctctagctcagtctgagatggtggagcgtggaatcatatggtgtgtgttttaggcatgtcatttccccgggcaggtaagacataaatatagtaaggtaggtcttttctagtagtattgagagtgtcctactggggcaaagatggagactaaatttccctttttctttaagagtcagtttctgttcagcctgagttaatatcccacagcggaagcctccttagcaaatttcaaaaaaccctgcagtctcaactgccacttatgctgagcacaggaaatcaagttatttatagttgcagaacggtgtttcagcgaagttgattggagagttacctgattatagtgagattcttatccaatccctacagaattgtgagactaaatgttggtgcagcatgtttggtcctcaaaaggcaatgtccaagaggaacttcttatccccgaaaaatcaggctgtgtgactcagcaaaggaattgtttatgactggttactcatatgccagtgcttccagaatatctgctcgtatttaaaggagtgatcttgaagccccagaggccataatgtttagattaccaacctcttcaccaatcagtaagtccattacatctcactacgtgttagacatgggacaggagaagaggatttttattacctcactgttattactggaggccgcccaaatttgttttttgttttttttttttaaataaagaagcttgttttcatggaatggacttactagaacttttattattcagactacctagataaaattaagtaaattcgtttctttctcccaaattaaatattttgactacatgcaagatttaatcattcaaaattgccatgtatttgattatagaccagtagtataatccccctgccccaggccagattccaaaacaataaaccaaaacacacacacacctggcaacagaaattatatgtattccgagactcattcattcattttggaaagggccagtgtttccagtggtttctccttgggattgtaactttacaactttaaaactaggtaagtagttttcccttgaatctaaagtataactactttgtagtagagaagtaatttatcttaaatcactataatgaagatttactcttaattttaaccaaaatgtttcatttatttgtgtaatgaagatgatcaaagcaacgccacctgtgatccttctgtcttttttactgtatgtggcacgtggctgtgtgattttcctagggaaaggagtgggctttccctgtgggttgagaacctctgtccccctcctctgaagtttccccagtttttcctgcttctctgctaggtgggtgccttagcatgcttgtcttctcatcgtgcttctaaacttctctgaaccggatttatactcttaggtcagtagctgtcaaagaagacactaagtagtgaaagtagctaatatttaccaaacccctgctgcgcccacctggtgttttatgtgaaggtcttctctaacccttgctgtaacctcatggggagcagatcgttttctctcagtttttcagataaagaggaaactgaggctcagaaaggtcagggactttccaagccctcacagctagtcagcagtggagccagttcagacccaggcctgctgactcggaactggtactgataactgtcaccactgtatgcaatgctgcaggcaggggctggcaggtagtaaatgtgcaagatatagctgtggctgccacggctgctgctgctgcttttgtcgctgttgtcagcttttcttggcagccctgctgtctcataccccagtattggggctgaaggatttctttttaccaaagctgcctcttaggacagaagtccttgtcttgaatgcatactgggaagtcttcactctgtcaaacttttctgttctctgcctggtaatttccagacagaagagaacattcaaagaacgaacttactttccttctttttttttattgagacagtcgtgcttgattgcccaggctggaatgcaatggcacaatctcagctcactgcaacctccgtttcccaggtgcaaccgattctcctgcctcagacctctgaagcagctgggactacaggtgcctgccacctcacccggctaatttttgtatttttagtagagatggggtttcaccacattggccggggtggtctcaaactcctgacctcaagtgatcctcccatctcggcctcccaaagtgctgggattacaggcatgagccaccacacccggcccaatgagctttacttttctacataaggaaaataatggtagaaatgaaatagctgtgaaacttgttttgctatttttgtaccatgctaaaatgttaactactgcttatgtcggcatacacctgagagctgctgtgatttaagcctttttatttttctgggtatgatgtaactcctcccctacctcatccaagtagataagttcatggaggataaacatgacagctgctgtttcttttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgctgcctggagggaaacctgtcacctggagaggaaacggcacaggggaggcccagccgccctcgcctctcagtcccgcacgtctctgttagtggtagtcatggttcttgtatttccatcatgttgaggcaattgaaggaaatatgaagattcattcatctcaggaaaagcaagaaatgtattaacagcaagagtagaagttcacttgcatggaagatactgtatagcgtatttatttcttagcgccagtgggagtagctgctaagcccaagattgtgttgtgaggtttgaataggtcaatgtgtgagtcatcaataaagtaacatcaatcattttgttcccgattaatacgtttgctattttaggatgcgaaggactttaaagaagcttattattctgaaaagcaaagcctggagatttccagtagcaaaacagacacagtctgtggacaatctcagtgtacaaataattcacctctggcatgaacccaaagaatttcagaggggaaggaagctcttaaagattacgtcccctcctacttctttaatgagggctggggttcaaaaaccgagtaacttatccaggctcacataactgtaggtgacagagcccaagctggaggctgtggctgggtcttcagactcctttcttgacagtctgcacctgcataaactcagacctttactgagaacagtgcagccatagctgagagaagcagtcggcacccagcatttcttggacttgtctgccaggtcccccgagtgcagaggacagtgtgctggctcctggggcctgtgggcccggccaggagcagccttgtaagctaaagccttctttgaaggtggccgtcttaccgtaaactttcatggtaatttcagtctactccataatttgtctgagttaattttgatggaaacatagtgttttaagtaatcagttaggctttgatctctaactttatgccatccaaatcttcatgatggcctgagcaccaggcacccagacctgtgctctgaattgtgccggggctggttcatacagtgtgatggagagacgagagatccacactggagttctgaagctgtggttctcaaccctgtctttttacaagttccttaacttccttactagcctgaaatgaaatgcataggtgagaaagtcaaccagcgcacataatttcgagtcaatataacatttccttaaaaaataaaatacaggtagtttatagtaacataataagaattttgatatagaaatactcaagaccaagtacaccagcagttgaatgcagtgatgagacctgcacacacctgtgcctggcgtcacagggaggctgacacaggtgtgttgcactgagacccacacaccacccctcatgttgctgtctatgacgtgacattctacaaagttgactaactctcaggaaagttctgaacaaagccaagtatcatcatcttccttcaatttccatgtcgattgcattcctggaatagttcatgtatatttgaactgtgtaaaacatattttgagtttatatgtaagttgcaatcagtttgtaaatccaaaaattaaaaatagtggtttttcttttcttttttttttttttctttttttttgagatggaatttcactctgtcgcccaggctggagtgcaatggtgagatctcggctcactacaacctccgcctcccgggttcaagtgattctcctgcctcagcctcctgagtagctgggattataggcatgcgccaccatgcccggctaattttgtatttttagtagagatgggatttcactatgttggtcagactggtcttgaactcctgacctcagatgatccgcctgcctcggcctcccaaagtgctgggattacaggcgtgagccaccgcacccggccaaaacagtggtttttctatcttcctgagcagtcaagggaaaagttcttcccatcgcaggcgtgtctgaatgcgggatggttggccgacctggccctgcccccccgccccaatacccttagcttcttcccaatctttttgacatcccagtccccccaacatttccaaaatgccctctaagtcaacacttccgccactgccagctgccaccccagagtgccctgtgcctggtaacgatcgttctcacagtcatggccgtagggaaggctctttgtggttcctgggggacttcgtgagattgcccacatgagcatttcttttggaactgagatacagtgcacatcgcctctgggggacatggggtggtgggtacacggaaccgaggtgagcctcccttgcgttgcggaggtgctagccttgtgccgtccgttcttgtccatgtctgtgcaggagaacatcacccggcccacttggttgctgtgaatagcaaactttagaggccactgcatctgagggttggggggtttgcagagaaaacaaaagttggtggctgtggctacttcctatagcaaagtggctcaggaaagggatcccgtgtcacagcctgggtacaccacggcccctccaggagcttgattccttcttagctcaggggaagaatcgcacaaggaccgaggcccctgcttgtctgtgaacaaactggcctttgtggccacttcaggcttcggctgcatcatattcctgtcacattcacgtgagtgaacttgaattacatccttaacacttttccaaaaaggttataaactagactggtgatgtatcatggggcctagaaaaataatgctgctgctttttcacttctctgcttgacgctaaaacctggaggcgaaaatgaatgtgtgtaattaataggagaacttcctcctgtttgcagagtgctttacagctggcaaacggcttctctccctgaacagccccgtggggcgtcatttccatctgacatctgaggagagctgctgttcatggtccagtcctctgtccattggcccactgggtgtccctaatatgcgctaacaggctcctggcaaacggcgggcatggcagccacgaatctgcacatgagctgtatgccctgggtctcccctgggctctgcggggggaggtgggagccgcctctggttcacatgcggtgctttccaggctgcagggccttctcagcctgggtggaaggagtgacgtcagagtatttctcaggaactgcctgccctaaagttgtggctcataaaccccttccagcttctgtgtagaattctggacccctagggtatcaccacagattttaaaagcagagtaagaacatttcctgtgactgtagggtgagaggccctgggatctgtaattctacactaggctggaatcccagaaaagcttcaatgctcaggaaatgtatgagcagtgccaggatcccctgaaggagtgtggggcttttgaagcaagctgcccagcgagcctcccgcagcacctgctgtccctttgccagcagtcagggcccctgccccaccagtgttggttgtgtttctgttctttgaggagaccacatgatgatcttctggtaggagccacaagaaggatacaaatgccattagagctgctagagccccagacgtcactggaattggggttcagggtgttgggctgtccccacccttaggcagtactcccactgcctacaacacctccagcgcaggctgaggccatgcgaggatggaagcacatgtgggctaggccaggagggcgtgcgggagggctctccactctgcgctccgctggggtttctccttgtgtcctggtcaataacttcttctctctctggttctccttggcctgagcccccagcctgagccgggctgtccctgagttccctgacccggaagaagggacggccattatctttgggtgactgtcttcttatagctgggaatctctggggctctgagcgggaggcccatggggagccctggaagaacaggcatgggttagactgtttacctcactgccctgtgtgccctgccccggtagaagccgtttctgctgtgtggttctgtctagaactagagcccctcagggccctctgcatgccgtggggtccctttgcaaagcacctcctaacatgtgcttttatctgtggctcgggatggggatggtgacttcttcacgcagtcttctgcaggcctctccagcctggctcccgagatgtcacgcatgggtccatgcagcccagaaaagaccctgcagggggagaagggtcactttggtgcctatctccccagctggcctgtgggctgggtgcctggcagatggggctcccagggaggtgcccccatagacttgggctccacagcaggctgtggggctggcattaatgtggctgggagagcctggctgtctttttagccatttgtttcggaggccctgggggtcatacttgtgcttcctcgtgtatttttagatctcttatcaccgtacacaccacctccctatcagagggctgtcatattcacatatggtaaaataagacgcaacaatagaactcgagtcgtggttcggctttctaggattaggacaaggaggcaactttgatagtaaatggaatctttttttcccagccatccccaccctcaaagagtatcttgctgtaagacctagttcctgtaaaactctgtctgtggggtccctggccaggatgggtgggatcccagggaaagggccaggctgtgtgttctgaacaggaatggttctggaccaaccattgtgggcattcctgagaagccagggagcctggatcttgtcagaggagctcctccctctgctccatcctaaccccgcgggcagcagcaggaactgagagaggacacggtgggggcagcgctgcaaaacccagcagcgggccaccttccagcagcagaaagcatgagttttggttttggggctcttccatttccttccttcttttctttctttttaaatttttgctctttgttatgaaacagcagccagaccgagctatgcatgtcctgctgcacggcaggggcccttatcttgaacgactccacatactgggcaaggaggtggcagggggaggggcttgtgggaacccagatctgggatgggactcagccaacagtttaaagagccctgtgcccccactacccagcctcaacaattgttagcttatagccgtttacaccccacccaggttatttgaagacaagtcagagggagataatttcactgtactcctaaatgttttagtatctcagcaaagattgtatgggcagagaaaggaggcttcagggtgtaggaccccaggagcaggcaagggcttgctctttccctgttggctcctgtagggtggggacagaccagcccccatgaaccctagcgagggccatgccaagaagccgctgttctaatctaatcagtggaggatccagcaagctcggatgggagggaaagaatgactcaacctgcaggccgtctggggtatgcacagtctcgtctcctgagttctctgaagccctttgcagtttttgctttgtatcctaaactccacaggcccgaaccctggcactgagcttgatccgctgcagcccagcccgttcctgtccccatgctggaagcagcctgtcaactcacttccttggtttcctgttgctcttcccaccccatacctgctccccacatttctatcagagccctgtttctaaaacaaaagtcagattccgctgtgttcttaaaacccttcagtggttctgaattctttcaagacgaggttccagatacggaggctgagggcgagggtctgcaccccaggcgtctgcactccttgtcaccagctcctggtcgcagccaccccggctctgcttgtcctgtttcagggtccggcttagggctcctgtcctgcggatgccttccccagccccccggggttgggtcaagttctccagagcagcccccgcccctgccacacgtttcttcccccatgtggtcctcatcacatgtacattgtcaccaggtgctttgcctgtttccctggagactgggcacccaaaccacatttcagaaatccctcccactgtctcaagcagtgctgagacagcatggcacgttcacagcacagtgcattcctgtggcctccccgggccacggtcagcccacaggctactcacagaaagtgacaggccgtgttcagaagctcttcaagcagtctgacgtggctgtggcccgtcatgagattttatattttacaaaagtgtcagtcgataaaggatttgtcctgcgccaccggagcactggcctgaggtgccctgatccccgagaacccctgcctgcacagtcagcgctctccccaatgtctgccatctgccgtgccctgtcaggctgctgtgccattcttcgcagtgtctctggggaagaattttgtcgaaactctgcagatgttcttttttttttttttttttcaaggcagagtctcgctctgttgcccaggctggagtgcagtggtgcaatcttggctcaccgcaacctccacctcccaggttcacgtaattcttctgcctcagcctcccgagtagctgggattacaggtgcccaccaccacgcccagctaattttttgtatttttagtagagacagggtttcaccatgttggccaggctggtctcaatctcccgacctcaggtgatccgcccacctcagtcccccaaagtgctgggattacaggtgtgaaccaccgcgcctggccaactctacggattttctctcaggcatcttaagcaagtggcaagagttattctgtggctaagtgtgtagttttgtgttcgtgaagatggtcatgcataggttttgtgccagtttaaatgctggctcatatatttgttggtgttgagttaggcagattccaagaattgcctgtaagctaagttgccacttccggtattgccagcactttgttttccacatatgagtcatgtgaggatcgtaaggggggtagatgttctagaaggcaggggctgcaaggatttggaattgtattcagtgacaaatggacttctttctgaattctaatgtaaggtggagatcgccatagttgacctgtcttggaggtgggcttgcgtgtgtccccatgaggaattgatgccctaacatgattcatccatggggttcctttatcagcccaagcccatgtgcctcccagcaaaggtcattgttttttagtctttaaatgtcattatccccaagtgagggacagggtaaacctgttaggctgaaggtgggccatgatgggaaccttttcctgggtggagggcagacccccgagagcagcggggtctgacagggcattgttttggaggcctgcaagtctggagcaggtgcaatactgcacgctcaggcaggcgagctctgcaaggacctttggccagacccgagcagagctaagctggaatagggtggggtactgagcaggcaggcggggaagtgggtgggcgtgcaggtgcctgggacccccctcagctcacagagatactcgccctgtgagagcaggagtcacctcagacctcctctccttctgttatctgctagtgtgtaataaatatccacaattcagcggcttagaataacacacagttatgatctcacagtttctgtggtcaggagtctgggcacattggccaagcgcagtggctcatgctggtaatcccagcactttgggaggctgaggcaggtgagtggcatgaacccaggagttcgagaccagcctgggcaacacggcaaaaccctgtctgtacaaaaaaatacaaaaattagctgggtgtggtggcacctgccctgtagtgccagctacttgggaggccgaggtgggagaatcacttgaacctgggaggcagaggttacaatgagctgtgatcacgccactgcactccagcctgggcgacagagggagaccctgtctccaaaaaaaaaaaaagagcctggactcagcctctctgggtcctgtgctcaggtctcacaaggctgcaaccaaggtgtcggccagtctggggtctttctggagttcaggcccctcttctgagccacgtgtttgttggaagaattcagttccttgtggttgtaggactgtggtcactgttcctgctggcgtcagtcagccaggggctgctctcagctcatcgaggccccctcccactgggcagcttgctttctcaaagccagcaaggacactgacttctagaccctcttttaaagggcttgcctgattagggcaggcccataggataatctgtcttttgagcaaggcagtcaactgacgaaggattttaattatttttttaatactttttgccatgtaatacagcctaattacagtggtgtcatccattatgtccatggtcccacgcactcagtgggagaggggtatgcagggcaggtacactagtggtgggagtcttggggaccaacccagaattccacgttcccacacagtgggagaggggtatgcagggcgtgtacaccagagtcttggggaccaacccagaatttggccgactgcagttgtctctccctctgttcccttctggtggcccttctttcccccaaccctttcctctttcttacatctcacccctctgctcctcttcttcttcttgcatggcctcccttctcttttcccggcccctcctctctgttcctctgccccccaacccccaagctggtgggctatggctgctatgaaacctcgtacctgctctgtactggcttagaaactgagccaatggcacagagccacctgccttaccaggaagggctgcacttggcgtggccttggtcactttgctggcccattggtagggccgtaggacgtcactctaatgcctttccttctctgtctcctccctctttgcttttgtgtagacccaagagtcctttcttttgtttgagacagggtctcactctgtcacccaggctggagtgcagtggcacaatcacagctcactacagcctcaacttcccaggctccagtgatcctcccacctcagcctcccaagtagctgggaccacaggtgtgtgctaccacacctggctagtttttgtattgttggtagacacagggttttaccatgttacccaggctggtctcgaactcttgacctcaagagatcctacctgccaccgccttccaaagtgctgggattccaggcctgagccaccatgcctagcctggccccaagaggcccttcacaccatgtaatatggtcttggaaattgaaaatggcaacaaggtatcaaaatcctgatgcagttgtgatttttgacaccccttgatttgaaagacatggggtgggttgataaaggagccaagcgaatagaacaaattcctcatgaggacacaaccaggcaacctcaagacgacagatcaagtgtggccagtttgcaacttagattaaaactgagaaagaaggtacatttgtaatatagtgtaagtctaggatgggagagagggacgtccctgtcaggaccacccccatgccaggagcttgctggccacctcggaagtcccattttaatattatctaggagccggttgtggtggtgcaaacctgtagtcccagctactcaggaggctgaggcaggagggttgctagagctcaggagttcctggctgcagtgagctgtgatcacacctgtgaatacacacacacactgcacttcagcctgggcaacagaacaagacctcatccccaaaggaaaaagaaaaaaaaaaaaaaggaagaaaaaaaggaaaagattatgtaagacgtctgaaaactgtttatagaaccattgttggaaggattacagacgtattctcaaaaaacacttcagtagaaagagggtggggtttgtttgataccagaaaacctgcactcagtaacacttatgccatcgagcttacggggctgtggtatcacatgaagcagtgaatacgcatgcagtttttaaaatgacttgtaagttgtttgtagaaacagttcagatgccaggctcgatagcatcatgtccattcctgctcaagcatttgaaacgttctcacggagcagaatgtggcagaacagctacaagctgaaaaatacttatatggaggctgatttttttagtgcaaggaaggactccaacagctagaaccgttctgctatgatcttcattgtgttgggaaaaggtggactcccagcacggctgtgttttaaggggaagctgagggtgcgtgtgtgctgagaagtgactggacagcagttcgctgggattacagtcccagctccacgccagccagccctatggcctcagatgggtctggcagcctctccaggccttcactttctgctctgtaaagcgaggggttgaactggaaacctggagtagcatccagctgttaacactctgctccatgcatctgtcagagctccagaaggaggctgactgcccagccctgccacctacaggctgtgtgaccttaggcaagttacttaccctctctgtgccttcgttccctcatatttaaactggggatggtaacagtctcggcctaatgaggctgttgcaaggaatacatggcatcatatccataaagctcttagaatattcctgcctagcatgtggtaaggacttgataaatggtagcagttcttataactatttctattgctcctgaccacccttttactctatgaatctggaatttattgctgtatatctgttaaactctgaacaagattttctttccgcatcatcactgctgaccctgtactgggaaggtgcccgctgctctgtcctctaataagatgccctgtccgtttcaggcggaagcccggctcgctgcaaaacgggcggcccgcgcggaggctcgcgagatccgcatgaaggagctggagcggcagcagaaggaggtaacgcttggggctccttgttgggtcttttcacagtgatttgcgtgctgggcccagggtgcaagtgcaggcacctgttgctgcagacgcacctggctgtctcacgttgctcacggtcagagtgcgtttgcgcctgtgacttctgcccaaggtcaggccaggagtgcgcatagcacggataccaggcgtgcctgctcagacctgctggctcctgagaggggcttagaagcctcttgcctgcgcagatcgtcgtttctagctgcgaggagccaaaatgttcagggtctgagctttaaggtctaactgttgtactagaatctagatcctctggattaaagtggaaaagaagaacggattaatgagtttttaaactggccaaattgttttatttaaaaatatgtcccccgtggtttgtacagtgttgatcacacacgggctccaggtttcaggatatctagagcccgtgtgtgatagagagacgggaatgaacacatggatgaaacagccaggaagaaattcctccctgggaaaatggctagcaatgtgttgacacacctgctcaagccatttgcaagttattttcatcatcttgagctggagctaggagtcatttctgacagcataagggttctttaactcacagttatggtgtgactttttctgtgacctcagagacatagaagctgagacccccactcagtccatgttctcccgtgggccatgccctgtggggccaagggaccatccacactgagcccacccccaagagcttttcttcttaagaagatgtgaatttattttgttagacagaagtaaccagctgccttccccagggttgattttaatacacaggttgttgtttggcttacatagccaaatttaaaaaggcgagccagtgtttaaaaccagtgagatttcggataaaaatctgaatttccagattctcttatggtggttgtagattccgccacattcccagcaaagaccaagctggccacataccctgcagggtcagggccctgccacaggtctaatgtgctcattgccctccgctgctaggagtttgccgctccatgtagaaacctgcatgcagaggctaggcagtgtcaccaagccctggaaccatcctgcacactcaagctctggtatccatagtggtgccagaggccactagaaggaatagtgcttttattctgaactggtttttaaatatgtatatgtataatttttttttttttttgagatcaagtcttgctctatcgcccaggctggagtacagtgacatgatctctactcactgcaacctccacctcccagattcaagcgattatcatgcctcagcctcccaagtagctgggattataggtgcgcaccaccatgcctggctaatttttgtatttttaatagagacggggtttcaccatgttggccagactggtctgaaactcctgatctcaagtgatcctcccgccttgacctcctggcctcccaaagtgctaggattacaggcatcagccaccacacctggcttaaatatatgtattttaaatgacaaaatctcaggtgctttttcacactgcccagtatcagtgtctctgtagaatgtgtctgttcatacagacacatttagataaaaacgtattgattgtatccttttttttttctttttttgagacagaatcttgctttgtcgcccaggctggagtgcagtggcatgatcttggctcactgcaacctccctctcctgggttcaagcgattctcctgcctcagcctcctgagtagctgggactacaggtacccgccaccatgcccggctaatttttttgtcatttttagtagagatggggtttcaccgtgttagccaggatggtctccaactcctgacctcgggtgattcccccgtttcagcctcccaaagtgttgggactacaggtgttagccatcacaccggccccatattagaattgatttaaatatatacatattgatataagatataaccaattagaattgatttaaacatatacatattgatataagcagcttgttacaaagttgttgggcaaaagttcttgatttaaaaataactaagatgaattaaggcaagcagtcatcgatttgaatggccccctttaaaagcaaagcatccctttattcctttgattgaaaggaagcccttttctgttgcattttaattgtgcagtttaagaaccatctgttgctggactcccacgtctctgttgtaatattcccagccacacgaaaagaaaaataaaaaataagccaggcgtggtggcatgcacctgtagtcccagctactcaggacactgaggcaggagcattgcttgagcccaggagcctgaagcaatgatcgggccatgattgtccctgtgtgtagccactgcactccagctggggcaacataatgagacccctatctctttcaaaaagtaaaaaaataaaaagtagttgctactccagatgggaaaccaagtcttgggcatttaattttagtatcatgaaaaaggggtgcagggcagccctcactgatgcttctgatgagcacaggccttgcggagaacatctgatgaaatcgggaagtctcacgtaaaacgccatggtttgccttcttcagcatgagtacagatgtcatttgcttagtagatggcattcacattttgaaattcttctccctacagcatggttttatcataaagatatttcaggggtcacaggggtcaagatatctcgccctgttgcaaattcggcggaacatccgccactgagagcggtggttttggtctgtgctctcaccagcagggaccggaggagggggtggtgtcccttgcaggcagcacctttggccaacgtcaccttttgcacggtcctctgtggatctgcagtctcggcttcctcatcaccgatgcctgcacttcttccctcacgaccgtggcttgcggctgtgacacagggcgggcgtcgtgggcgcggctgtggactcctgcctggggttggtcacggaccaggagccagagccacccaaatttaccaggttgtggaatgagagcctgggaaggtgggggacatgtcaggaggggcagagaaatgaacgtggccaagatggtgagtgaggacaccgagtgaagcagctctaccggggggtggggaagccactccttgtggcagcagaggatggacatggcagacaggaagctgccctgggagacgagagccagacgaggaagggccagcccagtcagcccagcgcagcacgcgttcctaacggcggcaacggtgccttcatgaatttcgggtctttgcaaggcggcagcattcctgtttaaagtttatgtctgcttcttcaaaagagggatcgaaagatcttaaataagatagatgtgtatttcgtgactagtcagagaagcctggggcggggggacatcccagagctcctgccgtgtggcagagctgggcttggtgctgtcacctaccactggtgacgggcatcttcccaaactttacaggtgaggaaaacaggccttagggagatacacagttttccccaaatccaagaaaatagccaagccaagattcaaatcagatttgaccagatacaaagcctgtggtcttcctagctcacccctctgtctcaaaatcagttctgtaccaacaataaaaacaagagtggaggagggagtgaatccgtgggccatggggttgaagttcacattgaggacgctggcacgcacagcaaagggggaaacagaatgatccacataatcctagtcactttccaagtggaagcatgccttgaaaaataaagttctccttggtgtggaatttgaggcacaggaatatgaaacataaaatatacaattttcttagaattttctataaatacagaatgagtagctttcacctagctgtgcttttatgtgacccaaagggtggggcagaggccaggaggaatgtactcgtgtgtgcgcacgcattcgtgtgtgtgcgtgtgcatgtgtgtgtgcatgtgtgtgcatgtgcgctcacacacgtgagcatctgtgtatgcatccagagggaagagtgagtcgagctagtggggtctgagcttgcacgtcttcgggccatgcctggaggatttgggaaggtgcactgacgacacctccctcacgctcttctttgcatatcacatctctgggcctggctattattagaaccagctaacataatttgaggttatacaatctggtagcttggggcactggcattttaagttgttgattaaggggaaatgaatacgttttggaagaccagtgtttaaagggtagggttgatactttggtgtaaaaattgagaaacctgatccctgttttcatcggggtcacaagccatcccacctgcatgcaggcgtttctgagcaggctcagggttttcttgagggggccgctctgagaacaccgagaagggcaggaagctgaccggggttggtatcccccaaggaaagcatggagcgtgtacggagaggggaggtggcgaggagacaccagtgtcgggggcagccctgtccccacagcattatcagactccaggccagctctagcccaccctgagctctctttcttgaatggttcttttcagcacacagacggcgagaacccactacagcttactctagctgcgttccggggtctgtttaaaaggatatgagctcttttttaatggatttgttaggggagaataatgtacatattcttgggaaattcaagtgaaccttgaacttcttagggagaacctacactgatagaagaaaatggtgatcatttctcttttcttgctgctgacttgataaacattttggttagagatgctttgtttcttacagtcatattgttggatgtagtcacatgtgttcccccatataagactagaaatgccaacttcttggtctcgcagttttggcagtgccttcaataatgcctgatatgacaaatgtcttaatgaatgaatgaatgaatgaatgaaaatgagtagctatctcagttttatctagtgattactacaaaattaaaagaaacctctgaagcaaacgaatatgtcaatgtatgataataacctcttttaggaatatttctgttatattctaatgatcactccatttagctggaattttcctgttattctgtgtgtgtctgtgtgaatcagaacatcaaagcctctttcttcattatttgtgaatttgaccagttaactttccaattaagtttctgtactttttgattaaacttttattaccgcaaaaagaaattctgaattaaagatgaaggaagtactttttctcattgatggcaataggttatacagacttctgtattagaataatagcagtatttttggtaagattcgtgtggctatgcccctatttccccaatgtatctaaaatgaaatgtaaagtaagtgataaaattacaaactcttgtcagtgggacctcacctgttttcttattcacattttactgtattcgttgtgacttgattcatatgtctagttacttacagaacctttcattctgatgttactgcttctttaattggattttacatttcttttttcttctgtccttctctatagatctatcaggtccaaaaggtaggctcttctttctttattttctaacttgcatgtactgttttttccttgccaagggcctggtcacctttcagaaataacaccttgcactgaagatacatagaagttcttactgtttattttactactttgtgtatgaatttgtttgaacaagaatgcctagatcctcatcttgccccactcaaagcaacagtcagacacatttctgtgtactgaatgcttttgtcatctgcattttcctcaagaaatgtaaaaattgtttctttgagaagaaaagtaattctaaggcaaaattatatttcagaatgtggatagccttctgaaattatgtatggaaagaaaaagatgattttattagaaaacttaaaaaattccatacaaattaccacacattgagagattattagatattgagttaaaaatctgagtaaaaggacagtgatgatataaaatgaacctgccattcatccctaatgctcagagatcataaaatgacgtgcctctctgtttcctagtattttgtagaagcagctgaggtttagaagtaaatacactgggcaggccagatacagaaaataaagacaagcaagtcagtgattcaagatctagcaaaaatgaagtcagaagtgagcgagttccttgagaatttatagaatttgtatacacgggagtctttcccataaatgaatttagtttgatacttaaaacatctgtgatagtttccttttataaatttagtttctagacaacaactgtatttttctcttagagcagatgagaaaatcagaataagatcacttaatttcggaggttagagcacacaggcctcggaatgcacgggcagtaaatttaagagcctgttgtgttggattcctgtgctggccatgatgacgaatcgccttccctgctggagccctgcactctgcatagctgctgtcccgaagagtgcaaagaaatttgttaagtagatgccagaatctcttgtgcttgactagtgtttccagggcccaagtgtagaaatggatattgcagctggagttcctggtcgtcctcagagagcctcgggaagaactggacaggtgcaaggccaggcggggagccctccctgtaactgacagcaggacgctctcatccaaaacctggaagaggggctctatctggtcgtttccacttgcattcatgcctttcttgtgctaggtcacattattttctttttactaacgtgccagggatacattgtgagaactttgtcagaatgtgaatttgtgtagaatgtgaagctagaaggagccccggaaacctgcagtggaggagcagaggcacagttttgtagtaaaggtgtgcccagggaagggaaggctttcctcattgctgagatgtctggggaggagaggaggcggcgattgcgcctccggcccagccagctgctttgcggaacagtttctctggaatcaaagctatttctgaaagtagcgcggctcctgcttccctccgcatggcttccggatcatggtagtgattgacgtttgaaatgtttgcccttcctggactttgctgtgctagtgctgctggctaacccaggaactactagttaattgcacttgctgttactaggggcgttctctccccaggaatgacatggaaatgcagttacagtagccacttataagaccacccatgaacgaggtgaaagattttcagaactggtcctttgtcatgaaaagagcaagttagagtgtgcagatataatgggcaaaaagaaatctatgaaaacagaaaaactgacagtacagattcttttggaatttaaataattttattgtgaatttatatagcccccatccttctaaaaacatattttgcttccctctttctagttaagccaaaaaataagggaggagtgatggcatcatattttacttgtgaaaaatctggaacttggcaggtgctaacattaattgaatgcaaaatagctttaagctgatgcatttccctgacattgaagttaaaacatgactttgggatgtttgtttttatttcctttctgaatttatattccaagggaataacctacagaaaaagatatggctcatgtcctttttgtcttttttgtcctttttgtactcatgtcctttttgtattattgaatttttaaaagtattgttaaattctccctcctaatttctgctcttccaattttctacttactgtcacctctaagagaaagagataagaccgtctgaaaactgcttatttttaaatctggccgcccttcgaaatgaaacaaaaccaaacatagcaacagcatgtttttggttattgtaaaacaatttcaaaaatggtcttgtatttctagcacctgattttttctcttgattataagattttaatgtatgaagagaaaactcacatctgtgttataatgatacggaagtttgcttagttgtttcttgattttcttactggaaattaaataaaaaggagagaagcaaaaccccattatttgggcccatgacctggcttcccacctacctttgggattccctgattgagtggcagcagtagccgttctgaatctgcttttctcattttaacttggaccactgaacaggataaaaacatggaagtataagctaaagcaagcttgtccaacctgcgggccacatgcagcccagaatggctatgaatgcagctgaacacaaatcgtaaactcttttaaaacattatgaaattttttttgcaattttttttttttagcttatcagctatcgttagtgtagtttatgtgtggcccaagacacttcttccagtgtggtccaaggaagccaaaagattggacacccctgagctaatgtcacctccagacatacataacttgtgggtctgcatatttttcttctgtacaaagacctcttctgtaggtggcagtcatctctccatccctgctacaaagacagcaaagtctatgaattctcacaggcctagactcagcatagacatcaggcagctagaacaagcgtcagcacgcagtttctccccttctcctctcagtttccctgaggtcccaacaccggaatggctctgagcttctgcttctcttcgatggtgttttattccttcatcgcgtttgctttgaaggcatgagcagcctgttggagggggcgtgaaggctgctgggccggctttactgtcctgctctcccccgaggcccttcacctggggaagcttcgtcctgggctctcttgctttgccgggatggggtgggctgggaggatctctcttcacagctcacagcctgcatgactgcacgggtggcggtccctgtggagaagccaggcctggtgccgactgctttgccttggcgtgttaccttcaccacacggctggatggcggtttggaaatgcatgtcagaacagtgccttagacaactgcctttttaagaaatttcacttcttgcctaattttctttcccttctgtctatagaaatattatgggctggatacaaaatggggtgacatcgagcagtggatggtaggccttgaatataattttgtttttactcttccctccccacttgaatacagtgttgagacttaaatggtttataatgtaattcttacgcagtttaactatgtagatagattcctattgcaccataatttaatactgagagattttcttccggggatttctgcatctggtctctgtttacatccccaaacgcagcctgcttagaaacagtcctggtcttgcctgtttggtagccactgactgctgatgtctcctggccagcagtttggggaggtctccactaccacagccgccctgatctcctcgagcacagggctctccaccaggactcgggctgggcatgcgcccctggcttgagaactttccagagaacattcccattggcttcgcagctcaccaggctgtggttggaacctgagaggtacattatgctccatttccttcactcatgattacgaccagctgccccatcgccctcatttagactttatctgcatttgctgttgggttctctcttcatcttgtccgctgtgcctgccgaaaccactggtctttggtaagaaaactcctttaccttctccacctgcttcctagaacagcccctctgccttcctgtggatggagagctagcctgcccctgatgatactcctgtccttctggctttctcaggaagcagcggcacccacatagggaggctgcggaaggggcacaatctgtgtgctttccactggtcccgagagagagtggcctggcccttctcgttagttcctctacccgagtccttctacctcttcctgtcccttttgctttattgcctggcctcgtggacttcatcacatgcttttagcatttgagaacctggccaggatggaaatgtcctattaaatgttccttatacataaaatgatctgaggaaaatccaaaattatttcctaacatcttacgtactgggtataaaagaggttcgctcttcagatatacagagcacacacttactgtattgaaaatatgattacattcagcctaggcaaaccatcattttaggcttacatgacataaatgtatttttgttaaatcttaagacatttctgtccacaggcatggtgatataagaaagagaaaaaaagaaaagaaatatttaaaaaatctttacacattctttgaagttgtatcattgttttatataccactgagaaagaaaaaatgctaattataactgagcaacttggattataagatacatccccagcttcagagatgtccaagtgtgaaaaaccgtgtgtgtcttagaatccacaatacatagtagaaagagtgacatccttttcggatattgtgtggaaatgatttatcttctgattcccgaagagagtgaggttctgaaagtaaggggaaaagtagattgatttaaatggatcagatgatagaggttagaaaaaaattaagacccagcttctgccccaaacactgtttttacaacaaaaatgaagtatgcaaattatttttgtgcttaagaacctcccaccccagaaaaaaacatttttacccactggtttaattaaagcctttaaatgaaggcaaagaaaatatttatgtgacatttagatcagaactgctgtattatggtgcagtgggactacctaagcttttttaaagcacttttcctgtgtccatctgtctctaaccttttcatgctgtttcttcattgttaggaagacagtgagcgctactctcgtagatccagaagaaacacatcggttagtaccgtgttcattcattacttgggcaatttgattgaattctaatttatgcttgcagtggctgaagtatatataatatattcaatctcttaatgatgatatcatctcttaaagaaattaactaatactattaatgatagaatactgatattattacctaaataaagactatgaacttagcttttagcattttgacctaaatttgataaggagagtgtgtttgagaaatttttcagtattaatatattcatgacagctgtagtgctttttgtgccattgaatacccataaataatctgcatagtaatatacaccaatgctgtgtatttatattacccgtgagataaagaatactacttggatgaaattactttttttttttttttttttttttttgagacagagtctcgctttgtcacccaggctagaatgcagtggtgcggttttggctcactgcaacctccacctcccaggttcaacaattctcgtgtctcagcctcccaagtagctgggactacaggcgcctgccgccacacctgactaatttttgtatttttggtagagacggagtttccctatgttgcccaatccggtctcgaactcctgggctcaagtgatctgcccacctcggcctcccaaagtgctgggattacaggcatgagccaccgtgcctggccctgaaattactttttttttgagatggtgtcttgctctattgcccaggctggagtgtagtggtgcagtcttggctcactgcaatgtctgcctcgtgggtccaagtgattctcatgcctcagcctcctgagtacctgggattacaggcacgtgccatgacacccggctaatttttgtattttttgtagagacagagtgtttcgccttgttggccaggctggtctcaaactcctgacctcaagtgatctgcctgcctcggcctcccaaaatgctgggattacaggcatgacaccacacctggccctgaaattactttaaatccatattgcccataagcagacagagatccacaaagcccatgctgtggaggacctagactggtgtcccctgagatgtccaggggtggctggccccctcactgctgtgggttggggtcagttcccagcatccccctgaaacttgggcactggttcttcatgtatgttgtatgattccttcacggttgttctcgtcctttcttttaataggcttctgatgaagacgagcgcatgtcagtgggtagtcgtggaagcctgagggtcagtaaccagaatgatggagtttgcatggcacagtttctggtccaagccctttactttctcatccccgcattctgatttcttcttcattatccccgtggtctgatagtcaatatttaaccgatgagatgcttacttaaaatcaaatcaatgggggatgtttctttgttgctgtagagagatgatttatatgcataggcacgttggttgtttctttctcccgagatgaagtcatctttttttcaatacttatccacatcacaaagctcccaagccttgattagcacagttgtctcagcacattggtgttccacaggaatgcaaaggcgcgtctgccctttagtaagtctgtatccactgacacccatgctcctggtaaaatcggaacctctattaaagtagctgtaagttaattattattgagcaatgttttggcatagccactatagactgcctgctgaaaacctggaccaggactggatccgtaaggtctgccttcagccgcttttccttgtatcagttataattagatctctttaccactgataggcttaatggttaatcaacacaaatatggacttttccttaaacattccagaaaccttaataattatacttgaaaaaagtgtgagtttggggggaagtaaaatagaaaaactatgttttgctcagtgctttaaatcagtgaattaacctgagcatgtcagtttcttttactgcaggattgaaattacatctcaccgctagtaataaataaatctcaaagcagccactcgctttattaatccttagggaccacatagagctgaaggcttgtttctcttcactgtggcaattaaatcctattactccttgacttcttatacatgcactgagtgtgcatgtaatttggcccttcccaatgataaaatgcagaggtgaaacacggttgctgtgctgtgaagccactctgtccttgtcagtgtccttgcagtgccaaaagcagatccgtagtgattttgccaaaaaactgtggttcaaatgtgaggccccgtgagggcttccttgctgtttgaaaccttctcctgagatgtagcctcagggatgctgttgtaaccgttacctcgggaccgtctgaccccactcaccccagaagagggaagatttatggatccaaaatagaataaatgcaaagctcaattgacaaagtctgtagacaaggcccagacatcacagctgttgagcaggcccaggagaagcttgagtccttgaaaccagtgaagaaaatgctgtttcagggatgagggggagcgaccgagagaggaggaaactcagacttagcggtatagaggatgtcagtcactttggcaggagaacttttaacggaaatattgagggcaaaacctggttaatatgggttcaagagagaataggaggagagaggcacagaatcccaaactgtctctctcaaaatgcatcattttcagagccacaccctcctgaaattgtaggcacaatttcagatgtaagatgtgtgcacttacattttcctgggaaaagaatgttcagtttcttcagattctcagagggtctcctgaccctgaagagttgaaaaccattgcaatatgaacgagtattacggtgttatgtaacagcattcatttcattttcaatgatttttaaccagaaataagttgcatctttctgctggacaccactctttgccgagatatcaagtatatttgttttaagagctgaaatttcctataggatgttcaccattaggacagtacataagatggggaggaagtggatgggattttcattttcagccacatgacactttcccatcaggtacttgatctgaagaaatatattcctcagaacttaagaacttggatcctggagatgagagtcaaacctcctaatgtttataggcaccaaacaagcccagagtggtgaagaggcctgcgtggggtcacagttcttaggaacaaggccagtgcctgctgctcagggccctggtgggctgtgtgtcctccgtgcgctgggttccctgggctctatgcttgcccctttgtaccaccgaacagggcactccccagagtgaggactggcatctcgctctatttctatgcggggccagtttctactgtttttatgtattttaatattatgaactttttacatttttgattgtaagatcgtatcttttatttattgactctgaaaacacaggccttcttcatttagctagaaaaaatgataaaccctaaaaaaggtggggaggtgatttatactactctggaatttgtatggatgcctcctcagaaagtctagattttggattttctagaatttctcgagtttagattttctggaaaatctagatttttaattttcctttttgaaaattgatgacagtgcatctgttaacctttgcccttttgtaactaaaatggattatgtagaagaggaaataagatttatcaaactgtttcagactttgtgaattatagcagcctttgccatggaagtttattgaatgctactggattctgtggtagctaccattctgacataattctttttgtaaatacatattagatcctagaaattatggaaaaatgcatttttgttaagattttaaagattgcttgtatttatgttttacttagcttttaaatttacttttggcaactctctttgctgttgttttttttttctgccatctttcttctgacagtcgcagcctgacttggagtatgggggtccttacgcctgggtgagatggtcggatatactttgctgtgtgaccttaactgtgtggtgtgaccataataacctgtggtatttccacgaatctcatgggtgctttgtctccagtttttgcctggggggctatgaggccaggagggcaggcttaccctgcagagtgagcagtcttcctcctggggcctccagggtgcagccctgatcctgccggaggggaggagcccaggcatctgtgcatgaacactccctcaccagatggcctttgagcaccagctgtttgccacgccttgtgttagcagctgtgcataccaagatgaaaaagatagtgtctgccttcaaggaactcaaatcagatcaagaattcccaaggcctctacatttgctttaaaagattaaatgtaaagccattttacctaatgaaaaatccattattttccagtctatatccattcaaattaaatgtacaatctgacttttttttttttttttgccagaaagtattctttgagaaaactcctaacttccagtaacaaaaactaaggctttagacataaactcagaattacttcttatatgtctctgacagtttctgtgccttatgctttctaaaagtctgtcagtgttatacttcaaggaagaaaaagttctcagaaagcacagctcagcattaaagtgattcgatactgaagttattgtagcatattatgtactatttcacctgaaggactttacctaaaagcagtttgtgcttcatttgctccagtgcatttcaaaattatttagtaaattcttgttttaaaaatgtatttttgtgtttgcaattatagtgaatcaatagtagcatacatctgcatagcatatttggtgccctgagcctcctgtgggacggctgttctgctcttaacagatacaagagcagaggctggagtgagtagctcgggagtcaggacaggggaaagcacaaagacagggcgttagattcagaaagcgctcttcacagagtatctgttacttacctacagagcactgcaagtcgctctggcaggtgagggcatttctgtgacactgtaactccagcaactctcctgttctttaaggaattcaatgtgttagcaacatatttctagattattactctttttatgttaaattcaaagtaaattttgtttaagagctagcccccagtgggataaatgtatatgttagcaatggtcaggaacacattttggattttttttttcggtcttaattcttttttaaaattcaatagaatgcatcagggatcgaactccagagttttgacgtcaccttccttgtttccttttccatctctaatgccctttacatgtgctctgtcttttgactcatgtagaaaagacatctaacattattcatccaaaaagttggcagtggacttttgcgtggtcccatgggaaggtcacagacgctttgataacactgcgtggtagccattagcattcggactagtcacaagttaccgttttcatagggcatttacccttgtatcttatttatcctgtattagaacatactaacttatgtgtgtcctctttattttattctctcttatggcagtgtttctggagagcttgttagagtgcctgttcctgagccctttctgtaggtatcctgattccctaggcagtggcccatgcttgtgggaagcatgccaggtgtccaggaagcaggtgtgagacccagcctgggagcatggaaccagcaaagtgaacaagcctgtgtaccacttaaagctacacagtacaatagagcgaagcttgttgaacatcagagacccaacttaagatgaagttaatatgctgcctatggacttttgttctaatattgttcagttaactgtcaatgccccttgccctcttatgccacgtaaaaacagccccacccatctaaatacaacacaaaaaaacaccatccaagaggagaaagttagcagtgttctttaagaaggtcaaagtacttctccctatggaggtatagtcaacaagatcctatagatttgggaatacattctaggaacatagcccaggaataggttccttatgatagaattccattaccacagacctggtcatggaaattgctttgcaggctttcctgcaaagtaacagtttttcccaggttttcgtagaaggctgtaagtggaaaggtgacaaatgagaggatactgtcatgcttccagcttgcccagccttctgctccgtcgctgcaggctgagctggagaactacagtgcaaaggacagggttccgccacagagctatgtatttcataagcagcagtggagagccagaggccttgcttatgtcatacatttctcttcctcatttgttagtaaagtcaaagtcatctaaaagtgattaacattagccttcattattttattaatttcttctggaatctagtttctgaagacataacaagggattgagatctaaaatttgcaagtccttgacatgcattttcatgtcaaataatcttgttgctgaagacatgaaaggaaattagtctgagtaaaactcttgccaatctccaaagatttttactattaaatttatttcagaaatgttttaatgttactcatagagttctcaaatttaatatggaaggatttctacactccttttgtttcagaacttcaaattgatttcttgatttgttttgagttacagcaaagataaatatatagtttgatagtcaaagttttatgaatctggatttataatctgtctggaaattcaatttttttttctactttaatgtcatggctgcaaaatatgtgctatacagcacccgtcccccggataaggaaccatgtttagcacctcccatatgccaggccccttccatgtggattcatgtatccacccagtcagctggtgattcatgagggcactgttctaggtgcttgagatactcattttcatctcatttaatcctcacgatggctttgtaatgtatttattattatgcacattttcacggctgagaaaacagatgttcaagtgcattaaataattacttaaggtcacatgacggagcttctttgtggaatttggactcatgcccaggacctgatggcgtctccttccatttttaccagttgtgtagactgctcctcctttttctgtcccgagagctggttttgtctctgatgcttgacagctctattttgaatcagcagaaatttccttatagatgaattaagggacatttagaaagcccatgctttgacttaagggaacctgggctgggaactgagaagagagggatgataggcatgcacttagtagaatcattctcctttattctggaggacacattatgaaattattaaatatgtgttcaaatttcattttgaaaaataaagtaggagggctggatgaataaaaaactagtatagaggatataccccacgatgaacttttgcgtttaactatagattgactagaaataatttctgaggccgggcgcgatggctcacgcctgtaatcccagcactttgggaggccaaggcgggcggatcacgaggtcaggagttcgagaccagcctgaccaacatgatgaaaccccgtctctactaaaaatgcaaaaattagccgggcgtggtgacgcacgcctgtaatcccagctactcaggaggctgaggcaggagaatcacttgaaccagggaggcagaggttgcagtgagctgagctcacactactgcattctagcctgggcgacagagcgagactctgtctcaaaaaaaaaaaaaaaaaagaaatgatctctgaatcttctgaattatggcccatagcatcacaatgtgccataattttcaaagaccctgaaccaggaactgaaaactcattgactcaggctgaatcactacccatcggcctggcatgtggcttcttgcaagcagaatgtccacagagccaccataaaaccagaaacagcctgacaaggaaatggccacaccaagcccaaatgttccaccccgtggagggacttggtgccactttaaaactaagagtggcatgtgacatgaagcctactgacttggttagcttgactgctgttccctcctgagctgcgggggagcagacggcggcagggatgcagtttgggagctgccaggacttgtactgtcctggactggtcattcatccgctccacaagaaaggtcaccttatacctggctggttggtccctgctgatttgtacctgtgaattcatttgtgtactgatgtcagtttttctcttttcttcattgaaacagacaaatggttatgatggagaattgtatggatcacagtccctgaatagaagatctggcagggttagtatagtaaatttgcatggctcaaaattcaaataggttgtttcaaagcttctagaactaaaaactaattgctaaatttaaatttagcttctttgctgtttttaaattttaaaatcggtctgtcttttttttcctagcacatgatggaatgaaagataatgtttttcaactagcaaacattctgagaatgttagccctccaacattctgattgttagtataaggggtagatattgataagaatctcaagttttaaaagatctgaaattaaagattaactctttcattactgtattcccctgggtgtatgtatataatgtgtgtattaagtatattcagctttcaaagatactaaatccaacattttcgcagtctccacatctgtcatttgtaattttaatgtttaccttaaaggcatgtgtacaagcacctgtgtttttctggagaggaaaaggagaataaaacaatgcagatgcttggaaggctcccagttaaggggtgggaggcaggaaggagctggtggaaggaaagggtgctgctctagggggagagagagggagtggtgccagtggcaggggcattagggagaccgggcgggggtggggagggctttggattaatcaaggacaggaggtcattggggattttagaaggttacactggatacatttccattaagcttcacgatatcccacaggtccattctgtgtgaaatggtctaaaaatttcctgttctcatgcttcatttttttcttttagtaatattcctaattgtgtaaaatagtatttcttttcatttatcttaattatgttatattaagatatcatgtgtatgcttaaattatacttttgggcttcaaatgagtgaccccacccagaccttcttccctctccccgaccaaagccgtctttagctttctgaaaccagctgatcaagttgtttttacttgctcattcctatttacctatttagcattgcatgcactttaattatttattttttgagacaaagtctcgtgccctcacccaggctggagtgcagtggtgctatctcagctcactgcaacctctgcctcctgggttcgagcgattctcctgcctcagcctcccaagtagcttggattacaggcatccactaccacacctggctaattttttttgtattttttagtagagatggagtttcaccctgctggccaggctggtctcgaactcctgacctcaggtgatctgcgcacctcggcctcccaaaatgctgggattacaggcatgagccatggcacccggctggatgcgacattttaaaaatgtatactcaagacacgtaaagatggccttcagggcatttgcactctgtggataagggctctccagtggacgggtggcagcaggctgtcacactccacccacctttctggcaccccagggctgagctatagcccgcaggcgggctgggctgaagaaagattgaaaattttgcaataaatggaattttagttacccaaggagataagacaaggagtttactgacaacgcagtgtgaaactcagtaattacgaatcgtgctagggatatgagattgtgaaaagcagtactagatacacccctggcatcaccaagacacaaacactgaaggtgaaaatacagcttagaatctccagttgttaagaatctctgctgtactgtttgtgcctcgcgtctttagataaactagcgttcctgggctcctagtgttggctcggttgtgctgttccatgttcgccttttgaatgggatgggggtgcttttggagtcgtaaggaagtgcttgtcacttaaacgtgttttcttctttggtgctcagaattccagctacagcggtgacagcagattctctactttgtcatcatccagggaggagaagttggttggtttccatttaaatctttcacattctcttcagaaaccgcagattttgtagcatgcaatcttgtgtgtgtggattcagctctacttttctctttcggtgtctgtttgacggatttttgtttgggtagctgtgttattgacgtgaaaagcagcagttaacatgagctccttcattcagatgtactccagtgtgctgcgtttgaccacaccagctcgaatgtgaattgtggcattcagctggctgcaatgaaaggacgtgtttttgtgtatattttctaattagaattaatcaaaaggaaaaaaataattagaagaatgctcttgaattcttgagagtttctgaaaacagaactactttgaagagtacatgcaaactttgtggtggtttcttgggcatggactagacttggaaggaaaatccagagtctcatccaaatccacatgtttacacaacagagttccttcccattctctacaaacatgcatcggtcttgataaacataatttctaaattgtttaagagccctaaaattgctaaggcttgttggtgtttgtttaggttcacatttactcagcaaaattgggactagtttaggtaggaaaatcaagcaggccctgggatcacaaagctaagcagaggaggtgggtgctctccaggcactgacatctagaacagaagccaccggcaccggagaccagtacaggagtgaacagatgagtagatagaatgggagggagacactggttttgccaggaaaaaagatgtgagctgaaccttaataaataggaagggccaggtgtggtggctcacacctataaatcccagcacttcgggaggccgaggtgggcagaccatgaggtcaggagatagagaccatcctggctaacacgatgaaaccccgtctctactaaaaatataaaaaattagctaggtgcggtggcacatgcctgtagtcccagctactcggggggctgaggcaggagaatcgcttgaacccaggaagcagaggttgcagtgagccaagattgcaccactgcactccagcctgggcgacagagtgagattccatctcagacaaacaaacaaacaaacaaacaaacaaatagaacaaatgaaaagaataggaactaaccaggtagagcctagaggggaagctcttcaaggtaagtagccatttgagcagagcagaggccgcgcagaatgggcagaacccaggagaggtgccatgtggctgagcacagggtgctgttggagctgttccgtgaacctggtgactccagtagcagctcccacgctgaaatcagaaaatgaaatctatgcaattcctctgcgatttcctttagccactcccatgtatcattgacctcattaaaatgcttctagaagaaatagctctgacccttccccgccctgtccccaatttccagcccctattctcgtttccctcccggggggttggggggtatctttttcttgccagggcacttcttcctcacctcttcaccccttgtccaaccccttcatgtccagggagactgcagaaggtgctggcagctccatggcgcccactgcttgccacctttctcaacccttcccatagtcccccagtctgtaataaatccccccactgtaagctgatggcccttctgtcccccaatacgtgaattttgactcagtatatgatcagctgtgaacaccaaagcatcggtgggtttaacaccttgaaaaaggctttgggcattttcttaattcaagagattttgctgttgcagagggcacttagtcattaagaaaacttcatttccaactcattttcgataagctgagttacttgctctaaaataaaagatggcaataaatatctcatctttggatatgaacgattcacccaagttcagcctgcatctgactcacttcagtccatttaagagaaataacccacatccaaagggttaaacatcagaatgagagctgactcattcaaacagggccacatgtgaactcgccctgagccctgtgtgcccgtgatttgctgcccgagggctcttgtactcacccaccctcagaaccttcctggaaattgtgctctgtagacatctattgctgcccagtacgtggtgcgtttaattttatttaaatataataatggaaaggtatcagtgtagaatgtagtattgatgactcttcctaatatcaattaaaatttatttcaatatttaatatcaactaaaattaaatatttttttctgtgcgtgaactcaaaagtcctaatttggccccatctcctagttttgtcagttgcctggcccagccgtctttatttccttctgaccctcgttctctccctcccccgtgagtgcatgcctgttactgttttggttgtataaggtaatcgtctctgaactcactggactgatgtacctttgcgatgccgtgagggtgtgagcctctctctcctctctgctgcccatttgctctgattacagggactctccggctccagccttgggcttgccggtggtggcctggctcccacacccctgtctgccccaaatggaagctgggtctgtctccttttcacatcactttgtcgctccttccctttccttctgtgcatcactttaattgctgattacatttagtggatagttcagcctcctctacacaaagtcacaagagcaaagcttagcaactgttttaattggcttgactagtttgctaagacttttgtcaatcttttagaaaaaccatgtcaaataagttagaacctatatagaaaaggagacttaaggaaaaggagggttttattaaatgcatattttcaaaaactcgagtccaaaaaattggtctcttgggtctctcctccttttccagcaattgttccccatttggggtttcatttgtttttttaaaaatattttttctcttgtaaatgtgtccaggaagcaatttggaaggtttttgtgcctaatctgcctccttggtccctgagaagtggacagaacagtgttattcctttggctgggtctccccgctgtttcctgtttttacaaggtcaggttcaggtccggccctgaggtgcttggcctgttagctataggtatcgagtcttattctaatccaaggaagtcggtgtcagaggtgaaagtacacgtcctatttggaggttgaactgtccctctcccttgcatgtcgactggagctgctgagtgatcaccgcctggccgtgcaccttgcctgacttgctcagtgtgccctggaaatgagtccagattctgtcccgtggcacagtctctggacactgggagctgcccttgtgtcccagcctgtcccttcaccagcactgcctccccctgacgtgtgtgctaggcaggattctcctttgacagggctagaccgcggctcctctgggggtgcctcccacaccagctgaggcagccttgcagtgactccctttgtgtcttgaagactgtcgctgggcccctggcatagaaataaagactcttcctgctcctgtcttcatgtgtggacatctgcgtattgaatactgccaagtgtgtcgttaaccttggatttgagctgtgggttttgttgctgttgttgtgttgaccttgtcaccattctgtctcatcccctgaccctttcttccaggaatgcctgaaatgactagaaatgatcgtgttttaaagatgctgggaagtttactgttttaaagttaaaaatcatctcagttatctttcttgtaaattttggatttgcatctatcaaatttgcagaaaacacggtgcctcgatcggtttgtttctgtttaaccactgtacagcagttggctatggtgaatgctgaaactatcgtgatggccttttgctgtcatttgttgctgttttttcaaggcttttaaaacctgccatttgctttcatcctccagccctcctgtctgtacagcgctgcccggccttcggggagttaccgggtgcgtgtgctgcccaccctgctgccccgcaccccctcccactgtgcatgcaccgcccccaccaagcccagagccggggatgtgcctgttcccagccccctgggggaagttgcaccttcacgtggagcttacatgtgccagtggggaatgtctgtcccctttggccagatctgggttttctctcccccgattgttgactgtagctgccacactgctctgtctccaggaagccttgtgtttgctgggatcgttaggcaggaatggaacaacagcaatgtttactttacctattggcagaaagaatggtggctttttaatgctttggtaacctggacagatactaatccatgttactatattactttggaaatttccagttttaaatataagtacttatgctatgcaagaaacgtaaagtaaatactcaaagtagctatattgtcttgttaataaccttttttttttttttttttttttttggagacagaatctccctctgtcacccaggctggagtgcaagggcacgatctcggctcagtgcaacctacgcctcccaggttcaagtgagtctcctgcctcagcctcctgggtagctgggattacaggcacgtgtcaccacacccagttactttttgtgttttcagtagagacgggtttcaccacgttggccaggctggtctcaaactcccgacctcaggtgatctgcctgcctcggcctcccagagtgctaggattacaggcatgagccaccacacccagccattaataactttctgaatttccatcagattgcatacttatgtgtttgatatattaataaatggctgagcaaactagtatgtcctcaagggaaaatagggaaattaaagttcctttataccgggcaaagtttgacatcaccatttgtggcagtgtaagctcctgtttacccacgttgattaattaagtagcattttccagttaaccaattactctttcttctacttagcaacttttaaagggttataaaatatttaacattaaaactataattaacataatttgatattttatcccaaagtcacttcacataagagtaattttctaagcatcaagtatgagaatgccatgacaaaattcaggatgttcgaattatctgctcattttaacctggattaacaagttttcacttaggcctgggatgttttccaaagtaatagatttaaatggtctgttggagattacattgcacacctcctgacaacgactaaaaccggtctctcctcatttccttgtcgcactctgcaaccctttgaagagctggaaaggtggttctcagcctcccctgcatgctttttcaggtcatgctcctggcacgtgtcagtttttcacagctcacgttttcagcactttctgggcactcttggagaaaggaagagcgcccatcctgacagtctcttttggtcgcaggcgtctgtgttggatgaaggcagcttcggtgggacccgacggggcagcacctccggctcccgtgctgtaaggcgctttcggtgatacctcctttcccccgtgcctgctgcatggcctggggatgctcgctgggcagggtccagccgtggggggtgactggccattctcaggaggaagcgccgagtcaccgggctaaccgccaccttccattgtaatgaaggtcacaaataatgtgaatcaggaaacctctggttgttggtttcatgtcctcactcatcagggagagtaacttgcactgagtttcatctgctctctctgcagcacgccaaccatactaacaggtggtgaaaccgtcttcggttaataaaaacgggaaaaggacaacttgacagaccacacatcattctcgtccctggatagttgaggaagaggaacaaattttaaaacttggaatgttacgcatatttcattccctgtttgtattttgttgtctctctacctctttcttcaatttgaaatgataggctcagctatgagggtaaagatgtaataggtgcaccataaacatttgtgaatgaatgcgtgagaaaagcaacaaggtagaaaaatgagatggaacccgtggaagtggggagacgaatttgcgtgtcccagggacctgtggaaacggagcgttcagtgctaaccggtgctccctggcggtggatctcctgtattcagaggctcctccccaatcctataaaaatgtcttcaagccctccaggaaatagaaaggtttactaagaaatacttgaaatgcttttataattttgcttttgaagtttatcagctacttacttgactaaatccagttttatgacttactatgctatttgtccagccatcatggatattcatgaattcttatggtgtaagccagtctaacctacagttttctttaaaatgtaatttatgaatattaaatccagtagttgacatagcattcgtttttgtcgacaactgattacacatttatcaacttttatattacataagttgttcagtattttgcagcccactatataacatatttttcccagttggtaaacattttcataggccattagaaagctcataaaccatgcatgaagaatgaaatagccctgcctatgatgtgatggataaagcacaactaatgattttcttttgtcagaaaagagggagaatactaattcaagagaaatttcccccaagcaccaggtggttttctggtggcttcagtagagagtctaagatctggcaggacggagggctcctgatgctctccagatgctactgtgtcacgtctgagatgggcttcgggagtcgtcagccctagatccttggccttcattgctcttctgcgagcagtgatttctgtgcttttagcccccacaagaattgcctgggagtgatggccttagagagttaagaaaacaggaggtcatcttgtcctgacagcacagctgcctaaaatagggatggtcagctctgctgtgagcaggaaattagcaccatgaggaagacggaagggacaaagaagttcctgacctcccaacctctgccatcgtttccctggaaccctcacagttcccctccaagtggatactccgttccttatgtttacaggagggccttgggagagagccacccctgctctcggtccagcgtgtagggaggttatggcccaggacggtgtccagagcggccccggcgcccaggcctgaggtcccagccccaagtggtcgtgacctcagggtccaggcttcccccaggcctgcacagacagccctggtcctgctgtggaggatttgccctgcccctggaggaccaggaattgcccccgcgcagctcctgagtgtgaagtgactttcttcggtgttgtgacaaagctgggacgtagtcatcaccagtggcattgtctgatccaggagccgaggaagttgtttctggcagaaagtggaaataagaagcccaacatgtaccccctttcctagtcctcagctcctccatttggcccacgtccttacttccatgtcacagatgccgggctaaggaacttccacagccacgtggccaacaagagatggagccatgattcagacttaaagctttctgacttctgcacattagccacataactcctaaacataaggtgcacgtggaccgtggcgatatagactttcactttgttcttttctgcgtgattaggtccagttggaaggtttgagagctgcttttgcttagggaagctggggtgggcagtaagctctattcacaacagttcactgtgtctttgcaccataaaccagggcatgaatggcataggatggagaaggatttgctgcaggatgaagttttcctctctcttacatcaggaaaccctcaggcaaaattcttctgctttaaagtgttgacattaagtgttttccttattttcaacaagaatgccaaaaagtgaggctagtaatactggtgattttcttgtatatctcaaatgtggcattgatgctttacatgtgctgtgtacacagcagtattaatctgtgaatctgaaacaacgtcttgcccctgagtgtaagtgtatagtaaacatttatcaaataaaatagaggtggatgggtctggggaacttgcccatcttgtccacagccctgtacatttaatgctttcaattgacatttgatggttattttagtctacagttgaaatcattcgttcattcaacaagtatttcttgagtttgccaggcctcatctggtcactagccctggtgaggaaacaaactaagagatggtatttgacatgagatcatgagcacccctgaagatctatatgagatcacaagcacccctgaagatctggatgagatcatgagcacccctgaagatctggatgagatctggagcacccatgaagatctggatgagatcttgagcacccctgaagatctggatgagatcttgagcacccgtgaagatctggatgagatcatgagcacccctgaagatatgggcttccttataattcgcaagcagggcacttcggcaggtccccagcagagcctgtgaggccagcagagggttctgtgcccagcacagtgcagggtgtccaggggctggaatggaggggccttcagcagtggcgaggcttgctatatggtgctgcgtgggtctctcttgaagatgctcctcaggacatgtcgggatcctaaatagtgttcaaatcctgcccccgccccaccatgccttgctcaggaagaatatgagaatgtttataataacgtgaaaatgtatctaagactagcagatgtgaacataaatcaaagttacaagggcgtagcttccagataatcgagttgctggtattttcctttaccagaagtgagaaagttcaggtaaatggatagacagatgtgtacatagcaaccacccaggtagaaggtaatctggcaatttaaaaagccatacataattttgtattaaccctaactctcattttgcttccacttggaaagatagtggagaagcaaaatttttgttcccttgctaaagcgccaagcgccctgtgcaagtcttcagtttctgtgccggaaggcagcttaagttctcaaaacagtcatttccacatccacggggtgactttctgtgtctacactaggtgtgactgcacacccaattgaacgggtgctttgtgttattttcttcttcctaactctgagaaattctgtgttcctctgataatgtgattggcttttttattcttagcgagcactgatttgaatatgcgtttgctgtctaaccctaactctcttttccttgccgtgcgtggctaacctcaccacttactgcagcatgttttctgtcggcctctattctccttgctcctttgctgaccctgttcctttgtttctggctgcgtgtcctggcggtggctgtgtgggcagccctcggagtacagcggccacctcaactccagctcccgcgcctcctccagggccagctcggcccgggccagccctgtggtaagtcggcctcctggccttgctcctactcagtgtcaccctccctcccccttcccttatcctcctcttccaacgtctccaaatttagaatattactctgcggtgatattattaggattacattgctcaacttttcaaggaccgtaaaagaaattgttagctgtgcttagagatggggatcttagaggaggcaaactttatacaaagggagaaaataatatagccatgtgcacggatgtgtggttttctttttatgatttaaaaatttgaagtattgactgttaatgctttgcttgaagtgttacctgtgatcagaccccgacagtgtttaaggtaaagcgtggcctgtagatcccgggacgctcccagtttggccccaatcattcgttaccctcctggttctcagatccttcgaaatgtgcagatttgcagccctgcatcctgcttgtcactcagcgtggcccaagttttgtttcagaaaataggagccctattaggtcatccccagcttgttaagtctcattattgtgtgttttcccctgggttgttggaatttgacacagttttacctgatgtgatgcttgaaggcgaccctatgactctttttaaaggaagagtttgcaggacggttttggactggggcttgtgggaatggaggaggggaggtgggcacatggccggggaaacagctccaggctgcacgaccagaccagcgttcccaccctcaagagccagtgagaaaccttggggagaaaaagcaaagatgggcaaggcttccctgttcgtctccactcatatcaaaatttccagcctgagctgggtgtggtggctcacatctgtaatcccagcgtcatgggaggctgaggcaagaggatttcttgaagccaggagttggagatcagtttggccaacatagcaagaccccccatctctaaacagtaaaaaaaaaaaaaaaaattagccaggtgtggaggcacgcatctgtagtcgcagctactcaggaggttgaggtgggaggattgcttgagcccaggagttcgaggttgcaatgagctatgagtgccactgcatttcagcctggacaacagagtgagaccctgcctctagaaaacaaaaacaaaaacaaaaacttctcccagccatcgagaagttaaaatgtggctcttaagttagttactgaacaccatacttcagcgtgctgatccctacaatttctgtaacgttcctagtaatcaaccaagaagtcgcagcgctgagacctcctgcttgcgtggatgtaccttttttggcgggcttttcctattgtggtgctggtggtttgtttgtgttttaaattagatgcagtcttttaaaactgtgaggtttcctacctcgcacctgatacctgcattcaggtatcagcaaatgcaggtatcagcttctttgggggaagaaaacccaggatctctggccacttgactctgaggctgccttgcagaactgcacagcctccaccccacccactattttcgtgaccccgaggccacggcccaggtgccattcatcactgtgcagcatggctttcctgtgctagaggaatgtttatctcctccatccagccatggagagcaggaaaatagagttcaatatgggtgggcattgcaacgccagcgcctctttctctgggggaagactctcccctctgtataagttgcagacacccactcttgtcacacatttggctctgcccacctggcctcacaggcatttgagtttgtgttccacccctccccatcccagagcccagcagtcagcagtgagagaagccaaatgtgtgcagggagtgcgaggcggcagctaccatgcaaactccaggggcacaccgccccccagtaatctctccccagagtgcatcaggcaataacaggaagatactcagctgttcattatgacatgatttcccattttcaaacctgacaagttggtcttgatgctgttattcaaataactgaaagtaaatggttgtgaacaaggaatttcagatcacagactcagtaagcctggccagcccccaaggctgtgtcttccttaaagttgggatctctgtattatctcatactctatagtagagcaataaacataagctgacttatgtgatcacttaaaactaccaggaagaaacattttccgtaataaatttagtgtaggattgctttgtcttctcacactcacttttcagaaaagaaaatgtaagtattgccaggcgcggtggctcacacctgtaatcccagcactttgggaggctgaggcaggtggatcacttgaggtcaggagttggagaccagcctggccaacatggagaaatcccatctctactaaaaatacaaaaattagccgggtgtagtggcgcatgcctgtaatcccagctacttgggaggctgaggctgaagaatcacttgaatacaggaggtggaggttgcagtgagctgagatcgcaccactgcactccagcctgggcaacaaggcaaggctccgtctaaaaaaaaaagaaaaaagaaaaaaaagaaagaaaagaaaatataagtatttacaattgacagaagaatgttgtggctttactttcagtgaatcccaaacacgcttaatgccctctgtaccctctgcctggttccagtgagacatgacaattggattttgttaagcattgtctttattcaagcatatgatgaagtctcaaaataacagggctcaatatagtcacttagagattgaaatgacacaaatttctttgtcatacgaaattgaccgaagagactgaaatgatacaaattcctttgtcatgtgttttctaaatttgtataaaatttactcacaggtttattagatgatcataaacagaaagatgtgagttcagccttcctgggcgtcctgggacctgatgggggtgggtgatctccttgtatctgctcttccttccctgaatcgattgctcaactagcaaaggtcagttgattgcgggctggttggcacgcttagggaacaaaggtcagtcccgcagtgagggacaaggctgtcccccatctcatcctgggtgccttacatctgatgaaacctcccgtatgtggttcttagaatgcagagaggtctctgtagagtgcagggcagttccctcgcggatgtgttacggtatcccttgattgatcgtgtcgagaatagaaagacggtgagcacaggcagcatccctggtatctgaagagagcctgggagacagaactaagctagctcatttccataatttccaaaactcatggtcctcttatactaaattgactccatttctgttttctgtcttgggacatttacaccattgctggtatattttggatctcctgggacaacagaaagtgctagtggttgtgtttggccttgttgatgggaagaagccaggagagcctggataggactccccggtccttctgcctgggagggaggagcaacaggtcttgggcagggcctggtgtaagcgtggtggcaaaggtgaatgaccctccagtctggccttccttgaggtcatatggagcaggcagtgctctgaggcagggagtttcagaacccgggttcagatgtcacagctctcattcctggcttgggacatctagctgggcacataaacttcttgtgcttcccctggaaagaggggtcatgatacccttaaaaagcaaaaagaaacccccccaaaaaaacaaaaaaaaaacatatggttactttatttctccttggctggggttagccagggatgggatacagttgttgtagcgagagctcatgggaaatgctcccaggccggggacttcgtcagggacacgtatccagggccagtatgagtgaggacagaggacaagaaaaatatgaagtcagggtcagccctgcaggctctgtagggagtcccgccctgggtttgggagatacaggtgcacaggtgagtgtgtcacacccatcagaggggagggagggagggtggtgctgttaaagggcagtagtaaccagaatgaaggaagtgactgcttgtcccacttcgagaaaatgaaaatgcttcagtgtccagagaccaccaccagggacaagacttcaagttttctccacccacttggtcctcccagggtccttgggaaagcagagagggcatcagccccatctcaagacaggcatagaatactgttcacctcattctcatcttctcccatgctgtggatgagctgtgttttcttcctctccagcacgaccaggatcttctccttgaggaagttatttcactcattcattcagtgtttattgagcacctagaatgttccagaaacagggccgttgtatgagcaaatgcagacttgccccagccctcatgggacgcacagacaggggcagacggatgcttgttgggtgatcacacgttgtgaagcccagcagcgggggtgtgaggggaggcaaaggtgcctcgagagagctgggatccagaggtttgacggccagagcttgggccacacccaagcagagtgactccacctagtgaagccaacagatctgggtcatccaggccccaaaatctcactgggaacctggtgaagccatcacgtttctgaaacatccatcaggaatgtcccaagggcagcctgggtccatatcttccctcgtgtactcagagaagacaggagcaatgaactcagatctctgcccatttggactagaaaaacaacactattttgactcatgttttttgttgcacaaagaggcaggggcagggaccaggtggaaaaacgggtcttgaattacaaacaccagagttcaaagataagtcattcaggctaaagtaaatattattggatttaaaaccaaaaaccgtcaccctagtggtggactgtgctatcatttaaatgtgaaggaaaattacccttaaaatgggtgttttctgagcagtgtttgctgtttgtttgtgtctcaagaaggacctcgcaaggatgttgcttcggtgatccctttttccatccaagtctggtgttgcctggctgggtgttgaggacaggttccttttgtacctgggcccttgagtagggtctctctgggtacgtgaacaggtgccacatattctttctttaggaaaatggcaggcagctggaacatggaaaacttagcgttttagcctcaccaggcatcgtgtgtacaggagcctagatagcaaactcctttagacacagtgttagaaagttggaattaataaaatatttaatgtgctccttgaagcatttgtttttgaaaggaaacttgacgtaaactaaacttccacagacgtgttttagaagtgactgtttccagtagattttcaatgatgtctgtatacactcagctgtggctgtaaaatacaacacacatactttgtaaacctgttagtgtgacgttttcaccctgacctgaaatgtttagtatcactcagaatacgagagtcatgaagctaacaggctgcaatgtgttcggcgctgtcgcccttcccgtgcaggaggccactgtctgcggggtccggtgctttcccgtcctgggctaaggtgggtgggcagagcagcctggaccgtctgcagccaccatgtcctctggacccctctctgcaccatgcccacctcctccaggcccccacaccatgccatgcagtggccgtgacagtgtttagaatcctttcttgtcttccatttcttcatcattttagggaggaagtgctgtgctttatgtcaagatgaaacacaacatctgattccttacctggctctgctagggcttaggaaagggggcttggttaaggtggactctgctgcctgcggcttctgtccgggcccggcccctgcagctgtgacacactgccatctggtggacacgagtggggctgcgtggctttccacggggctgaatagccttcctgtgtttgaggaaagctgacaaatcctttttcattcggaagacacacaaaatgaaatttactctactatgtaaaatagagataggttagacgttcatttgccatcacctttcaacaagagcttaatttttagtttttctctgcatggtctctacttaaaaatatgcccagattttattttgagtccgttgtgttcttcggagcaaggacttttttaaaatgataaaaacagcaaactatggtttttggggttttttcccttatttgatattttacaaattataaaaacaaatgatgtagacggttacaagcaaaaccatgcagaacaaagatgtgttaaagccctgcccccccaaaatcaaggtttgtggaccccgtgtgttttctttctcagctttcttgcaagaaataccagaaagaaaaaagggcttgggtgggcccttcttttacggtctcagatatctttgtaggtaaacgaatgcattcctggagcttcatttatttctccacagtatttatccattgctgaccagcagccagaaaacatacgttttacaccgtggagcaaacatgccacaggcttttcagtggtagtttggcagtctattaaactggattttcatatcccaccaagagttaaactagcctctttattttcatcttattaatatttgttcagcaaactaacttactctaaggaataaaaggctttgggcccaggagatttaatgaatttattctccagcacgctaagtgctagatagatagttcacatttccttgttctttgaaattttatttattttattttatttattttttttttttttgagacagagttacactctgtcgcccaggctggattgcagtggcatgatctcagctcactgcaacctctacctcctgggttcaagagattctcctgcctcaacctcctgagtagctgggattacaggtgcatgtcaccacacacagctaatttttgtaattttaatagagacagggtttcgccgtgttggccaggttggtctcgaactcctgacctcaaatgatctgcccacctcggcctcccaaagtactgggattacagacaggagctaccgcgcctggccttgaaattttgatttgaaaaatatttcaggaatatttttctttccatgtgaagttgagaaccacacttgaattgctccaatcatcctcacaactcaacatggctgcagggcttctggggctctgccaaatgagatggtgcccatctgatcagagtctgccttcgtatctgtcccatcggagtctgccttggtactcatcttatcggagtctgccttggtgcctccaagtacacagttaggctgatgtggcatgcacatccgaaaaaataactctagatgtgcatttcgacacatcagcaaatgcagatggtatgggctgcagatggtatgggccacagctggagagagccgtcttcactgcggtatagctgggctgcacccaacgtgagaatggacatcagggcagagagccgtaagcagctgggattgtggaaagcgcccgtgaacacatggtcttggacagggcctcaggtgggtccttagcagctgtggctaagtgggcagagggaccaccccaccaccaccctgcccaaagggcttatttagcaaagaggggagagaggccagcctgcccctgactgcatcccactggcctgagggatgtggcctctctgcccccatttccactcctgctcttgggacacaggagactggttagatgagagtagaaagtttatttttgaacacccaggtgtggggtggctgggcgagaccatctgatggctttgggagccaggccgcagggtttagcttggatctgttgagtaggagacccttaaacatggccaccctgagctaagagctggtcttggattttgctttcttttggattaaccgagtattttgtgggattccatttgatcccttaactggctgaccagctataactcctggttatgttgttttagtgttgctccaggtgtcgttggaggagaagttgaaggtacaaggagtttgcaggagggaaggtggcagttaatgagccttcctggtgggaccggatggtgagggcaggggcatctggcccagcgtggactcgggccatagatgggaagtggtcatttggaggtcaccatctctctgacaccctgaccatagcacctgcacccctgtgctgagctgcaggtccccggcaccagcgtctgtgcagctcaggtgttgctgagccgtggcctccgcagctctccatcaggatttctcaagcttcattatgaattatctctgtgtgagctcacaacggtgactgcagagtcccaggtcatctctcagatcttctgaatcaaacatatggtctgcagttgccgcgcatgtctttggccgattttctgacaatcaaagtgaagaagttctgagctacgggaagttgggttgaaggcatgatggggaaaacatgattagttgacagcttttcccagagagtttttagacaaactcaaccttggtaaccttctcagtgggcttatgataagaaccttcaatgtgccaaaaaataaaaaaagcagcactccaggtagttaatctttgtttaaaaaacccttccccccacccagtcctgcaaacaaacaaacaaacaaaaaaaggagaaaaaaagaaacctgtcttttgttggatgctgagccgagaaagaagtaacaccactgccggcctctgcctcttgtcccgagacaccctcatggtgcagggctctctccagggtccgttcctcatgtgcaccctctcttgtagttccacagcccgctgtgggtcccactgagactcctacctgaggacaggagaagagggtcctcagggacgtccaaatgaggacaagagaagaaggggcctcacagacatccaaataggagaagtgtgaaaagctaaatttggagtgtcccatttttctgcttctaaattacaaaggaagcaaatgttttgttttgttttgtttatcattcatagccccatcttcatgttatccatttaatgcttttaaagtatttaatattttgtctgttttcgtctacaggtagaagagagaccagaaaaagattttactgagaaggtaaggaatcgttcataaacctagagggtcccaaaagttgtggatgaaattgataagaaaatatgttgcttggttttttttaataaggatgttccccagcgagggaactggactagaaagcggcccacctaacctggtatcaccttcccggaggtaggccaccgggagtcctgtccggtgtgcgttagatcctgtagagcagggaggcgtttataatgggccccaccatggagtttagggttaatccagctaatcgcagagcatccaggaggtgcctggaaatgatcccctccttacagtttactataagcccatgaagagtttccaatttggaaatggaattaaagtaacagtcctgtgatgttagatttatatgcagttttggttttgtctgaaatcgcatctgtgttagtccgttctcacactgccataaagaacttccctgagactgggtaatttacaaagaaaagagctttaattgactcacagttccgcatggctggggagacctcaggaaacttacaatcatggtgaaaagggaagcaggcaccttcttcacaaggcgacaggagagagaacatgtgaaggaggaactgtcaaacacaaagccatcagatctcctgggagcccactcactatcacgagaacagcatgggggaaactgcccccgtgatccagtctcctcccaccagggccgtccctcatcttgtggggattatggggattacaattccagatgagatttgggtggggacacagagctaaaccatatcagcatgtgatcctctcaacgttccaggggtctcgtaacatgccgggcctgtctgcagccacgctggcctctctgggtgggacttcctctcggagaggcagcggagacacctccatctccatcgacaccgaggcatccatcagggaaatcaaggtgagatgctctcttcttactgacaacttgagagaaccttttgtaaaaatcagtctttagattaaaaaaaaaaaagttaattcataaagttctggatctttcttcttggtcctctctccctcacctcccctaaaatacggtgttctcctaacatcaagacccagctcagatagtgtctcctgcaggaatctgatcctacccactgaccccccagcagggcggaccgtgtgccggccccctgcgcccctcagcacccggggaataccttagtgagagcacttggcacgttgtgttgatgcacttggtcgtctctgtatgcttggtctgcatagacattcagtccacaagtttggacaccagacggctttacctactttcacacaacccctccccactaagtatgttccccttcggcctagaacttgccctttcctttctctttgtaatgtgcctttagtagccctcatctttgtattttaatgattttttttatcccactgtagtgtaggtattattctctgctctatcctcagcacccaggacagtgccaggcatttggtagtattctgtgtgtgaaagagaaacacggtgctatttgttaaagtaactagggacagtgcatctgaaaacctgaagactggaagggcaggtgaggtgactagacctgtgtcctccagggagcagaaccaagacagaagcagctgaaaggagccagaactgactcagattctgaattttctagtgctttaaactaggtttaaaagggaagcaacttccactggggatgtctgagcagctggatggccgtttgccagggaggacggagagggatttaagcatccaccagagtttggccagggttaccttgaagatgcttccaacacctatgttttataagtttacaaaaccagaagagccatttcccatgtgccacccctgggccacctgcagctccttgttgcttccctttttttttcctttttcttttcttttctttctttctttttttttttttttttttttttttggagacaagagttttgcttttgtcacccatgctggagttcaatggcacgatctcggctcactgcaacctccacctcccaggttcaagtgattctccagcctcagcctcctgagtagctgggattacaggcgcccgccaccatgcccggctaacttttgtatttttagtggagacggggtttcgccatgttggccaggctggtcttgaactcctgacctcaggtgatccacccactcggcctcccaaagtgctgggattccaggcgtgagccgctgcgcctggcctgttgtttccgtttctacagcagagcagcagagttggcggcagtcctgatgtttctctgcccttaggttgcgcgtgccgttcatttgttcaggtacttactgagaggctggctggtgccagatgctgtccccggcaccaggaatttggcaaagtagagacttggagctccataaatgcagggaaaaagtgctactgatttttgcctctagcatcttactgtacattgcacagagtaggaactcctagtgcttgaatgaattactaaataggagttgaaataacctgtaccgttttccgaggctctattttgtctgttttttaaactgtgtaaaatcatatgagatacactaaaattgtataaaatcatgtaaaaatatcatatgggatacacctgaactttaatctttaaatattgaagtttattttcccttaacgcttaataaaataaaaaagaaaattgggtgctcagactacccaaatagaaactaccctgaagtataaaagatttagggaatcacctgttttcccttgacatcatctgccttttttgccatttcccccaggaactcaatgagttaaaggaccagattcaggatgtagaaggcaaatacatgcagggattgaaagagatgaaggtaccaattcacagacgtgtggtctcacgatattaacccaacttaacttaaaaaaaaaaacaacatcctaaagaagaaattcaaagtgcatgcttactgtaaataggctccagggtgtagaagaactcacaatggcaggagtgccggcatgggtgtacactcaccattttcccaaatgcattgtttgaaccaagattgaaaatgtaactgcccagtagaaaaggttactaacatactccctgatgcatgccttagacttaccatccttcccccaggcttaaaaccagtttctcatttcccataggcgtgtgccagacacttgaagaaggttcttggttttcttcactttttgtagtagttgtatacaaaaatgcttcagttgatttgcttctcaaaatatctgatgtctactaataaggccgtcctcacatgccacacttttgaaacatcccaattatttgcaccctgtaaaatgctactaattgaagtaaagactgactatggcattggctttcttggagcgtgtgcacactgcttttagagtgtgcagtgacttcattgcaccagccaggagatgtggttgccctgttccttgacagtaaggtgggcaatcagtgactgtcttccttaggcagcagcggatcatggatctggaagtgggtggcgtatctgttacttccttttcagccccctagaaagtacctgcaagatcatttgaatttaatatcaaagggcaccagacagaggaggtgacatcgatcatgactaattcactatcttcatatctgccacctttcctgaaagggggaaaaataagactctggctttcaattcatgcgaaaaggagccacttggccaggcgtggtggctcacgcctgtaattccacactttgggaggccgaggtgggtggatcaccggaggtcaggagtttgagaccagcctggccaacatggtgagaccccgtctctactaaaaatataaaaattagccaggtgtggtggtgcgcacctgtaatcccagctacttgggaggctgagtcaggagaatcacttgaacccggcaggtggaggctgcagtgagccgagatcgtgccactgcactccagcctgggtgacagagcgagacactgtttcaaaaaagaaaaaatgctgctggggagccactgaaccaaccggagacccgctggtcccacgtgaagcagctgtcctggtgtggaggtacagagctagaccagcactggtccctccagccccctggtagcctctgctgcacctgaactggcagctcttgccgctgcctttagctctgcatgtatgcgccctgaaggttctgcctctctgttttggaatcgccttcccctcctcatgtttggggacctgcaagggtgtgaggcacgtgagggcatcgccatgcgtattttacaggcctctttctctggactgtccttcaaagggaatgacctttgtctttccaggacctacccagtgagatctgcctgccattttcctatgagtcaaaaatctgaactcactactgctcctttcctggttcataagccagagtagggctggttggcagtcactggcttgtggccctatgtaattatctcagccatcacacactggctctttcacaagggctggtcacacgcctcgagtgattcttcagaaatctgttgaacagcctgacacccagccctaggacgccgtgctggggggattccccagctactgagtggggccagagactctactgcctctgtgaccacatccctttccatactggtatctcgtttgttctaatgagtgtgtccattgcttttaatagtgaattttctgagcaatgagaatttgaccaaattgaaaagggggatttccatgcatttgaaattgccatgtgtttcttcttctgatccatttgctctaagaaatatagtctaagtttaggactgagggtttttttttaacagaatactgaatgattctttgttttgatttttttattgcaatttcaaaaatatgacctgctttccacaggactctctagcagaagttgaagagaaatataagaaggctatggtttccaatgctcagctagacaatgaaaagacaaacttcatgtaccaggttgataccctaaaagatatgttgctggagcttgaagaacagctggctgaatctaggcggcagtacgaagagaaaaacaaagtaagcattagtatgatacagaatgttaacaataggctgcgtgcagtggcccatgcctgtaattctggtactttgggaggccaaggtgggaggattacttgagcccaagagttcgagaccagcctgggcaacatggcgagacatcatttctaaaaagaattaaaacaattagccaggtggtacatggctgtagtcccagctacttgggaagctgaggtgggaggatcacttgagcctggaaggttgaggctgcagtgagctgtgttgacaccactgcactccagcttgggcaacagagaagacactgtctcaaaaaaaaaaaaaaaaaaagggaatggtagggtgtgtgtgtgtgtgtgtgtatgtatgtatgtatgtgtggatatatcgtgtgtatgtatgtatatataatgtataatttacattatgtatttttatatttttaaacaatggctctccgcttatccaggaaatccaaacatctgagaataaaagtaccatactctttgccaagtgacttgaaatattgatacgtataatttcaacatgtaaactggagacagtttttctaggagaacatctaagctaaaagcaaaaccatgaaaaaacatacctatgaaagagccaccatgctcagataaggtgcgatcagatgcttcaagattttcctattcatatgtattttctgatttttattttgttctctctcaacaccatagggaaatagttatgagtatcaaagattttaagaaaattatattattttctgctgattgggaaaagacacagttactctacttaagaattaaatatatcaccaagctcagagagagagatagtcttatctgagctttcattaggaaccactggaactagtttgttaatagctgagatcagatataatttctattgagagtctcaagcatgagtcatgtgttaagataagtaatgacagcggactgattccacgaaggctgggcttggatgttctttagatagaaagcaaggaatacttttttcatacttttaggaattgtccaatttttcagagattctgagaaaaacagaaaatgtaatgtgtgagtgtcgttgttgttgttgtttttaactggctattatcctctaaatccaaagggttaaaaccaaggtacccttgacaaccttcaggcctgcttcttcgactgctatagaattgagttggaagctgaagaacattttacgcacaaagttccttatagctgaactctgcaagaggggagcttttcacaagactgatgtcatgtgggaacggaggagtggagagcacagcccagccccccttcgggtgggggcctgtaatgcatatgcattcctcctggaatgctgtcattaggcatcattcagtggactgaaaactcccgagtctcactccagagaagctggatggtgctagaatgctgtcccgagatggacacaggggccatgcaaagccccacaggagggcccttgtcatagccaggagggcaccagccacccccaagctaaaggaagtgggcgaacagaagtgccagggtgagcagaagctcaggccagatcccatctcagatcacccgcctgacaggtctagggaaggagcgtcctgcaggcctgtaagctgtcagcaaagtgagttgggtctcaggccgtcaccagggattgcgctgctgtgactgggcaggaacacagcagagccgagctgccagcttcctgggctgagcctcaggtggggaggccaggcctgaggagcagctaggttttgcaggctctccatttgctcccccaaactctcctgtttttgtctcttaaggggcagccctgaagcacagagctggccaccagctgttcatgagagatgctttagtaggccatgtttatctcctttttatcccaaagagttttccttgtcatatttcagcaggggccattttatggtaagtccttgcagggcagcctcacccaggctctcagcacagtgctgtggaagacaccaggctccctgggggggcccttcgtcggctcttgcttcactgtagataagaaatcagaaaatccttgttgattgcatcaactcctcaggttaatttgacagtaagtcatcaggcatcatctataaagtccagaggaatctgtttgtgttgtttgaaagggcttgaaggccaggtgcagtggctcatgcctgtaatcccaacactttgggaggctggggcaggtggatcgcttgaggtcaagagtttgagaccagtttggccaacatggtgaaacccgatctctaccaaaaatagaaaaattagccgggcatggaggcaggcgcctgtattcccagctacttgggaggctgaggcagcagaatcgcttgaacccaggaggcagaggttgcagtgagctgagatcgcaccactgtactccagcctggacaacagagcaagactccatctcaaaaaaatatataaataaaaaataaaataaaagaccttgaagattgtgatgatgtagtagcaggtgatttgttccacagaaactataaatcgtgagagcctgaactggcatgccagaaacatgggattccactgctttagtgctgtttttctcctttacaggaatttgaaagggaaaaacacgcccacagtatactgcaatttcagtttgctgaagtcaaggaggccctgaagcaaagagaggaaatgctcgaggtaggtagcattctcctgcttttcttttccttttttccctttggagcattttgtcaggccatgactatcttagcttaggctgcagtaataaaataccatacacagcatggcttaaacaacagaaattaattttcttacaattctggaggctgggagtccaagatcaaggttgggttcaggtgaggcctctcttcctggcctgcagacagccaccttcttgctatatccttcctccaacggtggagaaaaagcaatgtctctgatgtctcttcatataaggacactaatcctatttgatcaggaccccactcttatgacctcatttaaccttaattacttcgtaaaaaccctatctccaaatacagtcacattgggcattagggcttcaacagatgaatttagagggacacaattcattccatggcaattactaaagttttcagttttcttaaatctgagagtttaggctaactctccatccctagatttacgaaacagtccctctcattggtgaacattcctattctttggtgatcttgtatttgtttggggaggtgtggtagacagaataatggtcccccgaagttgcctacatccagatccctggaaactgtaaatatgatgccttacatggttaaagggcccctgcagttgtgatgagagaccttgagagaagggattatcctggattatttgatggaacaagcatccttctaagaggaaggcaactcaaaggcagaagtagaagatgtgacacaggaagctgaggttggagcgatgcgagagaggggccatgagccaaggaaagcagctcagtcttagaagctgaaaaaggcagggaaacagattctccctagagccttccagaaaggcttgattttagcccataagactcattttggacttctgacctctagaattgcaagagaataaatttgtgttttaagctgctgaatttatgacgattcattacaatggcaataagaaactaatacagggttggtttttaattttttgacttaatcggttctttaactgctgccttgaagtgagaatttcacccaaagcaggttttcttcctgcacttcttgaagccggaagtaggacaaggaaaaaaatcctagaatgctgacaatgagttcagggttgatgaggtgaaagagtgcttgcggcctcactcactgtcccagctctcaggttctctctcgggctggggtttttcttcctctttaaccctttatctgctttctgtctgttcctttcctcaggaaatccgacagctacagcagaaacaggcgagttctatcagggagatttctgatcttcaggaaacaatagagtggaaagacaaaaagataggggtaggattcccaagtcttgaaaatctactcaaatgggcagcctgcttagcaaatagagttttttcagagtctttagtttgcaaaaccgcttgtctgagtatgcatgcaactcccacgtgacacaaagtcgtattaatttatttaattttattaagtagtgaatacactaacttatccaaattgatatgaacttggattgtgacacggactctccatggagggtcttgtgaatgcgtagctgtgcgctctgcctgccccgtggctgggccgggccggtggttgttgaaacagctggagtgaggaggacactctgaggaggtctgatgtgtgcaagtccagacgtcttgggattatctgcctggtggtgctttgagaaaaaaaatctaagcaccaccaggcagatatccccactttgaaatcttccccagggaaggtctccacatacccttctccctccacaagaagaaaagaggcagttctacacttagaattgaaggatagggggaacagaaccccacaaagtagttgtcatgattggtaacaacaaatggtttccccaaaatggtgattcctacacatagctctaataaagacgtcgagatacctgcacaaaccatcggcacgttgactcaagccacactgtgtttccactgtcacgctcatcagcacttaggagtgtgtgtgtgtgtgtgtgtgtctgcatgcacgcacactttaggaccacttcatttatctgagatgatggataccaagaatcagtgtataaaaatagtctaaatggctacaacagccgtcctgggaggtgcttaagcaatcccttttctttactgacccctcattcaagtggagactttgcgtaactctaacgcagctgtgaacacgcagacaaagctagaaagtgatgcaaatatagtaacctctggggccccgtgctgtgtccgtgtgcttcaagatgcgcatgtctttcatggagtatgaacagtaacatttcttggattatatatactaagcgaaaagcttaatacttggattttgttagtatctttaggcagagtctctttaatgtctagagtccactagtgttttagatggtagaagcctccttctggttcctgcttctgaagtaacttgctcatctgtgcaaatcttcttctttctcttggctctgctgcacactcaggcattagagaggcagaaagagttctttgattccgtaaggagtgaacgggatgatcttagagaagaagtagtcatgctgaaagaggaattaaaggtatgaagccaaactacagttttatttaaaaaaaaagaaaaaaaatccaggtgacaacagcaaattttgggatgctgtgaatatgtgtgtacataattcattttatgtcatttagttctgttaataattcatatattgggttaactgacagcgatgagatgtaaaataaatgtaggttcagtgggtggtgcccaaggccttttgatgttaataaacatagccaatcttgaatgcaagaattttttgatacattatctaaatttttctcatactcactagtaaattctccaggatattactcagacttagagaattaatttgcctctttatattaaaacccccaatttaaggacttctctagaggaacagtgacttgggtaagtggtttgggcaaggatcccgctaattagactttgagacctactagattacaggtggaagacggttccctgtccttggtgggccacgccaaggcgtcttcagccgctgcttgacacaggtgaagcgccagtggcagcactctgggtgggggggttcctgaaccgtcaccatctgctgcttggcctccagggtcaaagccagagcagtgagccagccagctacaggcttagagctaagattcgtaattctgctccttgaagaggcgatcagttcaggggagttcctcacacacaagggagagagagccacaggcggcaggagggcatgggtgagtgatgtctgcagttgggaagtgctgctgttttcagtgaattctgtttcttttgaatatactgaacattctagccacctctgaattccttctttaacataagtttcgtgtgtctctttcagaacatgtatatatttctttctttatctggtttctctttttaaagaatgcaatcagggttttgaaatgaaaggtcacttggcagtgacttgcttactgctccacttgggggcagcccacaggccactacctgtagttaaaaaggatgcctggtggaagtagcttgtcaccagcaaatgaaagcatggattggaacatctgagaaagaagtagcctttggaggacgatatcccagatttgtgtgtgttgaccgaatatttacgagtgctgcaccctagcatttctcttgtctctgtggagttaccctgtacttcaggaaaaaatggttttcttttttattattgtattaaaacagagtttaacctaatatcactgagtaaatattacgatgagcctatttttgttcccagaaacatggaataatcctaaattcagaaatagctaccaatggagagacttccgacaccctcaataatgttggataccaaggtcctaccaagatgacaaaagaagagttaaatgccctcaagtcgacaggggatgggaccctaggtaagtatttgctttccttcggctcctcacacctttccactcagcattggttcaccctccatgcactgctggggttggagccaccgtcgctgatgggttaacagtcaccagcatgccatttgtttcatcacttcatggtaatttccttgcccacccggtgtggtcacccacgtgttgtctggcatgcatctctgtgtagtgcaccatcaatggctcaagtgaaccttttcttttgctgctcaaagctaccaagcaagactgtgaaggcaaaaggaaaacagtctcaaaattaagtaacaatgtggagagtactatttggttttcctcagacacatatatatctgtacctataaagtgtggctttttaaaccgattctatgacagaattatcaaaagatcagaatggttgaggccgtcaagtcagttggccatatttgcaagccaacatcgacatcctgggcagcattcagcgctttgagggtacggggtgcctgtggacagcaggtccgtctgtgttgcctttttcaagccaccgctcgaggtgggcaggcggccgtggtagtgggtgtggcggtgctgagagtctgagtatgcccacctttgtcagaggggatcctcctttgtatgccacgtgtttgcttctgaaagaatataaaactggggaatccagtagatcagaggaatattttataccattttcaatgatctgatttgtcataatttgtcataagagttggctttgggagaaaccttcagattctggcgtgcagcctgaagttgcagcgtgcaagtgaggcctcatctgtcactggtcaccctctgcgttccagtgttttacaaagaggctggaataaggtcagggtccgtgacttttcattttaatgtagaagctttcatcttatttctttttatttatggaaatgtagacacctccaggccccatcttctcaggcctcgcattccagggaggtacctcattcattatctttatgactattaaagaaacacagctcttttcaattgtgtaaaaaaagttgtggcctagtgcagtggctcacacttctaatcccagcgctgcgggtggccaaggctggaggatcacttaagaccaggaattccaggccagcctggcaacctagcaagattccgtctctagataggtatgtagtatctatataccgttgttgagaaaagataaattaatcaatttccatcatacctttatatgagctacccgaacagctaggaatctgattacgctgctcttactcaaatacacattttataaatctttgataaccattgtgaaatgttgtaagaaccagaaatgtcagttttgaaagtggccttcaaatgacttttgatcacatattccttcagcaaagaattgtaggatccaatatgtatgtttattttaaatctacatatgtatactatttcattaatataaaatgtacgttataaaatatatgcaaagatatgcaaagaagttttagagtaaaactctaaatagaattcctaatatttcccccattttccctgggatatgggcaccccaccatggagatcactgggctataaaattatctagctttgactttcagtaacatagtaccatatctaatctgctggggttttgtttggagagtccaaaaattccaaaacagtttgatgttctttagacgatgaataatttatcatttaatttagtggtcatcttgatcttgaacatttgcctcctgctggtcctctctccctagtcccttagggaatggagcagaggtatcagggcatggacacagggtgttttctcaggaaaacaatagttgagtggcagaagatagatttcctttcatatgagctatttcaaaagcatcttccttgagactgaccttgaggctgcatttctaaaagtgcactgaatattctttttaaaaattacttgaaagctgcttttagggctgtgtgacatggagtgcagtttgacagctgcaaaagtacaagttgtcaagttgttcattgagaagtgagagtggggaattgaaccttcagtctgttcctaaacccatcattgtggattgtttggctgcctgatccagagttctttctatttgttgaaacttaacgtcacctttaaaaatctgtccacacaagatggcaccagcagccactctggcctttgatgtggtggcagtggccctcactgacccaaaatttactaatgcaactgctgctttgccgcacagaactggcaaaggcttgtttctcatgactctttgatgactctgtctttaggaataggggtgggtgggatttggaacgtgtgtttacattctaatgtagattatgtggccgccacatcatggggtcccttcaattttctcaatggtcttttaggaagagccagtgaagtggaggtgaaaaatgaaatcgtggcgaatgtggggaaaagagaaatcttgcacaatactgagaaagaacaacacacagaggacacagtgaaggactgtgtggacatagaggtattccctgctggtgagaataccgaggaccagaaatcctctgaagacactgccccattcctaggaaccttagcaggtgctacctatgaggaacaggttcaaagccaaattcttgagagcagttctctccctgaaaacacagtacaggttgagtcaaatgaggtcatgggtgcaccagatgacaggaccagaactccccttgagccatccaactgttggagtgacttagatggtgggaaccacacagagaatgtgggagaggcagcagtgactcaggttgaagagcaggcaggcacagtggcctcgtgtcctttagggcatagtgatgacacagtttatcatgatgacaaatgtatggtagaggtcccccaagagttagagacaagcacagggcatagtttagagaaagaattcaccaaccaggaagcagctgagcccaaggaggttccagcgcacagtacagaagtaggtagggatcacaacgaagaagagggtgaagaaacaggattaagggacgagaaaccaatcaagacagaagttcctggttctccagcaggaactgagggcaactgtcaggaagcgacaggtccaagtacagtagacactcaaaatgaacccttagatatgaaagagcccgatgaagaaaagagtgaccaacagggagaggcattggactcatcgcagaagaagacaaagaacaagaaaaagaaaaacaagaagaaaaaatccccagtacccgtagaaacccttaaagatgttaaaaaagagttaacgtatcagaacacagatttaagtgaaattaaggaagaagagcaggtaaagtctactgacagaaagtcagcagtggaagcccaaaacgaggtgactgaaaatccaaaacagaaaattgcagcagaaagcagtgaaaatgttgattgtccggagaatcctaaaattaagttggatggaaaacttgaccaagaaggtgatgatgtacaaacagcagctgaggaggtactagctgatggagacacattagattttgaggatgacaccgttcaatcatcaggcccgagggctggtggtgaagaattagatgaaggtgttgcaaaagataatgctaaaatagatggtgccactcaaagcagtcctgcagaaccaaagagcgaagacgcagatcgctgcaccctgcccgaacatgaaagtccctcacaggacattagtgatgcctgtgaagcagaaagtacagagaggtgtgagatgtcagaacatccaagtcagaccgtcaggaaagctttagacagcaatagcctagagaacgatgacttgtcggcaccaggaagagagccagggcacttcaatccagaaagcagagaagataccagaggagggaatgagaagggcaaaagcaaagaagactgtaccatgtcctaagctgaggcaggcggcaggcgcggtgcacaggaagtctcagtgtgaaggggtcttttctctccactgccaatgtaagtagaatgttctaaattcatagagaggcactgtatgacaattaccaggtgctctactgctttaagttatagactgttacttgtagatttccatgtaatcattgaggttatcacccagattagaaagacatatttgttatcagtgtacgttctaattgagagcattccagtagtatcaaacaataatgtctactgtttatagtccacttaataaaaatagaggcatttactatttgccttaggctgataggaatgtgggttttcttgaccaaatatatcagcatctaattgaaatgaccaaatagcattcttagacttctgtattatgaatataattgatatttaaattaatgtcttgttcacatatgtgtactttcatatttgattttaaaatgtacattataacctgtatggtattttatttaaaggagataaacagccaaatagcaaataggtcactgaatgataagatttgcaccttagaacaataatcattttaaggataacaagtaaatgtctgaaagcatgaggggctttatttgcctttacctcatatgagtctttgatcttgaaccgatacttttggatctcattgttgatatacctgaatttactttgtaagagattttaacttcacttcatgctgatgatgtatcaaattcattttatagaaagatttaaagtttttttctggaagtgatatatgtcaaattacatttcctactgcagtatttgagcagggacagtcattttttaaatgtttttggccgggcgtggtggctcatgcctgtaatctcagtacattgggaggccaaggcaggtggatcacctgaggtcaagagttcgaggccagcctggccaacatggtgaaaccctgtctctactaaaaatacaaaaaattggccgggcgtgatggtgggcgcctgtaatcccagccactccagaggctgaggcaggagaatcgcttgaacctgcgaggcagagattgcagtgagccaagatcaagccattgtactccagcctggacaacaagagcgaaactctgtctaaaaaaaaaaaaaaaaacacacacacacacaacacaatgttttcacgcctgtaaacctagcacattgggaagccaaggtgggaggattgcttgaggccaggagttcaaggctgcagtgagctatgattgcacactgtactctagcctgggagacagagtgagacactgtctctaaaaaaaaaaaaaaaaaaaaaaaaagtttttgaaccttaaaatactttgtttgaatttctaatcatcattcaaaagagcagtaaaaaatggttacttgttcttgtacaagctactaattagactatagtaggatattttaaagagctgaatcacttttggtattttggtataaatattttcatttgttatgtcccagtatattcttactggaaaattcttgttttgatctgcctgaagaaaatatctgttttctatataaaaaaattttttaaaataattgtaaagttagatttaaaattgtaaaatataaaatcacaaaggaatgtaccttatgaatgttgttgacattttatgaaattatgtggattcatattactgttacaagatagaattgaatgcaaaaagaccaaaacctcaataaaatttgaggaaaacgtgttattatgtaattgaaataaaaacattttataattgtgcaagcctgtggttccactctttgggctgcttgaagtctgagtctgactactgttgtatgtaataccacctttgagtaatatctgcttgggggttgctgattcctattggggttccgtggaagacccacgcctgatgccctccctcagtaaggaatgcacttccctcctggcatcgagcctggggctagcatgggcattactgggagaactgagacgattgtcacgcaccatcccctgtgatctgtggttctgatgtgcagcctcagctgaaaacggtcttcacctgtggctgtgcttacctgcgccactacttacagtgttttgaagagcaggatgaaaacggcaaaaaccttgactgtttctgctcaagtgtcctgaagtagaggatggtggggatgataaatgcttgctaggaaataagtccaagggctctataggacttcacagggttttagtttatgtctctaactttagcaaagctgcattcctattggaatgcatactggaaacagctctcattcctacctttaaagggctcttggaaagcagtgtgacaaccaaggtcactaaatggtgagatcatcaagccattttaagttctttctcatgttattcaccagcaccctgcaggacgttgggcacacatcacatccctcagctcagccatccagccgtctcagtgattcaccactcatttgcttaattaatagacaggtttgatcactttgtacatggaaggcactgtgccagtgaacaagcagttggacccagccctccagtagggaatggacagctgaaaatccatgagcaagaaagaaggaaaaagaaagagttctgagcagccaaaccatttctcgatgatttcagagccttcattctgagcatcagttatatgctctccagtgtaatgactttatagccaagcacagtaattgatattactgtgaaggcccttaacttatcaagaaatggttgaggccgggcacattggctcatgcctataatcccagcacgtgggaggccgaggcaggcagatcacttaagcccaggagttcaagcccagcctgggcaacatgatgaaagcccatctctacaaaaaaaatatacaaacaattagccaggcatggtggcatgtgcatgtagtcccatgtagtcccagctacttaggaggcagaaacacctgagcctgggaggtcgaggctgcagtgaattgtgctcacaccactgcattccagcctgggtgatggagtgaaaccctgtctcaaaaaaaaagaaagaaaagaaaaagaaagttgacttagctatactccatataagaaggtatagaaatatatagagcaatttagaaaga

SEQ ID NO: 12417 - DNA, 254778 bp, Human
aatatacaaggaactcaaacatcttaacagcaaaaaaaaattgatttaaaaatgggcaagtgatctgaacagacatttctcaaaagacgtacaagtggctaacaaataaagaaaatgcttaacatcactcatcatcaaagaaatacaaatcaaaaccacagtgaggtatcatctcaccccagttaggctgttatcaaaacgacaaaaaacaaaacaaaacaaaacaaaaacaataaaaatgctagtaaggatgcagagaaaaaagaagtcttatactcggtgggaatgtaaactagtacagctactatggagaacagtatggagattcctcaaataactacaaatagaacctttttttttttttttttttttttttgtgaggtggagtctcgctctgtcgccagactgggatgcagtggtgcgatcttgggtcattgcaacctctgcctcccgggttcaagcgattctcctgtctcagcctcccgagtagctgggactacaggcacatgccccacacccagctaatttttgtatttttagtagagacggggtttcaccatgttggccaggatggtctcgatcttttgacctcgtgatccgctctcctcggcctcccaaagtgctgggattgcaggcgtgagcactgcgcccggcccaaatagaactattaataagatatgaatcagcaatcccactactgggcatttatccaaaggaaaggaagtcagtaaaccaaagagacatctgtacccctatgcttattgcaacactaactagtagccaagatagggaatcaacctaggtgtccaacaacaaatgaatggctaaagaagatgtgatgtatatatacacaaaggaacattattcagtataaaaagaatgaaattctatcatttgtgacaacatgaatggaactagaagacattaggttaagtgaaataagccaggaacagaaagttaaacaccacatgttctcactcatatgtggaacctaagaatagttgatctcatagaaataaaaagtagtgcagagaatactagaggctgggaagggaagagggcaggtcagaggatagggagagatttgttaaaggatatagaattacagctagataggaggaataaattctagtggtctgtaccactgtaggctgactatagttaacaatagtatatagtttcaaatacctagaaggaggatattgaatgttctcaacacaaaaaaattatagatgttttagatgatggatatcctaattaccctgatctgatcactatagaccatatgtattgaaatatcactgtgtaccccaggcatatgtacagttattatttgtggattaaaaataaaatttctggccgggtgcagtggctcacgcctgtaatcccagcactttgggaggccgaggagggcggatcatgaggtcaggagatcgagaccatcctggctaacacggtgaaactctgtctctactaagaaatacaaaaaattagccgagcgtggtggcgggcgcctgtagtcccagctacttgggaggctgaggcaggagaatggcataaacctgggaggcagagcttgcagtgagctgagatcgtgccactgcactccagcctgggcgacagagcaagactaaataaataaataaaataaaatttctttttaaaatttatttatttttgagacagagccttactctctctcccaggctggggtgtggtagcacagtcttggctgactgcaacttccgcctcctgggttcaagcgatcctcccacctcagccttctgagtagctagggcatcaccatgcctggctataaaaaataaaatttcattaaaaaaagtattgaagatgaaaagagttctggagaatggttgcacaacaatgtgaatgtacttaacactattgaactgtacatttaaatatagttaaaatggtgaattttatgttacatgtaccttactacaattttaaaaagatacttgtatccagttcctgatagtttcttatgcagtctactagtttttttctctaggacttttgttctgttttcttcagtgttttttcttagtcaagagagtttataatctctcaggtgatttttcatccttttccagctgttccttaattttaaagtatacaagttagccctcatcttaaaaattggacaatactggattgatgtgaagttataatgtttggattttagtttataaatgttaattgaagtatttatcaatttagggagctatgagtggtcattgaatattgaaaaagaactgtttagcttcagatacattcagtataaagcttactcatgatttcatatattgtttttctttctttctaataggctttcaaggatatgctgtattcagctcaggaccaggcaccttctgtggaaggtaagatgaattaacccttaagtttagtcacagaaaacctctttttaaggaaagatattttgtactgcagagtataaaactaatatgataacctgtcctattatataggtctttttttcccttttaataatatatattatgattattttatattttattctaaatttttctcttgtctagctcacctttaccctatgacggatcttttactatgtctttgtgtcaccttaggactgtgaatcgtatatattggtttagtcagaagtttttctgtgtaatgcttccttgccttccctcccctcccctccttcctccgtccataaattacacaacatagcttttcctttctatttatgtcatgcctttagagtgggaccagtaaaacaatggagaatgtttacaatggatgtgtgtgtgtgtgcgtgtgtgtgtgtgtgtgtgtaagcatgtttatgtatacatgtgtacatgttctcgtgtcagtaaataggagctaattcaacaactattcttgagggagaatgttccttctcaggctggatattcttttttattttattttattttattattactatactttaagttttagggtacatgtgcacaatgtgcaggtttgttacatatgtatacatgtgccatgttggtgtgctgcacccattaactcgtcgtttagcattaggtatatctcctaatgctatccctccccccaccccacaacagtccctggtgtgtgatgttccccttcctgtgaccatgtgttctcattgttcaattcccacctatgagtgagaacatgtggtgtttggttttttgtccttgcgatagtttgctgagaatgatggtttccagtttcatccatgaccctacaaaggacatgaactcatcattttttatggctgcatagtattccatggtgtatctgtgccacattttcttaatccagtctattgttgttggacatttgggttggttccaagtctttgctattgtgaatagtgctgctataaacatacgtgtgcatgtgtctttatagcagcgtgatttataatcctttgggtatatacccagtaatgggatggctgggtcaaatggtatttctagttgtagatccctgaggaatcaccacaccgacttccacaatggttgaactagtttatggtcccaccgacagtgtaaaagtgttcctatttctccacatcctctccagcacctgttgtttcctgactttttaatgatcatcattctaactggtgtgagatggtatcccattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttcagttcattgtagattctggatattagccctttgtcagatgagcaggttgcaaaaattttctcccattctgtaggttgcctgttcactctgatggtagtttcttttgctgtgcagaagctctttagtttaattcgatcccatttgtcaattttggcttttgttgccattgcttttggtgttttagacatgaagtccttgcccatgcctatgtcctgaattaccggtattgcctaggttttcttctagggtttttatggttttaggtctgacatttaagtctttaatccatcttgaattaatttttctataaggtgtaaggaagggatccagtttcagctttctacatatggctagccagttttcccagcaccatttattaaatagagaatcctttccccattgcttgtttttgtcaggtttgtcaaagatcagatggttgtagatatgcggcattatttctgagggctctgtgctgttccattgatctatatctctgttttggtaccagtaccatgctgttttggtccagtaccatgctgttttggttactgtagccttgtagtatagtttgaagtcaggtagcgtgatgcctccggctttcttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacaatattgattcttcctacccatgagcatggaatgttcttccatttttttgtatcctcttttatttgattgagcagtggtttgtagttctccctgaagaggtccttcacatcccttttaagttggattcctaggtattttattctctttgaagcaatggtgaatgggagttcactcatgatttggctctctgtttgtctgttattggtgtataacaatgcttgtgatttttgtacattgattctgtatcctgagactttgctgaagttgcttatcagcttgagattctgggctgagacgatgaggttttctagatatacaatcatgtcatctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagcgttgttgaattttgtcaatggccttttctgcatctattgagataatcatgtgatttttgtctttggttctgtttatatgttggattacatttattgatttgcgtatgttgaaccagccttgcatcccagggttgaagcccacttgatcatggtggataagctttttgatgtgctgctggatttggtttgtcagtattttattgaggatttttgcatcgatgttcatgaaggatattggtctaaaattctctttttttgttgtgtctctgccaggctttggtatcaggatgatgctggcctcataaaatgagttagggaggattccctctttttctattgattggaatagtttcagaaggaatggtaccagctcctctttgtacctctggtagaattcggctgtgaatccatctggtcctggactttttttggttggtaagctattgattattgcctcaatttcagagcctgttattggtctattcagagattcaacttcttcatggtttagtcttggggaggatgtatgtgtcgaggaatttatccatttcttctagattttctagtttatgtgcgtagaggtgtttatagtattctctggtggtagtttgtatttctgtgggatcggtggtgatatcccctttatcattttttattgtgtctatttgattcttctctcttttcttctttattagtcttactagtggtctatcaattttgttgatcttttcaaaaaaccagctcctggattcattaatttttgaagggttttttttgtctctatttccttcagttctgctctgatcttagttatttcttgccttctgctagcttttgaatgtgtttgctcttgcttttctagttcttttaatcgtggtgttagggtgtcaattttagatctttcctgctttctcttgtgggcatttagtgctataaattttcctctacacactgctttgaatgtgtcccagagattctggtatgttgtgtctttgttctcgctggtttcaaagaacatctttatttctgccttcattttgttatgtacccagtagtcattcaggagcaggttgttcagtttcccatgtagttgagcggttttgagtgagtttcttaatcctgagttctagtttgattgcactgtggtctgagagacagtttgttataatttctgttcttttacatttgctgaggagtgctttacttccaactatgtggtcagttttggagtaggtgtggtgtggtgctgaaaagaatgtatattctgttatttggggtggagagttctgtagatgtctattaggtccgcttggtgcagagctgagttcaattcctgggtatccttgttagctttctgtctcgttgatctgtctgatgttgacagtggggtgttaaagtctcccattgctggatattgttttaacactccacatcaggtttttaaaatgagagttgagtgcaaaaaaatatatatcgagaatattctaagttggatgtacagaataatacctttataagacaccaaattctatgaagttattctagtgacaagctattagagacttgttcttatgacaaaagttaatgaagttatttaataaaactgtagatttatagtagaaagtctcatttcatcaattatataaaaatatccatctttcatctcaaaccattctgaattaaaaatgtatttcctctgaacgtgtaaaaatctcttgccttatattaagtcaggaattggcatttagtttcatgtcactgaattttagactataatatatttaattctctaatatttaactcaagacacttaaggtttaacagtaagtttagttttctgttgggttatcttttattttatatgccgtaaagaatacctcctttaactatttttaaaatataagaaaaatgaaattccatagaagctgaactgattccttaccctgagtaagttgctttaatattggttctcttattttactattctgtttgtaacaaagatactctgagatatattgaaaatgatgatgatatttattcatcccctttatgctggagcatgtttcttgtattttttaaattttctttcagctattattagagaaaaactgaattttgtgaaagtacgctcaaaatgacaaatatttatagttaagagccttttctttcattatccagagacattaacttctttgggccatgttataggggaagtattgtaggaacatgtactactttcacaagaaaaacatctgcacacattctttctttatactttcatgtaaacatactataaaactagttttatagtgaattagtagcttcttagtaggacatttcagggtggtacctttacttcattgataaaataggctttttctcaaaagtaagtcaacaaaacaatttcagtgtattgagaaattatgtttactttaatttgctctctgttactcaaacaaataaacacattcaaattcctagttgttttgtttcgtcctttgagagtgaatttcatgaatcagttatacattgcaaacaaatctctatttaaaataaatgttttatgattataactaggaagtgctaatattctgaaataatatagataaggatttactctcaggtattccttatcaatatatatgtaaatatatattttagatatatttctgatatatttcattatctactcttctatgtaatcactggtatttctgatataattctgatatatttcattacctactcttctatgtaatcactggtatttttgtgtaaccatttacattggaaatatgtgactgagatgttgacttagaattctgtgttacagattatacagtatgttattaatttttttttttttttttttgagacagtgtcttgctctctctcccaggctggagtgcagtggcgtgatctcggctcgctgcaacttccgcctcctgggggttcaagtgattctcctgcctcagcctcctgtgtggctgggattacaggtgcctgccaccatgcccgactaatttttgtatttttagtagagatggggttttgccatgttaacctgcctggccaacatggccagttttgccatgttggccaggctggtctcgaactcctgacctcaagtgatccacccaccttggcctcccaaagtgctaggattacaggtgtgagccactgcgcccagcctattgattttttaaataatgcatatttaaatttttactattttgttatccttttctgcagaaagacttgtaaatatagaatacatggcagtagattaggggattaaagtgactagaattgtggggtttttataattcctgatgtcagtgagtatactacctcttgatatttgtaacaaattatattaaactgcaaactggaggtttcccatcagtgcatcagtcagtcataccttaataatcaggattgttctgaggcaagataattttttacctttataggttaagtataacaattcttacatatagtacccgtttgacattgtgtcaagttttcagtgatacagaactgtggaaaatataaagtgaaatatcttttaccttttctcatgctccccactcccagtttgctgtctcagtaattttatggaattaatctacgtgggtaaatgctcacatccttacatctttatttttttttaaactgcctgtcttccctctttcccaggatacttttgaaattagatatatataaattacatgctgtatttgattaatctattttagtttttactctgaattaattgcaaggaaagcttcaaacttcattttgtcgtattctttttaaaatgtattttttgtttaaaagcataagtgttttctactctttatttgtgatggaaaaatatgagaatccaatagtcaaccaaggtaacggaactaagaaattgacatttctaatggaaagggacattaaaagataattttgcttaacctttgttttagatttgtgcattctgagaccactttaaggttgcatgactcagtaatgacagttgggattattaatgctctatttgacaacaaaagagaattctggagattaatataaaaagactttttaaaaaatgactttgcatttttctctaaatgatatatttgaatataattttaattggacatttccttgtgtctctatttttaaaagatttaagaattttttaaaacattactttgaaaaatactagactatttaacttgttagaaaaaagcaaattgtctctttcaataaatttctctcctaatttttttattactccatatagttcccagaagtattggggaaggtttatagaataagatagcacatattagataacagtagatacagagcttagaataaggggaaaatgaagacagaatagtgagagtaaaactagagtaaatttaatacatagaatagataccatgaggattctggaacagaaaaagaacatcaggcataaactagagaaatctgggtaatgtatggactttagttaataataatgtatcattattgattcattgattgcgacaaatgtaccatatttatgtaagacgttaatgataggggcagctgggtttagaggatattggaactctctgtactatctttgcaccttttctgtaaatctaaaactattctaaggttaaaagtttatttgcccatttgtgatggctgacacctgtaatcccagaactttgggagaccaaggctggcatattacttgaggtcaggagtttgagaccagcctggacaacatggtgaaatcacgtctctactaaaaatacaaaaattagctgggtgtggtggcgcatgcctgtaaacctggctactctggaggctaagcaatgagaattgcttgaacccaggagatgaaggttgcagtgagctgagattgtgccactgctctctggcctgggtgaaacagcaagactctgtctaaaaaaaaaaaaaaagtgtatttaaataaaatagataccgtaaggttttgtaccattgacagaatgtaaattcagctctgaattttcagaggatagaagaagacattatttcaaaattgatataaggtgaatttacaccagttcctcagaaaaagtagcttttactgaacatgaaatttgagaggaaattcttccttggactctcatggagagtcttttgtttctgtgttgaacagtatctccaacaatagttttacaaagaacatgacggtgagttttaataggctgcttcttataatccaaggatgtaatgtaaaaatgtattactatgaactacaattcctaaataatctggtcttaaatcataaatgtccatgatctcaccttctacatttcccccattttttcctaggctcctttctttacctaaatcaggccaagcttcctcttgcagtctaatatagccacttagtcactttatattgcttcactgtagtttatttctttgcatagcatttgttacttactgatatcttgttttaaaaattgattaattctctttctgggatgtaagtctcttgtgactagtgattatgactttttaaaatttttatatctagtatccgaaataggcatgtagtttacatatttacttgacacatcattgagtaggaataaaagtgaatccttttcctcaattccttgaagccaatgtactgtttataaaaaaaggagtaaattaacctaggttgcttctctatgtgtgtgtgtgttttaaaaatttttcaaattctcttgatctattatgtttagatgcagaattttacctgctggttagatggccaaacatattattagtagttgttgttttacagtactggcattttggtttcataaggtatagtctgagatgacacatacggtattttttaaaattagtagaggagcagatgatacaagattataattttaaaggttttttgtttttgtggcatcatgttttattgctgagaaactatattttatgaagtattgagagactatgtattttgtcaaaacaccaattaaaccgtttctttttgtgtttttatgtttagtatgcctcctttcaaagatacatgaaattggcatagatttgaaagaccatatgtgagttgttagaggattttttgatatatatctactcagtggaatgtattttttagactatttaaattaaaatagacctattgcttgatagttttccttgtatattttgcttatctttttatcttacaatacattccttttgatggagagtgtacatagctaatgttagcttaattcatctctgactcagcttaatacagctatctgactttctgaaattggatgaataaatagagataaggacataagtaactggccaccacactagtctctgtttttctgccatttcttctttagtctccctgttccctctccagtcttgtgaacaggttttgttagaaattttggcttaggttctctctgcttattctgcttggttagcagatgtgttacagtctccctaagctccttagaattcagttcttagtgacattgaagatgaaagtgcgcttgtaaattattcattcttattatacgcttcaatggacagggtctacttcaagcatcttcttccatgtcacccctgtccctagatctttgttgttttaacagatgtgagcttgctttttaattctggagaatggaagactgaattgcatttctaaaattcatgaagtagtttttgcatttataggattactgtcaaatatgtgcatttatataacattactttttcatgttattttaaatcttgtcccctctccccagtttccactttgttatcctgcatatttgtctctaaaaaaattatttacatgacttttctgacctagctataaaacagtttgatgtttataataggcagagctatatttaatttgctacattttcagctgggcaaaggcaggagagtagcttttctaagttccatttttctgttagcattgttttgtcagtaaggtaccctagtcatttattgtctctgcttgaagtgggataatgttgcatgagaagactatacaagggactagtagtgaggttaaccccaagaatgaagtggtagatctatctgtaggcactgagccttgttgtgagagccataaagaaatacagatggctaagagtggaggttgagacaatagcaagccaacaaaatagttgccatctctttaagaatgatatattttattcttcattaactccctttaggaaggatgaaaagttctgattgatactcaaagtcatgtaatggagttatttctgaagggtgtgccttattatttgtttcatgtttacattggaaagtgatttgcatattcatttgtattatgaaaatgacagcttgtagataacaagaactattaacttcaaaaatggactcgtatattctataaagatgtcactaacttcagtctagttcactaagaggcaaggtgtacttctgaagaacaaatagcattgctatttgatttgaagaaatatctacttctttttcacagaaagagaattagatctaatttaatgctcattgttatgacgttagataatgatataaatagtaaaattatgttatgataacaaatataatttttagtagcatacaggtaggaagctggaagcaatgaagaaatgttataaacacgggtttataatcctttctttgtgacactgtttaatgcatctttagtgtttaaaatatttcatcacctgtaaaagtcactaatatatgaagtcactgttttagttatcacacagtgtcatttcctttttattgtcaagtttgagagaaggtaatgaaatagggaagagataatgataaaacattaaatcatggaacaaaaaagttctgggaattacaaatgtagactctacgttgtagaggaaaagataccagcagatgaatctgatgatttcagatagaatttcctgaagtagacattagaaagctggagcaattgttaaagtttaaagttggcagagttcaaagtaagggaagttcctttttgagttgttttcattttctttaggcaagaccacctaaggtgttcagtaaagaaacaacgagaaagctagaaagaagcatatgaagttgtgatcagagagtagtggttttccagtattaggtatcattgaataaaggaaaaattcctgccactgaaatggaagagatactctaaaaatcatttggagtagcattgacttcagttatctgaggcagtatgaagaaaaaaaggtagtcaataattggaaaagtagataacctcttgcattagtttccttcggttgctgtaaaaaccacagacctggtggcttaaaatgacagacatttattctctcacagttttggaggccagaagtctgaaatcaaggtgtctgcagggctaccttccttctggaattctgagagagtatctgttttttgcctcttacagcttctggtggttgctggctttcttggcttgtggccactccaatccgtgcctctttaccttgtcctttgtctgtcctctgggtatctaaggacatttgtcattggatttaaggtctgcctggacaatccaggatgatgtcatctcaagatctataattacattacaaagactcttttttccaataagatcacatcacagattctagggatttgatatagatatctttttttggtggaggggaaggaacacttttgtgcctaccatattcttaaaaaaatttttgttgttgttgttgttttagagacaggatcttactctgtcatctaggctgtagtgcagtggcaaaatcatagcccactgcagcctcaaactccggagctcagtagactgtcccacctcagtctcccgagtagctaggactacaggcgcatgccagtgtgcctggataattaaagaaatttttttgtagagacagggtcttgctatgttgcctaggctgatcttgaactcctggggtcaagcgatcctcttgcctggcctcccaaagtgctgggattataggcatgagctgccattctcagcctactatatccatgcttttacatttaaaaaaatattataatgttcttcaaattgtgaactagagcttgaagtccaaatgaggcatttgcttcacgtgtttctacctgctgtattgtgaaaggagcagtcaaatggtgtcaaagaaatattcaggtatgatcccggaaagtgaaaaactggccaatagatattagtcagacttgagtgtataaaatatagtaaaggaccatttatctgcctctagtgatagttacctgcaaaatattccaagttatacctcaaatttatctttatttctgatatccttcctgggggaaacaaggaccacaaatctctttttagtacactggatcaatgtattccccttccccaattttttttttgattgtggaactttttaaagacataaaaaagtggtgaggatgtataaagaaccccatttttcaacaatcgagctttaaccattatcagtgaaggggctaatcttgtgtcaccccgactcctgattgttgtgtgcacacacacacacacacacacacacaccatgttttctttatctgttcatctgttgattccatatcttggctattgtgaatagtgctgcaatatgcatgttggtgctgatatccctttgatatactaattttcttttctttggattgggggattaagtggtcattctatttttagtttttttcagaaacctccaatctgtcgttcccagtggctgtagtaatttacattcccaccaacagtgaataagagtccccttttctctgcatcttcagcagtattgttatttttgtctttttgataatagttattctaactggggtaagttgatatctcattgtggttttgatttgcgtttccctgatgattagtgatattgagcacttttttcatatacctattggccatttgtatgtcttcttctgagaaatgtccattcaaatcctttgcccactttgtaatgggattgctttttcattattgagttgtttgagttccttgggtattctggatactatttgcttttcagatgaatagtttgcagatattttctcccactctgcaggtgctgtcttcactctgttgattgtttcctttgctgtgcagaagccttttagtttaatgtagtcccatttgtgtgtgtgtgtgtgtgtgtgtgtgtgtgtgtgtgtatgcgcgcgcacgcgcgcgcttttgttgcctgcgcttttgaagtcttagtcatgaaatgttttctcagaccaatgttctgaaacatatccctttgttttcttctggtagttttatagtttcaggtcttacatttaagtcttctgtccattttgagttgatttttgtgtgtggtgagagagggggatctagtttcatttttctgcatatggatatccagttttcccagcaccattttttgaagaggttgttctttctccagtgtatgttctggagcctttgttgatagtcagttttctgtaaatatgtgggtttatttttggattctttattctgttccaatggcctgtgtgtatgtagttagtccagtatcttgctattttggttactatagctttgtagtatactttgaagtcaggtagtgtgatgccttcagctctgttctttttgcttgggattgctttggttattcggagtcttttgtggttccatgcaaattttgggatttttttttctatttctgtgaagaatatcattgcattttgatagggattgtattgaatctgtagattgctttgggtagtgtggtcattttaatgctattaattcttctgacccatgagcatgggatatctttctgtttgtgttgtcttcagtttctttcattggtgttttgtagttctcatcgtagaggccttttgcctccttcgttaaatttattcctgggtgtgtgtgtgtgtgtgtgtgtgtgtgtgtgtgtgtgtgtgtgtatatatatatatatatatatattatggtagctattgtaaatgagattgctttcttttcagttcattattggtgtatagaaaccctactgattttttgtatgcttattttgtatcctacaactttacggaatttatcacttctaagaggtttttttggtggaattgttaggtttttctatatctaagatcatgtcatctataaagcaggacaacttgactttctcatttccaatttgggttcctttttatttctttctcttgcctgattgctctggctaggaatttcagtactatgttgaataagaatggtgaaagtgggcaagaatggtgaaagtgggcaagaatggtgaaagtgggcagttgttacaaggaaggctttcacctttccccttcagtatgatgttggctgtgggtttgtcatatatggcctttattatgttgagatatgctctttctatgcctagtttgttgagagtttttatcatgaaaggacattgaattttatcagatgcttttttgtgtgtgtctattgagatgagcatacggtttttgttttctggtgatgtgatatttcacatttattgatttgtgtatgttgagccatccttgcatccctgggataaatcccacttgatcgtggtgcattatctttttgatgtattgatggattttgtttgttaatattttgttgaggatttttgcttctgtgtttgtcagagatattggcctgtagtttttttgttgtgtctttgtctgattttgttattggggtaatgctggccttgtagaatgagttaggaagagttttctcctctccagttttttggaatagcttgaggagaattattgttagttatttacaggtttggtaggattcagcagtaaagccatccaatcctggaattttcttggttgggagactttttattactgattcagtcttactactcgttattggtcttttcaggttttctgtttcttcctgattcaatcttggtaggttgttcaggaacttaaacattttctccaagttttaaaatttgttagcattaatttgttcataatagtgtctaataagtttgtatttctgtgggatcagttatagtgtctccttttttctttctaattttatatgggtcttctttttttcatggttagtctgactagtagtttatccattttattttttcaaaaactttattttgctgattgtttgtatatttttttagtctctatttttgtttatttctgctctgatctttattattgcttttcttctcctgatttgggtttggcttgttcttgcttttctagttcattgaggtgtatcattaaataatttgaaatccctctacttgtttgatataggtatttattgctataaactttcctcagcactgttttaacagtgtcctgtaggtttgggtatgttgtggttctattttcacttgttttaagacatttaaaatttttctttttaatttctgtattgacccagtggtcattgaggagcatgttgttaattttcatgtatttgtatagattccgaagttcctcttgttattgatttatagttttattccattgtggtctgagaagttacttgacattattttgattttttaaaaattcttgagatttgttttgtggcctaacatatggtctgtcctagagaatgttccatatgctgatgagaagaatgtttattctgcacctgttgggtgaaatgttctataagtgtctgttgggtccatctagtttaagtgcagttaagatgtttatttgtttattttctgtcgagatgattgatccaatggtgagagtagggtgttgaagttcccaactattagtgtattggaatctctttctttagatctagcatttgccttaaatatctgggtgctctggtgttgggtacatacatgtttagaattgttacatcttcttgctgaattgatttttttatcattatttaatgaccttctttgtctcattttacagtttttgacttaaagtttgttttatctgataacaactcctgctcacttttggtttccatttgcgggagatatttttttccttccctttcagtctatatgtgtctttacaggtgaaatgggtttctggtaggcagcatataggtggatcatgtttaaaaaatccattcagctagtatgtatcttttaagtggggaatttaatccatttacactcaaggttattattgataggtgaggacttgttcctgtaattttgttcattattttctgttaattttatacatcctttgcttttttcttctgttcttgtttatcatgtggtttggtggttttctgtagtgacaacatttgtctccattttctttctcatttttgtgtatctgctgtaccagtgaattttatacttcagtgtgttttcatgatggtagatattattctttagctttcagatgtagaattcccttaagtattttaggactggtttagtggtgatgaatgaatgccctcagtttttgcacatttggaaaaaaaaatatttctccttcattttttagggatggctttgttgggcatagtattcttggctggcaggtttttttcttccagcactttgaatatatcatctcattatcttctgacctgtaaggtttgtagtgagaaatctgctgttagtctgatggtaattacttgatacgtgacttgacaattttctcttgatgttttcagaattctctctttgtctttgacttttgatagtttgactataatatgcttggcggaggacctttgtgggttgaatctgtttgggaattattgagcttctggatctggataaccaaatctcttgcaagtcttggagagttttcagttattttgttaaataggctttttatatctttacccatcatttcaccttctgggattcctagaattagaatatttgtctgctttatagtgtcccatatgtcacataggctttctttagtttcttttattctttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacgtgtgcatgtgtctttagagcagcatgatttatagtcctttgggtatatacccagtaatgggatggctgggtcaaatggtatttctagttctagatccctaaggaatcgccatactgacttccactatggttgaactagtttacagtcccaccaacagtgtaaaagtgttcctatttctccacatcctctccagcacctgttgtttcctgactttttaatgattgccattctaactggtgtgaggtggtatctcattgtggttttgatttgcatttctctgatggccagtgatgatgagcattttttcatgtggtttttggctgcctaaatgtcttcttttgagaagtgtctgttcatgtccttcacccactttttgatggggttgtttgtttttttcttgtaaatctgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcagttgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagaatgatattggctgtgggtttgtcatagatagctcttattattttgaaatacgtcccatcaatacctaatttattgagagtttttagcatgaagggttgttgaattttgtcaaaggctttttctgcatctattgagataatcacgtggtttttgtctttggctctgtttatatgctggattacatttattgatttgtgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctatcgattggaatagtttcagaaggaatggtactagttcctcctcgtatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacgctgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattctttctttctttatttttttttgtactgactgggttatttaaaaagacttgtcttcaagttcagaaattctttcttctgcttgatctagtctgttgttgaagctctcgattgtatcttttatttcattcattgactacttcagttctaggatttttttgatttttaaaaatggtatctttttgttgactttctcattccgatcatgaattattttcctgatttctttatattgtttatctgtgttctcattgagtttctttaatattattttgaattgtttttcaggcatttcataaatttctcttttttgggattttttttctttttactggagaacttgtgtttctttggagatatcatattttcttgctttttcatgtttcttgcatccttatgctgatatctgcacctctgatttaacagtcacttcttccaattttatggattgactttcttagagaaagactttttcctgtaggcataactgtagtgttgattgggtaggttgctttggttttgattctgggtagggcagtagtgtagtttctgaattatttatgtagctttaattagtgtcagtggtatctatgagtttctcattggcttagactgtgttttttagtgaaggctgtttgaggctttgctagggatgaaaacactagaccagctagtccttgggcaccagtggtggtggcagtgggcaaggtgggcaaggtggacatgtccccaagccactggatggcatgtgtggatgccagcagtagtgatcagggtgggttgattcccaggtcactagttggcacgctcagactcaagcagtggtggtgatgggtggagtgggcttgtcttcagttcctagacatcatatatgtatgtcagcagtgggcagagcagacctatctgcaggcctctggataacgcatgcgggtgccagcatcagttgggtgggtatttcccagttcctaggctcccagatgatgtgcgcaggtgttggccatggttagcagggcagacctcttctcaggcccctgattatgcacataatgcaccaatggtaggcagggcagatcagtcctcagtcatcctgatgacaggcgcagctactggcagcagtggtgaacaagggcaggactaccctcatgcccccagattttttacatggcccctaattgttttatgtgtattttaagatttattagcttgaatagggacccaaataagattcatcatacaatatattgtgattgattagtaggtctcttaatttttcattggtttgtaatgacaccatttggtacagaaggcactagccatatgtagctatttacattgattaaaactgaaatgaattaatctggtccttagttgccctacccatatatcgagtactcagtagcgatatgaggttaggggctaccatactggacagtacagattatttctcttattacagaaaattctgtttgttagagctaatttataggtttctgctgcatctcttttttttcttgaatttttggtttgtctttttacaattttattattgttgttgttattttttgatggaagaaactggcttattcaggttttttgtttttgtctcccagagtctggattttgctgattgtactcctgtggtgcatcttagcatagtttctgttctctttatttacagtaaatttgtagttaaatctagaagcttgtttctattctgactatatataatgtgtgtatgtatttttctcaagaacactataggtgctggatatatatatatatatatatatatatatatattatcagattatctgttttgttactactggtgatcattgcctaaccctagatcttttaattcattaaggtttacaaaatggtgatatcctaatgctcctgtgtttattagccagaattcttctataaagggaaacttccctttgtcaattatttggttattcttacatacagattgtataggaaagatagcataaatgcttaattatttccctttgtttacctttttcaaaataatgttgattctgtaacatttttccaaagatgaccagtgaaacattttaagtgtcttattcaatttgtatatttcaatatatttggtatattttggtacagtgcagttttatccctattaatgattaaattctcatctttggccagtgggagcctattcagttggttttctcattccttttgatagactcttagtatcctattataacttcttttctatttgatattacaaaaatttccagacttgacatatatatttccagcctgggacctccaatcagccatttttccagggactgttggttgtttttttttttttttttttttttttaagtaataatcatggaatcttacttccttttagacaccacatactggacactgctttggaagtatcattgctactgggttattcactgtttcaggctttctgtttcatggaacagaaatgcatgcatatatacactcttataaatataaatgtatatatatattttaggataaaattctttattctttaaagcttaaagtcttagtacactttggatttgacaaaatgtgtctactgtagctgaaaagataaactgcgatgattttaagcattaagtaatactcttaggcatggcaaccacaagcataactttttgggattagggtattgggggtgggggatctacctgtattgattaaaatttcattttcttattgaaggttgaaaggtgaaagattgtttgtcaccttcgaaacagagtgccaattcgtgtttcctgatgagaaattgaccagctatgtgtttactgtaagaggtgcaatcagtgaaattggaaaaggaaattgaatttatattggtgtattatcccatgcagttaattttgcaaataccctaatgcacatgaattttatttgaggttgagatgcctatatttactctgaaacaaagtgttggaaatgtagtgtgattaaatacatttcaaattttctcttgttccacaattgctgtgcagttccaaaatatgttcttattaggttcctcacaaaggaatcttttggccattacaacaagaaaatgagatagttaattttaaaggatacatcaaaataagataatttacattgtaagatttattattttcacgttcctgttttttctgtatgggatcctctaacatgttagcaaaacaatatgtcgtctttctataagactataatttccacttaaggaaaactatgatatgattcactcttgacatggcaaaaaaaagttaggttaataaatttacagcaaagaagaatttttaacaatacaaaagtaacacaatatattaggtagatatcctcagaagcagtttattcgcaatggccatgaaagaatcttcctaaaagtagtagtaagagaatgactaatggagaaaaagggatttgaactggatcttgaagcatggttaacatttagatagccttaggagagggccttctaagcacagagaagcaacaagacgaaaccaaaagaatgcacatttctaagacattcagggaagatttagtagaacacttaaaatgaagcatggagggttatcactggagaatagttagctgtatggataaagccagcttcccaaggagcttaaataatttaaaaagttggactttatttggtagactagtgtattctaagatttggagttactagtttaatgcagactggatttatagaccttcgtgggttccttgttctgattcagaagtatccataaaaatataggctttgtgctgtcttgaactgattaagtctaaggaatgcaggcttcaggtatggtcccattgagtttccggctctactttttaaaatgattcttacagctgtgtcattatccatgttggagttctccaggtatctgtcagcaacaattagagccatatgctcccttcttcaggaatactggaaaaaatagatgcatgattttcaattagctgtatgacccagaatatgcatagaaatactgtctttttcatgtgaaaattcacataacacaaaataaccattttgattgcatttagtacattcactgttgtacaacatctacatctatcaagacacagaagctttttttttttttccccgaggcagagtctcgcactgtcacccaggctggagtgcagtggcatgatctctgctcactgcaacctccgccttccgagttcaagcaattctcctgcctcagcctcctgagtagctgggattacaggtgcaagccaccatgcctggctatttttttttattttttatttttagtagagacaggattttaccatgttggccaggctggtctcgaactcctgacctcgtgatctgcccacctcgatatcccaaagtgttgggattacaggcgtgaaccaccatggccagccctacagaagcattcttaaatggaatttatttaagctgaaaacagtattttctataaagtaatattttggcatatgtttttctagctaatttttcagtcaatatcagttgtagaaatatgtattttaaaaaagaaatatttacttgtattaagagttaagatttctaattttggagaatcaacaaaaataacggtcagaatagaatttttatcttgacagtagttggaagaatagttacatggtgagaaaaccaggatagatttttaaatcattttttaaaaaacttttaagttcagacttacatgtataggtttgttacataggtaagtttaaatcatggggatttgttgtatagattatttcatcaaccaggtattaagcctagtacccattagttatttttcctgatcctctccctcctaccctccaccctccgataggctagtgtgtgttgctcccctctatgtatctatgtattttcatcatttagcttccacttataagtgagaacacaaatagaatgaagtgcagtggtttaattttaatagtggaattgtttttcaagttatacctgtccctgctgtcctttggacttgagagattctacctttttaaagtacctacataacactatctgaatagggctgtggaatataggcagacccaattctcccctgttcctgtttatagattttgtgttgtgaacctagaaggattgtgcttcctgattttagttttctttttcttgtctttactgcaactctccagaaaacctacagaatgtttattggaaacaccttggtagaagagaagtgttgtttgttgtaaacataaatcctaatcttttgtgcaaaatattttagaaatattttaacttttatttcttagtaagagacctttcagggtcctgattatggttgtggagatctttattatccattactaatttttctcattgtttctttttgtctttttggaggtagtgatattggtgctgaagtagtgatgtgaggatgatggcagtagtatttctaattagcatttcttgttgaggtcttttagaacgcctagttggaaatttaaataaaacaattaggtcaaatgaatttagaaaagctgaatagactatttaggcacaatattcggccaatatgaaaaaactggaaaaaatagatacatgatttttaattagctgcgtgatactgtttttagattaataagtaaaaggaagtttaattgaacatctattacaaataggagttttcagaattttcaggtggatgtaatcagtagccagtggtttttgcctactgtttttgtggatagtagcatctgactctcatgtcatctgtgatttacaagactgcatctaaagaagtatgttcaatttcctgtttttgttttgtttaataaacactttgtaattccttactatgtgtgtttgaggtgatgaaaattttggagataatagtgatgatggttgcacaacattatgaacgtacttaatgccattgaattgtactcttaatattggttaaaatggtagaattaatgttatatatattttaccacaataaataaaaggcaggacaaattttatcagtaaatttacgtttctggaagatttagttctaaaattttttagtggagattttattgcaaggtgatttttttttttaacctatattcctggcataactgactcctatttttagccctaaatattcaaaagaacaggaaaacgtgactctgcatatgactttccttaaatattttttgaatgttttatttgaaatatcatgcaactaaaaatttcaaactctttcataaaggtaatgtttaattttttatgttgtaaagttaaatattgttttttaacaaaaattttccccaaaatgaaatgtcgaatttgcatttttaaaagataatttttaaatctttatcttcagatagctgtagtcttataagcatgtaaagtttttttttttttttgggggggggggggcgggggcggggacaagtctcgctctgtcgcccaggctggagtgcagtggcacgatcttggctcactgtaacctccatctcccaggttcaagcagttctcctgcctcagcctcctgagtagctgggattacaggcgcccaccaccacacccggctgatttttgtatttttactagagatggggtttcaccatgttggccaggctggtctcaaactcctgacctcaggtgatccacccgcctcggcctcccaaagtgctgggattacagacaggcatgagccgccgtgcccggccataagcatgtaaagttttaaagaaaagcagcttttatctctcctggttagtgtgttttttaaacagcttttttgaagtataattgacatttaataaactgtatatatttaaagtgtgcaatttgataagttatgacatttgtatacactggcgaaaccataaccacactcaagatagtgaacatatccatcacccccaagagtttcctcatacctttttgtaatctctgcttcccaccgcatctcactctatcccttctcagtcaaacactgattggctttctttcactgttgatcagtttacattttctaaagttttatatgtatttagacagtatgtactcttgtttgtctggcttctttcagtcaacctaattattttgagattccaaagtagcagtgcaattttacgttcacttagaatgtgtcaatgtttcattttttttccatgtcttcaccaatacttggtattgtcaatctatttaattttagtcattacaataggaatgtggtgttacctcgttgtgtttttaatttacattttccaaatgactaacgatattgagacttttcctatttatttgccgttggtatatcttctttaggaaaatgttcaaatcttttgcctatttgaaaaattgggttgtttttctcctattcttgagttttgagggtttttttttttttaatttttttatttttattttcgagatggagttttgctctgtcacctaggctggagtgcaatagcgtgatctcagctcactgcaacctctgcctcccaggttcaagcaattctcctgcctcagcctccctagtagctggtactacaggcacctggctaatttttgcatttttagtagagacagggcttcaccatgttggccaggctggtctcgaactcctgaccttgtgatctccccgtcttcgcctcccaaagtgctgggattacaggtgtgagccaccacacctggcctgtttaatttagttttttttttttttttaattgatcattcttgggtgtttctcgcagagggggatttggcagggtcataggacaatagtgtagggaaggtcagcagataaacaagtgaacaaaggtctctggttttcctaggcagaggaccctggggccttctgcagtgtttgtgtccctgggtacttgagattagggagtggtgatgactcttaacgagcatgctgccttcaagcatctgtttaacaaagcacatattgcgccgcccttaatccctttaaccctgagtggacacagcacatgtttcagagagcaccgggttgggggtaaggtcacagatcaacagcatcccaaggcagaagaatttttcttagtacagaacaaaatggagtctcctatgtccacttctttctacacagacacagcaacaatctgatttctctatcttttccccacatttccccccttactattcgacaaaaccgccattgtcatcatggcctgctctcaatgagctgttgggtacacctcccagatggggtggcggctgggcagagggtctcctcacttcccagaaggggtggccgggcagaggcgcccccccacctcccggatggggcggctggccgggcgggggctgccccccacctccctcccgaacggggcagctggccgggtgggggctgccccccacctcccagacggggcggctgccgggcggagacgctcctcacttcccagacagggcggctgctgggcggaggggctcctcacttcccagacggggtggctgccgggcggaggggctcctcacttctcagacgggtggctgccgggcggaggggctcctcacttctcagacggggcggccgggcagagacgctcctcacctcccagacggggttgtggctgggcagaggcgctcctcacatcccagacggggcggcggggcagaggcgctccccacatctcagacgatgggcggccaggcagagacgctcctcacttcccagacagggtggcggccgggcagaggctgcaatctcggcactttgggaggccaaggcaggcggctgggaggtggaggttgtagccagccgagatcacgccactgcactccagcctgggcaacattgagcactgagtgaacgagactccatctgcaatcccagcacctcgggaggccaaggctggcagatcactcgcggttaggagctggagaccagcctggccaacacagcgaaaccccgtctccaccaaaaaaatacgaaaaccagtcaggcatcgcggcgcgcgcctgcaattgcaggcactcggcaggctgaggcaggagaatgaggcagggaggttgcagtgagcagagatgggggcagtacagtccagcttgggctcggcgtcagagggagaccgtggggagggggagagggagaggggggagagttctttttatattttagatacaagacctttatcagatgtagattttgcaaagatttttcaaaagtagagcttttaaattttgatgtagtccaatttatcagttcttttgtggattatgtttttggtcaaatcttataattctttgcctaattcaaggtcacaaagattttctcctctgtttgcatctaaaagctctgtagttttaggttttacatttaggtctgtgtccattttgagttaattttttgtatgtggtgtgaggcgtggaacaaaattcattttttatatacacatatcagttgttctaacaccatttgttgaaaagaccatcctgtctccactgtattgcttttgtatgcagtagttgccccttatctgctggggatgcattccaagacccccagtggatgcctaaaactgtggatggtaccaaattatatatacaatatttttctatacatttatacatacatatgataaagtttaatttctaaattaggcacaataagagactaacaataataaaatataacaattataacagtatgtcagcatcattactcttgccctttgtggccattaaataaaataagtgttacttgaacacaagcactgaagtaccatgatagcctgataactgagatggctactaagtgactaaagggtgttagtgttgttccctatacgaagggatgattctcatcccaggcaaaatggagcaggaaggtgtgagatttcacagtgctattcagaatgacatgaaaaaatccctatgaattgtttatttctggaattttctatttaatattttcagacagctgttgacaatggtaaccgaaactgtggaaagtgaaaccatagtttaagggggctattttatttgtcaaaacgtcatgctgggcacggtggctcatgcctgtaatcccagcactttgggaggccgagacagtggatcacctgagtgaggagttcaagaccagtctgatcaatatggtaaaaccccatctctactaaaaatacaaaaatcagctgggtgtggtggcgtgcacctgtagtgccaggtactcgggaggctgagacaggagaatcgcttgaacctgggaggcggaggttgcattgaggtgaggttgtgccactgcactccagcctgggcaacagaatgagactctgtctcaaaaataaataaataaataaataaaaataaaaaaataaatcagttgttcatgtatatgtaggtctatttcttgattactatagctttagtaatagtcttgaaatcaattagcattgttcttattccagctttgttctttttttttttttttcaaagtagttttgtctattctaggtcctttgcattttcttatgtattttggaatactctatccgtttctataaaaaaaagcctggtaagatttttattgggattgtattgaatctctagataaatttggggaaaacgttgacatcttaatatttaatctttcaacctgagagtaaggtatatatttctctttggtcttctttaatttctctcagcagtgttttgtagtatatgggttttccacatctttaatcagatttatttctaagtattcaattttttttgatgctcttgcaaatgatactgtctttccatttcaatttccaattgttcattgctattatgcaaaagtactatatatataaagatttttatatattgatcttgtgcaaatttgctaaactcactttttagttacagtagctttttaaaaatagattccatcagattttctatatagaccaagtgtcatctgccaatgaagacagttttacttctacctttccaagctgggtgcctttttatttcttttacttgcctggttacgctgggctgaatctctaatgcaatgttgggtagaagtggtgtgagtgggcatcccttgtttgctgagagtttttattaggagtaagtagacattggactttgttaggtgcttttttcatatttattgagatgatcatatagcttttctcttttagtttgttaatgtggcgaattacattgattttcacatgttaaattgaccctgcattcctaggagaaaccccacttggtcattacatatcctttttatatgttgttgaattagatttgctaaaattgtattagaatttttacatctgtatttatatgggatattgttctctagaagtcttataatgtctttgtcttgttttggtatcagggtaatgtttacctcatagaatgaggtaaactaatgaaaagaaagaattcttttcattagtgcggaagagtttgtatatatctggtattattctttttaactgtttggtagaatccactaataaagtcatctggacctggaactttcttcatgggaagattttaataggattgtttaggttatctgttttttcttgagtgaactcttgatagttggtatctttcaaggaatttgtctatttaattaaaattgtcaaatttattggcttaaagttatttataatatttccttattatcctttacatagtgatagaagctatagccttgtcaactctcacattcctgatattggccatttgtgttgtcttcgttcccttcctcctccttctcatccttctctagcatcatcattatcagtctggttagagatctatcaattttactgtcttagtcatttccttgatttttctctcatattttttccctgttctctctctctctctctctctctctctctctctctctctgtcgtctgtctgtctgtctgtctgtctcgtctcatcttgttgcccaggctggagtgcggtggcacaatcatagcacgctgtaacctcaacctcctgggctcaagcattcctcccatctcagcctcctgaataattggggctacagacgcatgccaccatgcccagctaagtcttccattttttgtagagacagggtctcactatgttgcccagcctggtcttgaactcctgggctcaaggggtcctcctgccttggccgtccaaagtgctcagattacaggtgcgaaccaccacacctgaccctgttttctttttaattgatttcctcttcgattgttactattttcttccttctttctttgagttaatttcctctttttctagttttttttttaaagtggaaaatgtatttctgttgcgacccttttctgttgtttggcaattttaatcagtgtttttgaagagaatgctgatatacagtagtatgctatttagaatcaatttagtttattagctggaaagaatagctgatattctggaatgttagaatccaagaagctaagatggtagcctaaatatattaagatgtgggctaattaagaaaaatctcaaattctctgctcaataccaaaaaatcatttaggaaaatatgggaaaagggagaacaagatttttagtgcagtattggttaaatgtaggcagtagcatccaaagtgcctggtttggatactactaagtatatggttgtttgaatgtaatatagccccagataatctaatctgatgaaaatattaatgtaaataaagtgttcagaaataaggaaggtaattatctcacacttctttactgaataggctacctcaggaatcttgtatttatttatgagcgtcactctgctgggtttagacacactagaattctgttggccagagtaggcaaatttgtaagtggacagaccatgctataacgaatcttggactcatagaatcttagaatggataaggatcttagagattgccttattttttatcataggaaaccaaagccaggagctgtctattggtttatccagtgttacacaaataattggtgacagtgttgaagattggattttcagtttctggagggcatttcagcattctttccactgaaccatcttgtcatcaaaatatagttcagaagaagattataggaggtcttgaaattatctgtatgggaaaaggtcaatgatcaacaatcaagagttacagagaagttgttttttttttctttatctttctttcttttttttgagatagagtttcactcttgttgcccaggctggagtgcaatggtgcgatcttggctcactgcaacctctgcctcccggaagcgattctcctgcctcagcctcctgagtagctggaattacaagtgtgcgcccccacacccagctaatttttgtatttttagtagagacggggtttctccgtgttgctcacgctggtctccaacttccgacctcagatgatcagcccacctcagcctcccaaagtgctgggattacaggtgtaagtcaccgtacccggctgagaagttgttttaatgaaagcttcttgagctatgtatgtggctctcaattcttggaggtagccatcaagggagtggacaatccctagagtggaatgtcatataatagatagatccatgtatcagataaactttgggctatatcagctacagagttttggggggttttttgtttgtttgttggagccagggtctcactctgtcacccaggctggagttcagtggcgctgcctcgaactactgggcacaagtgatacaagtgggtgccaccatgcctggctagttttttttttctttttgtagtgatgggtctcactatgttgcccagactggtcttgaactcctcgcctcaggtgatcctcctgcctcagccttgcagagttctaggattataaacatgagccactgcatggcctcagaatatttaccgtctaattttcaagcctgtctgatcttgtcaaactaacctgttttggtatcatcacttttctttattgtttacctattttgtattttattgatatccactctttattatttccttgctctgtgctctttgggtttaatttatcctgccttttctggtttttaaaagtataagcttttgtctctgctaaaatctctgttgctttatttttggctcttaccatcagccctctgcaggtataaatttcaggttctaaacttcacacctgattgtcaaattggtaatgttctaggctaagtgtcttcagaaagtaagttcacctctcttaagattcttcccctctggaattaggtcttttacctctagtttttgctctttcagcagctatttgctaccttgaaacaaatgacttaggtatattattcagttttctgtttgtttaacttgtaggtggtagttggcctccaggtcctccttcttgcctggaagtgaaccctccttaaatggattatttttcaatattcagtaatctgctcgtcttctagaagctcatattgattcacagaagcaagccatgccaaacacacgtaattttctttttcctttttttggagatggagtttcactcttgttacccaggctggagtgcaatggcacaatctcagctcactacaacctctgcctcctgggttcaagcgattcttctgcctcagcctcccgagtagctgggattacaggtgcctgccaccatacccagctaatttttgtatttttagtagagaaggtgtttcaccatgttggtcaggctggtcttgaactcctgacctcaggtgatccgcccactttggcctcccaaagtgctgggattacaggcatgagccactgtgcctagccctaattttcttttgaagttagttctcttaattgaataggagaatgtcataggcataaaatttaagaagactgttttttaaaacctgtcatgctgttcttgtggaggaccaaaatatacgagatgaatgataatatagttaggaggatttggagctgattgaacaacttataaccaaagagtattgacagattagtggcagccaaaagtgttttttttctgaacatgtacctcagaactacctggggattgctaaaaatatgcaaataccgagatcccagtctatatctcctacatcagaatcttgggtgtggattgggaaatattattttcaaaatatgtttttagagtctgtgatggaaacttctggctaagaatgatgaattaaatttagtggcacgctggaactgtctcacacaagattatgataattgtctttatctcttctcaaccctgtgttcactgctggtagcttgaaattggccatgataggagtatttacactatagaaattggcaaacctgcccaccaccccaggaaacattttctagcacactactattaggttggtacaaaagtaattgtgttttttgtcattgaaagtaatggcaaaaaccgcaattacttttgcaccaacccaatagttacatttaatagaattgaatagatatgaagtttaaaaaaatctgtaggatagaagaatggtagcatgattacagttaatataatctaagggtttagctgtttctttggtatgagccagtaataagatacaactttaaaaaacattaatgctatgtattaagttttatacagcaaaaaaaggtggtagtactactgtgcagagcattaatcagactgtccttttctggagtattgggtattgatgataggtgctgtgtttttaaaaggtcactgaacttttctagaaatgagccatcaatacatgggaatgggtttgaaaattgttgtaaagataatgattgaagaaaagtttaacatagagtacttaggggatacttcatagctctgataatgaacaaaaattagaatcattttatgtgaccacataaaatagtatttggaccagtgggtatggagtggcaaatttcgcttgttagaactttcacgtagttaaatttgcccccaaataaaattgttggagatgtcattaaattttggaattgaatgttatgtagctaccacatagggacattagggagaatttttgcatttggcaagaagaggactagatcagtgattcataactgtggttgcacattagaatcacctgggcaacattaaaaaacaaaaatcttggacagactgcatgcaccctaagctgactaaatcagaatcttgggacttgagcatctgtatttttttttttttttttgagacagagtctcactctgtctcccaggctggagtgcagtggcgcaatctcggctcaccgcaacccctgcctctggggttcaagcgattctcctgcctcagcctcccaagtagctgggattacaggtgcccaccaccacagctggctaatttttgtatttttagtagagacgaggtttcaccatgttggccaggctggtctcaatctcctgacctcatgatccgcccaccttggcctcccaaagtgctgggattacaggcatgagccactgtacccagccggatctgtatgttttaaagctcttcaggtcatgataatgtgcagcaaagtttgtgaattagattataatgtattttccaaattaattttacaacataattctgaccattcaatggtaacgctttgttttcctggaacagattttgaatgatctgcatttgtaaaatacatagaaaacctgggatatataaataccaaggaaatgtacagacatagatttattgaacctgagaacagagattctaattctggaaacactagttaaatgtttatgtgataatttcataatgattatcagtaatttatttaaagtccaatatgattaaataaaaatgcattttaaaaatttatgaaacaataaagaaaaaagttggaagtatatttagaattttatttcttaggattaaaatgtgactgatgatattggcatcagttgatgacattggcaaaatgttaataattgttgaagcagagcattggacatgttggggcttagaatattattctctgtactttttgctttattagttttgaaatttcaataaaaagttgacctttgttcttgcagcaatttaaagatgctattctgttgctttctggctttggtattttcttttttccgccttcttttatttttagttgatacttaataattgtacatatttgtggggtacagagtgatatttagatacatgtatgcaatgtgtaatgatcaaatcaggatagttgggttatctgttactttaaacgttttatcacttctttgtgttgcgagcatcttaaaaaatcacacatttaaattagctgtaatgtagagaaaatgattagataaataataatcctaccttacataaactgttcagtcatttcatctcattttaagttagatgctcttaagtattctcttttgagcaaataaaacactggacttataacaggatctgacatatctgaaagataagattggatgggtatgttagggctctgtctagtagaccaaaatgtttgaatttgatatttaatgaatattgatgtgttttagcatctttctaatttttttttcttggggattagtagagccaaaatatttagaatggtttacaacaaggtaagtggttctgacagaaagaagaaaagcagggagcagggccgggggcgtgggggtggtgttacgagataggagaggggatgcttttaaaaaagaaggtggtaataaagttcattgggttatctttcagtaattattaaaaataaaaaataattaaaccaaggcagagtgccttggagaataaacctgattatgagggatggcaaatgtaataatatattgacaaagggtagaatttctagactttcaaattccattgtcttaaaacagttggtaatgtgacagttctttagcctttttggaagttttgcttttttggtagagatacaacataaaagacttgaggaaataggtcatggtaattatctgtcatccagtaaaagaaatttgaaaatcattgatgtaaagcagcatttataaattgatgaattagagtaattataaattgatgaattagagatatggttttatatggcatgaaaaatgaatattataatttaatatattactagagtagcgattttcaaagtgtggttcttagaccaacagcatcacctgggtacttgttataaatgctaattcttggacctcaccccagacctactaaatcagaaacttctggggtggggcctggctatcggtgttttaacgaggtcttcaggggatttgaatgcatgcttaagtttggaaaccatggatttagaatactattgccttttgttgtaccagccaataaattaaattttgtgtatgctttctattcaagagttatgtgcccttatcatgcctttatatatatctccatatcagtatgtataaaagaatcagagggtaaaatgagagccttttgtggttaaatgtcattcaaatttagaaggaggccaggcgtggtgactcatgcctgtaatcccagcactttgggaggctgaagcaggcagatcacttgagatctggagttcaagactagcctggccagtatggtgaaaccccatctctagtaaaaacaaaaattggctgggacgtggtaattccagccacttgggaggctgaggcaggagaatcgcttgaaccccggaggcagagattgcggtgagctgagattacaccatggcactgtagcctgggtgacaagaacaaaactctgtctcaaaaaaaaaaaaaaaatctagaaggaaattctcccattttacactgacattggtgaaatccaggttgaatattagtgttttaaataaatttatcatatcattttttctttttggtgccatttgttgacatttagctaacaagtctgagagtgttagatttgacagactgtgggttgactcaggtggttgttcttaattggtctggaatgtcagttgacataaaatattaaagtaagttttgagaaaagggaagaaagaaattgtacctgccttggatttgagccaggattgaaaccgtcattttactcctggctatgtggttcatggtttgaaagtcattgtcctactatatgtaaaacatgtctttctaaaatttacattttgttatacagttgacccttgagcaacatagatgtgatctgtgcaggtctacttatattggatttcctttcacctctgccacccttgagatggcaagaccaacctcccattttactcttcctccttttcctcagcatattcaatgtgaagtcattgaggataaagatttttatagtaaccacttccacttaattaatagtaaatatatttttcttacgactttcttttctctagcttattttattgtaagaatacagtatataatacatgaaacatacaaaatatgtgttaatcgactgtttatgttactactaaggcttctggtcagcagaagggtattagtagttaagtttttggagagtcaaaagatgtacgtaaggccaggcttggtggctcctgcctgtaatcccaccactttgagaggctgaggttggcgaattgcttgagctcaggagttgaaaaccatcctgggcaaggtggtgaaacttcgtgtctacaaaaaatagaaaaaaaaaattagtcatgtgtggtggtgtgtgcctgtattcccagttactctagaggctgagatgggaggatggcttgagcctgggaggtcaaggctgcagtgagcctcccaagtagctgggattacaggagcccgccaccacacccggctaatttttgtatttttagtagtgacagggtttcgccatcttggtcaggctggtcttgaactcctgacctcgtgatctacccgccttggcctcccaaagtgctgggattacagacacgagccaccgcgcccggcccttaaaatgttactttaaattaacatacacactcagttatatgttttgattttatttagaactttcattttaagacaagactaagtgaaattgtagaaattagttgagaaatgagactgtgcatttcatattggcctgtggtgtaaaatgatctgacatataatgaaacttagttgaatacaaatgttattttatcagttttgtttttatctgataagttaatttatagttattaaccttgatttgactgtccttttgaaaaatcttgcctaagaaaactaaatgatcatcaaaacactggtcttaaaatagagttcaggctgttttttagcttgatacagttgtctctcttgctttgctttccttctgaaatgatgtttccattttggggactgggaagagcatgattatttatagactagtgtgttttggacaggtggtatgtttacacagatcagtggaattatttgtcccccaagacctttaatatgaatgcatttcattttatcactttttgtaattaaaagagcaaaataattatgtgggtgagtagagaacatcgtctttaattttgtatgttaatgcagcaggtgtccactatatattaggaatttttcagagatttggggttaccgataaaccacatagctttgtcattgaaaaattttaaagaccatttttgtatcttcttacagagcatacaacttacaaatatctctctgtcctccccgtttcggctttgtttgatagaagtgttctagggagtcaaaccctgtagaaaattggagcattcatacattgctgaaactttctatattacattttatattttaaaaattaaagttataaagtaaccattagcaatactgcataacagaaactttacaacttaaaatacttctgaaatttagcatgtgcacatatttttgagatttacaactattgttatattaattatgtaggtaacgtcaaagttatatactccaattattataccagggccttttttgccataaaaggtaccaaatcaaagcatcaaatgaaattctttcagtcaatctatatatgttagcagttttctctagtaaaactctacataaagaactgctttcttccttatagcaggaactactttcattttattcctttttgagagcccctgcctcttgagaaaatgcttcccatctggttagagactagatgacataatatagtcccattcagaaagatattgataataaaatagtctcttccttttctcttcccttacctgtcttcaactcttctggaacctcctctctgtcctttatctgttatgccctggtgatccagagccatcttaattttaaaattctccatcatattttttattatattgaattaacaattcattctagggtcatccagatacatcatttaccaggagaagcagttagcttgcctcttgagatatttggccgtttcattattgtgtcacatggttgaaaacctttctttttggatgttgtatatgaccattagtgcttttcagtcttttctgttcttacagttcatatttttacctttctttttgcaaacaaagatggagagaagagtaaattaaatactcttctgaatatgttaatacttagtttaataaaaaaccagaattacatcccaatttctggagatgagaaggtagtcaaaaaaatgagtaagctatggtcctataggggagagaatagattagaatacttatctaatgtgagacacatgttctaaaagaaaagagaatcaagtgctgtcagaataaaaaggtggcatactgacttgaggtgagtttgggatatcaaagaatatctagaggaggtgacctttgagcagggccttgaagcagggccaacttacccattaagcacagtaagcacagtgccttgggccgatgctatttatagcagcccataaaattcactttaattttaattaatttttacaggagaaaaaatgagtataatagtaatgaataatgaatccagcctgaattatatttgtcttcatattaatgaagttgtaaaatataatttttaatatacagtatttttaaatggaggaagtgacttacagaggcaaaagtgcctgggacttggaaaagtcgtaatgtaaactgcctataaagttaagtaagggtttgtgggtgtaaggggctaaagttggcaaaatgttaagtaagaaattgataattaaacaacaaattcattttaaggagttaaatatatatggtttcttttccacgtgttgccactcattgaagcacaacaatgaccagataaacgttatttagctagaactaataacacttgatatgctgagcaagaaagatgccttcagtcaatgaaaaagtcattgtattgagaggtaatatctgctttaatatttcctcagttatcaatttaatattaatttgtaaatattataagatgtatacatcattggtaacagaaacatagttaaaatgtggtggtatggagaatatatttttgattctaagaagtgctgcaattttttgtttccacaaacccgtcgccataaaactcataccatagcatagaatgaacctccatggtgaaacaaggattgaacatttcagaccttaactttattcatggttataaacaataacaaagtctataggtggtactgagtaaggatccctaaaggtatcgtacacattcaaagtgtaagttagcaatactgaggcttccctttctcaaagggtaatctgtgaggcatctggagattctggttaaaaatcttaaccatacccaagatttattgtagcatcattttagtggatacatcctggaataatgtgcattttaaatgttatttttaaggactcaaaagttggagaaccagtaagatagtgtgaattttttttgaagatctgactaatcttcctgatgaaggacactgagagagtatagggacagggagtaaagggtaaaaatttgggggaaaaaaaggatgtggagtgatttagtggtaggtgaacactattgcactatcaccctgacatgaataaaaaagccccatctctatccattaatcttttatgacttccaaacctttctagtattgttgtacttaattattttttatccttcactgtttggctttgcttccctcagctgaattataagctaattaaagagaaacatatttttgcattctcttgcaaaagactacacatagtaactgcttaaactgattttactgaataagaacaaattcaccgaagtctcattgaacttacctagatatactatctctcattttaacacttttgttgtaagtaaatctgaatttcccctggcatctcttgctttaagaggggatactgcaaagtagctccaagtgtgggcttcagtgtcagaaaacctggattgaaatcctggccccactccttaattgctatgtgcccttaagcaagttttgtactctttgaaccttagtgccctcaactatgacatggccctgatagtatctacttcaaattattatgagaattaaatgagataatgtatgttaaatgtttagcataatgcttggcataaagtactcaaatgttagtggttctgagaggtgaagccagctggacttcctgggttgagtggggacttggagaacttttctgtctagctagaggagtgtaaacacgccaatcagcgctctgtgtctagctaaaggattgtaaatgcacgaatcagccctctgtaaaaaaacaccaatcagcgctatgtgtctagctaaaggtttgtaaatgcaccaatcagcactctataaaatggaccagtcagcactttgtaaaatggaccaatcatcaggacgtgggtggggacaaataagggaataaaagctggccaccccagccagcagcgcaacctgcttgggtccccttccatgctgtggaagctttgttctttctctcttcacaataaatcttgctgctgctcactctttgggtccctaccacctttaagagctgtaacactcacttcgaaggtctgcggcttcattcttggagtcagcaagaccaagaacccactggaaggaaccagctgcggaaactccggacacagttctgtttcttataagccagcagttatcaaagtgttatccattcacccctcttggggtccctgagactgaaaactgtttacataataatactaagactttatttgcctttttcactctcattttcttacatgtataaagtggagttttccagaggctagcagaagcagatgtgagaatccagcttctattaacccagacagacatcagagagatttgtacaaatgtaaaataatgccactcttctcaccattttggagggaggtagagggaatacttatttttgtaaaatagagtcatttatgttaacatgtaatggatttatttttgtttaagttgataggtgaatatttttaaatgtatgttttctttcttttttttttttttgagatggagtctcgctttggcgcctaggctggagtgcagtggcgcgttgtcggctcactgcaagctccgcctcctgggttcacgccgttctcctgcctcagcctcccgagtagctgggactacaggcgcccaccactgcgccccgctaatttttttgtgtttttagtagagacggggtttcaccatggtctctatctcctgacctcgtgatctgcctgcctcagcctcccaaagtgctgggattacaggcgtgagccaccgcgcctggcttggccgtatgctttaatctctaatatgatgaagaacaagaaataatacaatgtaagtgggatataggatgcctgaagcggttatattgtaactgttaccagaaaggggtcctgatccagaccttaagagaaggttcttggatcttgcgcaagaaagaatgtgaggcaagtccatagagcaaagtgaaagcaagtttattaatataataaaggaatgtcacgcttgtaatccagcactttgggaggccgaggcgggcagatcacctgaggtcaggagttcgagaccagcctggccaacatggtgaaaccctgcctctactagaaatgcaagaattagccaggcgtggtggcagatgcctgtaatgccagctacttgggaggctgagacgggagaatcacttgaacccaggaggcagaggttgcagtgagccgagatcgcaccattgcactgcagcctgggcggcaagagtgaaactccatctcaaaaaccaaccaaccaaaccaacaaaaaacgaaagaaagtaaaggaatgaaggaatggctgctccatagacaagagcatactcaagggctgctggttgcccatttttatggttatttcttgattatgtgctaaacaaggggtggattattcatgcctcctcttttttagaccagataaggtaacttcttgatgtttctatggcatttgtaaactgtcatggtgctggtgggagtgtagcagtaaggatgaccagaggtcactttcatcgtcatcttgattttggtcggcttctttactgcaacctgttttatcagcaaggtctttatgccagtatcttgtgtcaacctcctatcttatcctgtgacttagaatgcttaaccatctgggaatgcagcccagtaggtttcagtctcattttacccagcccttattcaagatggagttgctctggttcacacgcctctgatatcaccagtctttctgtaaagcaaaaggatttacatttaatatgtattcaggagcaattttaaagaaaattaaggtgttttaaaagatatggatgatttaggaaaaagtcttggagacagaaaatatgaatgaaaaagtaacactggtatatggcggtagtgagaaaaaggagttgtttataactgggggggggggtagtaatgaaaactatgttgatggggctacaagctgtgggcagtgagagaggataccacaaactgataccagccagctataaagacttgaaaggaaaatgcaattacttagaggaactgccggaaacaagatcataggtgatatttatcctcaaagtcagtacttttcagacttaattggacagatgtatcatcttggatcttgttaaagcgcatattccgattaactaattctcaggtggttcctaagattctgtatttcaaataagctcccagaggctgctaaaactttaggcatcactcgataagtcatatatgcacattagagtttgagaagcattgctgtatgtcattattttacaggtgaggtaatggaagctcagagaccttagttgacttgctcagtattccaaagcttgtgagaacaaaacctggattcgaatacaaatggcctcatatcagacttcacattgtttccctaatttcttagaaacatggaatgccaaaattaggaattacaataattgttaaattaattttcaggttttttttgtggaatgtttaggttcagagatacatgtacaggcttgtgatatgtgtcataggggtttagtgtacagattatttcatcagccaggtaataagcaaagtatatgatagcagttttttggtccccactctcctgccaccctccaccctcaagtaggccccagtgtttgttgttttctttgtgtccatgtgtgctgaatgtttagctcctgcttataaatgagaacatgaggtatttggttttttgttcctgtgttagtttgcttaggataatggcctctagctccagctatgttcctgcaaaggacatgatctcattacttttcatggctggatagtattccatggtgttatatgtatcacatttttaaaatccagtataccattgatgggcatttaggttgattccctgtcttcgctgttgtgaatagtactgcgattaacatatgtgtgcatttgtctttatggtaaaacattttatattcctttgggtgtatactcaatagtgagaatgatagttctgttttaagtggcaacggtagttctgggtcattcccaatagtgggaatgatagttctgggtcaaatggtagttctgttttaagttctttaagaaaacactgaactactttccacaatagttgaactaatctacattcccaccagcagtttatgtgttcccttttgtcctcaacctcgccagcatcttttattttttgactttttaataatgccatgctgactggtgtgagatggtatctcattgtggttttcatttgcatttctctaatgagtggtaatgttgagtattttttcatatacttgttggccatgtgtatatcttcttttgtaaagtgtctgttcatgtcctttgcccactttttaatgggattatttgttttttgcttgtgaatttaagttccttatagattctggatattagactttggttggatgcatagtttgcaaatattttctcccattctctaagttatttactctgtttatattttcttctgctgtgcagaagctcttagtttaagtcccatttggcagtgtttgattttgttgcaattgcttttggcaccttcagcatgaaatctttgccggggtctatgtccagaatggtatttcctaggttatctcccaggggttttattgttttaggttttacatataagtctgcaatacatcttgagttgattttatatatggtgttaggaaggagtccagtttcagtcttctgcgtatggctacccagttatcctagcaccatttattgaatagggaatcctttccccattgcttgtttttgtcaactttgtcaaagatcagagagtgtaggtgtgcagctttatttctgggctctctattctcttccattgatctctgtgtctgcttttgtaccagtaccatgctgttttgtttactgtagcctcattgtatagtttgaagttaggtaataggatgcctctaagtttcaagttcttgactttcattttccaaaagaaggatttatagagaaacctttatgatgaatttgtttatcagtatattagcaaatatttattgaaactgtgtattctacacatgaaatatatatgacacaaattctgcctccattaagcttactgtttagaagaggtgttaagatttacatgaataattttccccctatattccatacttaaagtttccaccatttcctgaatgtgccagagtctggcagccaggctctatcacagctacttgcatttgcgtattaagcccttctccttttggcaaatttttcccccactgtgttatttctttttttgtttgttttttagatagggtctcactccgttgcttaggctggagtgcagtggcacaatcacagctcacagcagccttgacatccatgctcaagtgatcctcccccctcagcctcctgcatagctaggaccataagtgttcaccaccatgcccagctaatttttttttttattttttgtagagatgaggtcttgctgtgttacctaggctggtcttgaactcctgggctcaagcgatcctcctcccttggcctcctggatcaaaaactttcttctttaaaaattcattgcaaatatccttgctttggtgaatctttgtgtattcaggtgattctctgttccctgcatctgtaacacttcattcattactctagaatttgttacattgtattaatatattaggttattcagataattaaagtggttatgatataccattttactagtgcctagtttagaattattggtgtcgatctgcaccattcaatagaaatacaatgtgaaccacatatgcagtttaaaattttctgtaggtagacttttaaaaataaaaagaagtgttaccgaaacaccagaggtttggtctaggtcctgctgcttgccacacagaaagctaatcactaataaaagtattgctaaggaagaaggctttaatcaggtgctgcggccgaggggatggaagctcagtctcaaatccatctccctgactgactaaaacaaggggtttatatagcagggaaaaaatgtaacaatatgtaagaaaacaagaactagggagtgacaaggaggcctatggtgctgtgatctggtgagtttcagttctttgatacctttttttgagagacctgaaagtcctttcctgaggaactcagataaaacaaatacaagtgtcaagctttaacagcagaagggttaatttctatgtccatccaaaagaacagtctgtgggagtattgggctggtttcagaagcaaggtgaaattaaatttaatactattttatttaactcatatccaaagtatgatcattttaacacataatcaatataaaaattatcaatgagatagtttacatttttatgctgtcttcaaaatctgctgtgtttttaattcttaaagcacatctcaatttgaactggctgccacatttcaggtattcatgtagctagtggctgttgtattggacagcacagatctagagcttttacgggtttttaaaatgccttttgaaatgcctttctaggctgggcgtggtggctcatgcctgtaatcccagcactttgggagaccaaggtgggcagatcacctgaggtcaggagttcaagaccagcctggccaacagggcaaagccccgcctctactaaaaatacaaaaattagccaggcgtggtcacgtgtgcctctaatcccagctactcgggagcctgaggcaggagaattgcttgaactctggaggcggaggttgcagtgagttgagattgcgccactgcactctagcctgggtgacaaagtgagactccatctcaaaaaaaaaaaaaaaaaagaagtaaaataaaatgctttctgaagtaagacatttttttcaatacatcaagtaaaaataactttctgggtcttgatgattaaaattttcccttttactatgaatttgatacattttctcatggttatttttatcttaatatgcgtaactcctagtaagatttttcagaagctcatgtattttttattactgttttgtattagataatattctcataattttaaggtggcctttaattgaatattccagaagtagatcttcatgaaatactggtgtgaaactattgatgtgtgatttttgacaaataaatgttgtttttgaaatggggaaagttcctgtgtccccctcacagggtgtgcaatgggggagtggctcacttcttcagtgccccactgctcaaacttctaggggagcgtacagatggtcacgttgtggggctctgaccccatggcagtgtctaggggtaaatgtcgacaggtgaagccccagtgggcatgtgttaccatgtgctcttttagttttgatgtctataggcggcttgtgttaccagctcaattagaccctttaccttgtcgcaaggacagaggtctttctgtatcccagttcttaccttggtgtacaggaagaatcggatcacacttgggcttggagaataagtacaaggtttgattgagtggaggtagccctcagcagatggggaaagccagaagggagatggagtgggaaggttttcccctggtgtctggccgctcaacggcctgtgatctccctgccacagccaacctctgcatcgttctgcttcttcttgttggtggcccaccggcgtgccggtgcatgtcggtgcattcctctcgacgtccagccgcctgtgtgttccttcactgatgtgctcctttctgtgtccagcgggctgtgtgtctgcctgctacggtcttaggggtttctataggcactggataggggcgtggcaggccaaggtggtcttgggaaatgcaacatttgggcaggaaaacaaaaatgcctgtccttaccctatgtccgtgggggctatttttgttcctagccctagctgggaaccatgccctcctctacccagcacttcccttccccgcttccatatcatttaaaagggccatgctcttcccttcccagtactcccgtatcattttggctctttccaaattacaagttgactatacatttgcagagtttccttgttcatccaacaaatacagtcagtattgtgctatatttggtagatacagagggtaaaaagcactaggtggagatatgcatggagctagaagcttttaactgagaaaggggataagagatatgaaggaagggtttgtcagcaatagattagaagaagtgctcaactggaaacaaggaagacagttcagtatctgtgttaataatctagaaagaagtaaaaggaacctattttgaggtagaggtggtagagatgtagagcagtggatttaagaactattaaaggaactcgggaagacgggattttatttgggagaaaagtaataggaaggaatcaaggataactttccagtttctagtttaggcaattgatagccagttaaggcaactgaattaagaaaaccagaaaaagatgtttttgagggaaggttgaagatgatgataacgttaataatagctgatatttttagtgcttcctgtacatcaggcatttcactaaatgctttacgtacataattttatttaattttcgtaacaatcctttgaggacagttataattattattttggttttactgatgagagaaacagttaaaaaagattagagtatcttcttcagggtcagatatttaataagaaagaggcagagccaggatttcaacccaggcagtctttattcctgagcctttgcttctaactattatacttacaggttactgaatttagtgttggacatgttaagtttaaggtgcatgtgttaccaaaacaccgggggttcagtttagggcctgctgcttgctgcacagaaagccaaccactgaaaaaggagtattggcagggaagaaggctttaatcaggttctgcaaccatgataggagaccagtctcaaatccatctctctgaccaactaaaattaggagtttgtttatatagcaaaagaaatgtaaccatttgtgggaaaacaggaattagtgaggggtaaggaagaggaattggtcaacagcaaacaggcagtgggttaggcaatcatgatgggtgaggggtctggcatcttattgttcaaatgcaatgatctgagaagtttcaattccttgatctgagaggcctgatagttggtttgcagagaaaggaactcagataagacaaatgtaacttgaaactttctcaagtttcaagactgggaggggccatttctgtgtggtacagtgggccaatttcacatgtgggacagcaagtggcagatcttcagtatggcgtatcagcccagtaagtaattggctagagaacaagattttgaaaccttcatcgtataggtgaaagactttagtaggaagaacctaccatgaagattggtatcttggaaacgaagatggggttttgagtggggtggggtgtcaagaactatgagtggtcaggattgtgaaatacagtggaggaggtctcagaaaataagtactgaaaagggaccattgccttagcagcaaggatgtcattatgttacccagaatatgacctcattcggaaatacgatcttggcagatgtgcataattagtagaattctttatctgtaatgagtgagctagtgaggaatcacagaaataaaaattagttctcttgacttactcataggaattggtcttgaatatgtttttattgtggctcttttcaataatgcctttgaagtgcagaaacacactttgtttcagaaatacatattgtcagacagaatgtgtctgttctgtatttaatagtccaagtctatttgaaaactgtctaatcaaatagtgactttaaatggttttaaacagatttgagtattccattatggctcttgctagatgtttaacttgtttagactgaagaaaaaaagatttccaattaacaccagattttataagaaagaaaatattagctaaataattaattccatgaaatgacatgtattccaaacaaaaacagacaacatctgttaattcaattgggaagacaagattgagcttgatcctttaagtttttaattaagtgttcttcagaatttttatttcaaaaatgttttaagtacctttagtgaataatactgtgtcacaccacaacttgaagtatttgatttgtgtacaatcattaaatttaacattttatttattgattaaatagtgaaagctgatcaatctgacattctcttgaactctattaactattcccttcatctacaatttaatgataatcaatgcttttaacaaatcggaagcactacagtttgtaaaacagacttctaaataagatagttaagaataaattatgttcacaagtttcattataatttccaccgtatcctaattatttgacaatttgtaatccacgttatagtaaaaatatcatttttatttgttgacggtcttctagttgcagttcccatcctttacatgaatctcttttatattattactgagatggatggtcacatatccttcttttcccatctctggagttcattacccctcaaggcattcagcaaccagtcatgagtatctatgaatactagacaccaggatatgggatatggcaatgaacaaaatagatactagccctgtcctcatggagtctataacctcattctgattttaaatacataattagaagtatgtaagcaatgtgaagaagaaatagagtgctatagaagaatatgatgggaatgtaacataatgggggtggtcggaaaacactgccttacgacattaatgttttagctgatacttgaaggttgaattaactagggggaaggatggggaagtttttcaagctgaggaaatagcatgtaccaagatctagcgttgagaacatggtatattcgggctacctgaaataattacagtgagaggacattctcctcatttttgcaggaacctggcttggctcttatgaggactaaaggactcttttaagggtttgcagctttggaaggtcagcattagcaaaccttcatagatgcacattagagtttcagatacattgttttacaaatgagataatagaagcccagagaacttagtgtcatgatttgctcagcattccgtagtttgttagtagaatacctggattggaataaagatgtcttcacaccatggtctagggcttgtttctctaatgtcacaaaagaagatagaatgccaaaattctgtttgtatgtcaggcactgagctaaatgatttacatacagtatttcatttaataatgtgttaagtgactttataaggagacatcaacaaaataggaacaagaaatgaagaacacataaacacttgtaagacatcttgaccttctgtaaataactggggttagggttggggttggggtgaggagtggagaccaaaaagagatgagacattatgtgttcaacagtgagcaggtatacgcagatttacccccaaggctgagggagctgacaggccgaaaaaagaggctgacaagtccagtttctcggaaagaaatacttaatagggacttaggaaaagaagcgatgtctcaagcagccgcaagatggtggatactcacacctgccctgtggaaagtattctttgtagagtgagcttttaaggtaaaacatgcatctggtcctatcttcagactttcttgccgagacttgtgactactggggagtttagataagcatctttttgagagttatgtatgttataggcctttgtttaaagactttactgcagaacaccttggtatgtggcaggggtagaagggggtgggtcaaacactagtcatcatggcagttttgcttcaagatggcatcacccttgccatggaataggctgttttcctacgttatgtaagggcaacaagtagcaaacactggagttatcattgaaatacctacaggttggtaaggctggggaaaattcaggctatgtatacctattataacattttctaaaacgtgatatactattttcccttctttattttattttcctctttgctgggaaatggcctcttgaaatagtaatcatataaattggtattgtaaattttttaagttaacatatagtgaaattgacttcttgtacagttttatgaatttaaacacagatgtaaatccatgtaatcagcaccacaatgaagatacagaagagttccatcagtctaaaacattccttgagttattcctttgtagttatacactcctcctatgcataacccgcgccagctgctgatctgtttgtcattactatatttttaacattttgagaatgtcatataaatagaataatacagtatgtaatgttttgatactttctctttccatacagcataaccctctgagattcatgctggtgttgcttttgtcaataattcattcctttttgttgctgagtagcattccgttgcataatggatataccatgatttgtttatccagtaggacatgtgggttgtttccagtttttggtgattatgaaaagaagctgcttcaaatatttgtgtacaggtttttgtgtaaagttaagtttttatttctgtagatactaaggagtgggattgctgggttatttggtaaatacataactttattttatttatttatttttatttttttgagatggagtcttgctctgtcacccaggctggagcgcagtggcacgatcttggctcactgcaacctcctcctcctgggttcaagtgattctcctgcgtcagcctcccgagtagctgagattgcaggtatgcgccaccacgcccaactaatttttgtatttttagtagagatgaagtttggccacgttggccaggctggtctcaaactcctgaactcaagtgatctgcacaccttgcctcccaaagtgctaggattacaggtgtgagccgctgcacctggcccataactttacaagaaactgccaaactgttttccagagtagctgtaccattttgcattcccaccagcaacataagagttggagttgctctgtatctttatcatttgatactgttagtatgttttattttagctatcttaatatttgtataaataggatctcattgcatatttaattttttagaatctttattgaggtctaattcacctaacataaaaattacccatttaaaatgttcagttgtttagtggttttagtatattcagagttatgtaaccatcacaatcttaaggttacaacattttcatcactatggttttaatttgcatttctctatgggctcatggtattaaacatctttttatatgcttctttgccattagtatttcccagtcttttgtccatttttaaatttggcttttctgtgttctcactcttgagttttgagagtgcttatatattctagatacaagtccttttgttgattttgtgacttgcaaacattttgtccaagtctgtagattatagttttttcattcttttaacagtggccttcacatagcacaagtttttttgttttgattaagttcaatttatcagttttttttcattttgatgtcatgcctaagatctttttgtctaacctatggtcacaaagattttctcctttgttttcttctaaaagttttatagttttaaattttcatttcgctctgtcatccattttgagttaatttttgtaaaaggtgtggggtttagaccagttcattttcttagatatggacatccagttgttataacataatttgttaaaaaagagtctctctcccttctcctttgaattgcctgtgcacctttgtcaaaaatcaatttaccgtatttgtttgggtctatttctggactgtctattctgtttcattagtttatatgtctgttcctttgccaaataccacagtgcccactttgtcttaattatgtcttaaaattgtctagggtgatttctctgactttattgtttttcaaaaattttatggctattttcattcttttgtctttctattggcttttgcctttttatccagttattctagttattttgcctttatattttgcctaatataaaatttagactccgtttgtctatatctatgaaaaaatatttctggcatatcaattagaactgtgttaaatctgtagatcaatttagggagaattgacatctttactgcattttggcttccaatacatgattatggaaagtgtctccatttaggtcttctttgataaattttatcagtgatttgtagttttccgtatacagatcctatacaagttttgttaaatttatacccaattatttccttttaaaaaatctgttgtaaatggtatgttgtttaatttcccagttgttcattgccagtgtataaaattatgattgatttttttttccagacagggtctcactatgtttcccaggctggagttcagtagcatgatctcggctcactgcaacctctgcctcccagattcaagcgattctcccatcttagcctcctgagtagctgagactataggcgcttttgatggagatggggtttcaccatattggccaggctggtctggaactcctgacctcaagtgataagaccacctcagccttccaaagtgctgggattacaggtgtgagccaccgtgcccgaccaattttttttaaatatattgaccttgtatattgtgaccctgataaactcacctactatttctaggagtttttgataaattccttgggattgtctacacggtcatcttgtctacagttttatgtcttccttttcaaactgtatgcttttatttctttgtcttatattattgcactgaccaggattttcagtgtgatgttgaataggtgtgaagagtagccattctttctccttgttcccatcttagcctttaccattagttataatgtttgctgcaggttttttcccctctgccgtagatgccttttatcaagtcggggaacttttttcctatttctagtttgctgagagattttattgttgatggacatggagttttgtcacatgctttttatgcgtcaaatcatatgaccatgttttttttttctttacactgtaatttagattacattttttgattttcaaatattaagctagttttgcattcctgagatctactcccactaggttgtggtatgctattctttttacatattgttggattcagttacctaatattttctcaatgatttttacatctctttataagggatattggtctgtagtttcctttttgttctgtcttagtctgattttggtgtcaggatagtattgacgtcctaaaatgagttgggaagtgttctctcccatctcagtccttttggactgctatgacagaatgccacatagactgtgccacatatcaacaacagaaatttaaggttagggaaatttgtttctcttagcactcgaggctgggaattcttaggtcaaagcatcagcagattcccatgtctgaagggcctgctttctggcccctagatgactgtctcctcactgtgtcctcacatggtaaaaggggcatggaagcttcctgtctcttttataaaggcattaatcttgatcaaaagggctctgccatcattacctaattgttcaccaaaggcccacctcctaataccatcacattgggggttaggatgtcaatgtatttatgaattttagggtgacacattcaatctataatacctccttctattttctgagattgtatagagttggtatcactttgttaaatgttggttgatcccctccttgaagttatctgcgtctagagatttctgcttttttttgagacggagtctcactctgtcgcccaggctggagcacagtggcacaatctcggctcactgcaacctctgcccccaggattctagtgattctcctaccttattctcccgagtagctgggattatagatgcctgccaccacgccgagctaatttttttgtatttttagtagagatggggtttcaccatgttggccaggctggtctcgaactcctgatctcgggtgatccacacccttcggcctcccaaaaggctaggattacaggcatgagccaccacacccagccaagatttcttttttggaaggtttttttgtttgtttttttagatagagtctcactctatcaccccggctggggtgcagtggcacaatcttgactcactgcaacctccgcctcctgggttcaagtgattctcctgccctcagcctcctgagtagctgggattacaggtatgcgccaccatgcccagctaatttttgtatttttagtagagatgggatttcaccatgttaaccaggctagtctcaaactcctgacctcaggtgatctgcccacctcagccttccaaagtgttggtattacaggcgtgagccaccatgcctggccattttggaaggtttttaataatgattcaatttatttaatacttacaacactatttaggttatctgtttcattttgggtgaattttggtagtgtatggtttttgaggaattgatctgttttatctaagctgtcaaatgtatgcacatggagttgtttgtagttttctcagtatccttgaatgtctgcaatgtctgtagttcttccctatttcatttttatttttggtaatttgtgtcttttcttttttctctgtcagtcttgcttgagtttttttgtttgttttttttaaatcaattatattactctttctaaagagccatcttttgatttcactgattattagggggtttttttggtttgttttcaatgttggtcatttctattatttctaatatttgcttttgggttcattttgtttacattttctattttcttaaagtggaagcttagattagtgatttgagatttctcatataaacattttatatcataaattcccctgtaagcactgttttagcagtatccctcaaattttgataggttgtatttttattaattcaaaatattttctgatttcccttgatattcctctttgacttatggattatatagaagtgtgttgtttaatttccatgtgtttggagaatttgctattatcctttcattattgatttctaattttgttacagtttaggaggacatactttgcataatttcaattcttttaaatttggtaaggcttattttatgacccaggatatagtctgtcttggtacatagttccatgtgcattttgaaaaggataagtatgtatattctggtggcgttcctgaaattttctttaaaggttaattacatccacttggttaattgatgttcacttcttctatattcttgctgatttgctgtctacttatattcattttattgattactaagagttatgttgaagtctccagctataattgtatatttatctctttctcctttcatttctgtcagtgtttgattcatatatcttgaagctctgttgtaggtgcatccacactttcaaagtaatgattttttttgatgaattgactcttttatgagatgtgatatctctatccttggtaattttgtttactttgatgcttactttgatattaatagtttcatcttccttttgattagtatttgcatggtgtatctttttccatcattttacttttaaacttcactttatattatgtttgaagtgagtttcttgcaggcaacatatatagttggacatttaaaaaactcattgtgacagtccatcttttaattggtatgtttagataggtcatttatgtttaatgtaatgattgttatgtttggatttagatctaccattttgttattattattatttttttgcttttccatatgttttctgttcattttcccttttttttttggggggggagtattttaatattttttgtattttaatgtatcagttgtattttttcttgtatctgtttctacagttatttttaatggttgcttcagggattataatatacatacttcactttaaacagtctatttaggattaatattttacaattttgtatagaacatagaaccctttacaccaaataggtctctttccctttcctcttaagctgtgattgtcttatgttgacatccacatacattgaaaactccattagacaagattatactttttgctttcagttgacaaagattttatagaactcaagaagaatagttcattatatatatatacccagatatttgctgcttctgttgattttccttcattcctgatgaggttttgagtttcctgattattatttctcagctatccaaagaaattcctttaacaatttttttagagtagtctactggctacaaattctcttagattttctttctctgagattatctttatttcaccttcattcctgaaggatgttttcaatggatatgtattctgggctgacagttcttttcttgttgcactttaaaaattttgatctacctccatgtctggacattttgatgaaaatttcacagttgttaaaataagcaatgagttgtttttctctggctactttcaagagttaattttgtctttagtattttacagtttgattatgatccatctggccttggacttctttggatttatctcatttggagtttactcagcttcttgaatatgtaggtttatgtctttcaccaaatttgggatgtttttaactattatgtcttaagattttttatgtactgcattctatttcttttcctttgggaacttggttgacatgaatgttagactttttgcagtccctcaagtcactgagatcctccctcttcctctccccatcatttattcctctgtggcttagattgaataatttctgttgatctgtcttcaggtgtactcactctttgctctgtcatctctattctgtttgctggacccatttggtgagtttttattttatttgttaaatttttcagttctaacttttttatttagaactttttttaatttagaatttatttttattcttcttttgatcgtatatttttgtgccagagcattcctttctattcctttcaagaatatttgcccttccttggtgaagcattttaatgatagtttttgttacataattccaacatctgtgtcatcttggagttggcatttgttgtcttctgccatgtgttgagattttccaggttatttgtatgccaggtaattttagattgtatcttgggcattttggatattatgttagaagattcaaggtcttgcttatatcctgtatagagtgttgagtgacttgttcaggtttaggcacaatttctttcttttttttttttttgagacagaatctcactctgttgcccaggctggagtgcaatggcacgatctcggctcactgcagcctccgcctcccgggttcaagtgtttctccagccttagcctcttgagtagctgggattacaggcacataccaccacacctggctagtttttttgtatttttagtagagacggggtttcaccgtgttagccaggatggtctcgatctcctgacctcatgatccaccttccttggcctcccaaagtgcagggattacaggtgtgagccaccatgcccggctggtttaggcacaatttctaactaaccttgtgtgatttgtgatttcaatattagtgttgttttcaaagcctttgatatgctattcatatatgtcctataagatatgctattcagatatggcctacatgtgaccagatatgtgtcagttgcctggacagcagtatattcatagtttaattttcagagtctgtggtgtgctgcttaggttcagatccgattatgcaagcttttctctctgtgcattctccttgatagttctctgaagtgtcccttttctgttctctggtcagataactagggctttatttattctgctctgcggagcaattcctatgactttgcttgtatccaaagctaagcagtggaacaggagggagggaggggaagagagagagacagagagagacagcaagagagagagcacgagtgagcaagagagtccgagaacgagagtgagcatgcaatatgcagtagggggtcaatttcactctctggggagtactacttcgctgctgtaagaagaaagtttctcttcctcagtgttttaggctcttccaggcccctgttactactgttctcactgccaccactaccacagggtttcatgggagtttgggtgcaagagaatggataaaagaagaaaagggggggatgtttcctcagtgaatgttaagaaatccctttccttctcctcaagacagatttagaggatttttggaactctgtctgcactgatgcctatatcttggttttgggcagcattgagtacaggccagcagatactgaagaggaaaaatacatggtaaactgactgctggtttggtggcactttgattcttgtctttttctccaaaccttaagagtcttcacatagttgctgcatacattttgtttaggttttatggatgaattcactgggagagacaggtggaatatacttacttcactttattcagaaccaaaactttgcttgctttttgttttgttttgtttttagcttagaacaacacaaatttatcatctcatagttctggaggtcagaagtccaaaatggatctcacagaggtaaaaccaaggcagggctatgtccttctggagtctctatctgttccttttttttctttttctgccatacttttattttactatgtttttttatttaaatagctttaggtgtaccaagtgggttttggtttcatggatgcattgtatagtggtgaagtttcagattttagtgtttcctcactgaatgttaagaaatccctgtcacctgagtagtgtgcattttacccagtgtgtagtattttatccctcacctcccccaccttcctctcttctgagtcttcggtgtccattataccattctgtatgcctttgagtacccatagcttagcttccacttacaagtgagaacatacagtatttggttttccattcctgagttacttcacttagaataatggcctccagttccaaacaagttgctgcaaaaaacattattttgttctttcttatggctgagtagtattccatggtgtatatataccacattttctttatccactccagttgatgggcacttaggttgcttccgtatctttgtagttgtgctgcaattaacatatttgtataggggtttttttttgatataatgacttcctttgggtagatacatagtagtgggattactggatcgaatggtagatctacttttcgttctttgagaaatctccatactaaaactttgcttgatttttaataggacatttaaaaaactatccgctgtattcctaaacaagcaaaaaccaaacagatgagcaaaaaatcattaccttgctagaactcagccattcattaatacatccccttgggtaatcttcataaacctttgaaagatcttttttgggggttggggacctgagtacaggaattacttaaaagtttgttgttttgtatataaaatgcgcatctacctacctggctttaaaatatatttattttgtacagcaccattaaaatcctctttgtgatttttatggttaatatttcaaattgaaatttaataatcattttttaatgtcaaatagtggtcttttgttcataatcattagtaattaatacacaattacttaatatttgaaatggttaacatattccccctcttaacatctactttttcacaaccatttagtggatttgaccaaagaagctaagtgttattcagtttcattgactgaatcctaaaacttagacgtaagtatacattttttaaaaagaatactagtaatcttaacaatttagcttcatacggttattgtagttacctgtaactagcttgtatcttttatcagtcttcactggctttcagaaggtgctcagggcatgagaaaaaaaggaaactgattttgaggcacctattgtttcaagcctctaatccatttagttgctaatacattgtttatttgtacttatttgtcactaaaagtttgcagaggagtctattatttgtttgtaatttgccttgttagatttttagtgatcttaagtacagaaattatccgttatttatttagtatttactatttcccacctaatggattctcagtgaataatgataagttgattggaatttagatagtgaagatttttaaaaataagttaatagggaaggctttttactatttaaatattacatgatacagaaaaattaatctgattttaattgaactctacaaggtagaagcaatgagacagcacagatatctgtacagagtgaacagaacatatgtacaaagaaaaatagaggctttatagccataaaagcgaagcaagccagtcagtttctcaattgccatggctttccaattcccatgaagcatgcctctatcaaggtttctgtggtggggaccccagctcaccaactgaaaccattatgtctgtgaaacaaaccttttatttaaagtgattgtctgttctttgaaatcagaagaacaacaaccaaaacaaaacaaaacaaaacagattttccacttaaacatttacaaacaagaaaatcttatgtgaatcatattataaaagtttactataaattatatctttgataacctggtaggtaccatacacatttagagtcatccataccccagcttgaatcactgtgttaccatttaccacctgtgtgatttttggacaaatcattgctaagttttaattctcttgtctgtgaaacatttctatggtgtctagccagtggtatattggagctggcttataccagctcacaagagccaattgttaaattttcagaaatcttgtcggctgattgttaaacacaaccattaataagaattatataagcttataattaaataggttatattaaaagcaaagtcaataaatgctcaaaactcatcacttaattattttgctactctgtgttattatttatgtctttttttttttttttttttttttttttttttttttgagatggagtttcactcttgttgaccaggctggagtgcaatggcgccatctcagctcactgcaacctctgcctcccgggttcaagcaattctcctgcctcagcctcccgagtagctgggattacaggcatgcgccaccacgcccggctaattttgtatttttagtagatgtgggatttctccatgttggtcaggctggcctagaactcctgaccccaggtgatccacccacctcagcctcccaaagtgctgggattacagcatgagccaccgtgctcggccatttatgtctgttatatctgtatggtgaaatactgtataaagatgtgctgcttgcatatctcttcccaactctgtattcagtgatgtcatattggtagcttgaaatctgcagtggtagtatgtatattacggaaattggcaaatatgcaaatcacagtttgatttgttttattgactgtctagatttaagaaattaacaaaactggacgaggtggctcacgcctataatcccagcactttgggagtccaaggcaggagaatcacttgagctcaggagtttgagaccagcctgggtaatatagcgagaccttgtctctactaaaaattttaaaaaattagccaggcgtggagacgcacacctctagtcccagttactcaagaggctgaggtgggaggattgttttgagtctgagagagtctgcagtgagctatgactgcatcactgcactccagcctaggcaacacagcaagaagaccctgtctaaaaaaatagaagaaaaggaagaaattgatgtagaaaatgccaatgaagcagattaaacttaaatttttttatgtctgttgcttattattgtgaatagcacaaaacattgaggacatgttctaaactattgtctaatttagcagagaagttccttatgtcattagtgaacaagtgaagttatgatatatatctttgttgtttcactttcttctttttttaatgtaaacgaaaatatcagacattcagattggacctatactcattcattagttgcaaccttaggttgatttcttatgagttttccaaatcatgagcattttgtaagattcacctggctctatgaagttacaaaaaagagtattgtatttttattatagtttgtaaattatgtgctgtacatcctgtatatcagtaaaatttataataaacacatatacatcacacacacacacacacacacacacacacacacacacacggagctggtggttaaacatttattagcatactactacatctagcacagagtaggcattcattaaatactgctttccccttttctcccatttgaccttttcaaacataatcaaaatgtctgccatgcttaacgtaatcagggttgttgaaagaagagcaacctttaacttcaagtctgttttatgctttaatattatcacttttcaccagtattaaaaacataccgtagttaaaagggcaaatgaagggttgagggaatatggttttcttttgaattcaatatgctgggtcagatctaaaaataccaatacttcattatatttcaaagagggatagtagaaccttgaataacgatgtttattgaatattgaaaacactatgaatcatagcacttgtcagtatttccttgaagatattttttaagaaattgaagtaatttaatttttgcttttaatttggaaactttttattcttttttgtcctttttctcctttctcatgttaataagaaaatgattttataagaagcactgcaacactggatacagtcacaggcccattttctttttatttaaagaaaagaaagagcagctttatttctgtagtgcatagctgatttttttccagctcccaaaggggaagaactaattgctgatcattgaagaaatggaacatggagatccctttccatgtggatttaatatgttactaatcagggaaaagtaagcctttacacgtttttggtcctgtttatttccaaaagaatagcatggagtaatagtgttttcccctaacatgtttgcaaatatattaaggaagaattgaattatgtaggaaatcatgagcattttgtaggaaatcctttgtagaaaatcaattgaccatacatgtgtaggtctgtttcttggctctctatcttattccatagggtttatctttatgcaggtgcaacatttgtcttcattactgtagctttatagtaagtcttgaaatcaaacaatataaatttgatttttttattttcaaaattgtttgactattttaacttttcttaaatttccatataaatttttaaatctacttgtcaatttttgcaaaacagtctcctgggattttgattgtaattgcactgaatctatagattattttgtagaaattgacatattaacattgttgagtattcaacaattctagtccacgaacatgatacacttctgcatttatttaggtcttctttagtttgtcttagcaacatttttagttttccatgtagttttagttttccacatacagatcttgcacatatgttgctaaatttatccttatttcatatattaatgctgtcatcaatggtaatggttttaaattttattttgcagtcatttattgctagtttatagaaatacagttgagttttggatattgtctttaacctgaaacctagttaaattcacttactctagaagtgcttttgtaggtttctgataattttttacataatatgttatattgcctaggaagaaacagttttacagttttcctttcctatcaatatgccttatattttttatacttttcaacccacaaactacaaggcattttatttatgtatcttttgtctaatcattaacaactttaatttgagatcatcatgaccaaattttcttgcctaataatagaggaattctttgttacagtttttctaataaagccagttattcaaacatgctttttatatcagtacctaataaataatagttggaatgaatttattagaaaatatgggtttctgatttttacagaaaattgaagtctctttcaagcttctttgaagccatatcttttatctactactgtttaaaaacttaaggcaaatattttagcaagatattttacagtaaacacatttggtgagcattaacattagttttataaataaaatcacaataaaagggaattcaaacctactgatagcatttaaaatttttgtttcttcttccatacttgtcacagtgcatacttactggaaaatcaaatacaggtcactgcctgaagtagaataatttaaatgaatcaatattttaatttccagtggtagaacctctctcttgtcaagtagaaagagcagatggcaataatcattgaaataaatctcacaagcttgtctataattttaagtatgtaaagggacagtgagctcatctttcacatagactattgaaaattgtttccatcaaggaggaaggagaaaggaagaattaatgtctaaggggaataaacgtgtcgcccataagtctggggatatgaacttggaaacttataatacaaaaaataccaatataatgatatcatcatctatgacacttagtagtggaaacacaagagtgctagaaaatgtgaaaggaaatagtatgagtgaaaatatgattgaagctaagtaaaagttgaatatttatggcatgaattaacactcactcacaggctgggatgctaaccatggctggcagaagatgcaatgggatggaaaaggaatgttggctataaaaacagaagaaatgtgacaaaataaaggatagttgttaacttagaaaactacattttaaaaaggattatttattcttttctttttttgatattatgtggttaaattagttgattctctggtataattttagtatggatgttaaaattatgcatatgaaaatttggatttggaagtttaccataaaactggacagtattggtatctccctatttttatctgtatcttttctgagagctttagcagtaacaactttttaccaaaagtcttagcttatgtgtttgattttcagcatatgaaacttccctgatttttattttctatatgtaagtctccctaccacgtttctttggagattttaggaatttttcctttgttcttcggtggccatacatcttgtttggggtgaagggacttgatgaactataattttaactaaggattatcatgttttgatttaatagatcccagaggaagaatgctcttccatagctgtacctctggaatgttttggttgtacagtaaaattgaacatttggttattatttttagaaatacaagaatttccaaaacacagatcttctggcctgtcacttgtggcctatactctttgaaagtgctcaaaataataaaggtcaggttattgataatgattttagataatagaatttaaaaataattctgtaattttatattgaaacattaagccttagaagttgatagaagtattgtgcattacagaagtaccaagtagttaaaagttgctcttaatgatttaaaaaataagagcagaagatcgtttagccatacatcatgtagaaagaacattgtgttggcagcatgatctgaatttgaatccatattctgccccttagtcaactgttggcaatcactttgagccaactttgcttactacaaaatgataattgcagtactcacatttcaagattgttgtatgcaagttcctagcaaaggacctagcatgtcgtagaaattcagcaaataataaagtagagcaattgaaaagtacttgttaaggcaatcatctttaaagaggcactgtgggctgggcatggtggcacactcctgtaatcccagcagtttgggaggccagggctggcgaatcgcttgaactcggaagttcaagaccagcctgcgcaacgtggtaaaaccccatctcgacaaaagttagctgggcatggtggtgcgcctgtagtcccagctactcgggaggctaaagtgagaggatggcttgagcccaggaggcggaggttgcagtaagctgagatcgtgccactgtactccagcttgggcaacagagtcagaccctgtctttaaaaaaaaaaaaaaagcagtgctgaaaatgttagaactatcactttagttgcattactaataaataagctgaggggaagactaattttctctttttttagtagttttataatactcatttcagttactcaattatgtgacatattaactgtcagtttgatatatatctatatagtatattgtattttggctgagagaaggaaaagtgttctacttatagtcctagcacactgctaaacatatatttgtgtggttaacaaattggtgaatatgtgttttaaattgcacttttactttattttcacaactgctgttcttatagttgttttatagtactatttcccaccattcaaacctatctgtcctgaaacatgtcaatcattctttagagcctttatattttctgtaccttctgctcttacatctttgcaagtctgactccttatctttcaactctcaggtcaaatgccaccttctccaagtttttctttgactaccgattctaaagtcactctctcgacacttgttcaactatcatatcacctagtttcattttcttcattgccatatgactatttgaaagtgtctcaatttatttaattacttaacttctgatagaatgtcagtttcctaaaagcaagatcctagtatgtcttatactattatctattctggctactaggttctttctctgtctctaatttatttgttgtattccttttaattgataggtatatgagaactcattatactttcccctctagttttatatacatgtgaaattttccacaataaaaagtttttttataaaggattaaatggatttatagtatagaaaaatatttaatacagaatgatatgaaacccaagtttgtcctgtactcttctcctttcttgtattttttgtttttattttattttttttgagacagggtctccctgtatcaccctggctggagtatactggtgcgatctcatctcactgcatcctcaacctcctgggctcaatcaatccgcccacctaggcttcccgagtatctgggactgtaggtgcgcatcaccatgcccagctgctttttgtatttttttgtagagacagggtttcgccatgctgcccaggctggtcttgagctcctgggctcaagcaatctgcctgcctcagcctcccaaagtactgggattacaggtgtgagccatcgggcccggcctcctttcttgtattttaaaatatgtggtgagagtaggttttctcctttctcaaaaaatttcatgtcttcctttctttaaaaagtcttttgtccccctcactcccctgtgataatttagtccgaaagccgagcacatggtgttaagcctgaatggtttgaggataatatctgcatgggtgggggtgggtcactgcaaccatgggatattacacacatagaattgatcgaataaggaaatatgttcaaagtaatgggaaccaggtttctaacttttagagaaggaagttaccgatatggagaaggagaaaactagaatgaaccctaatggtgttagattggctaagagatattactataatctcttggttttcaacatatattgatagatgtagcatgtgtcgatgtatacacatatgcttagctctgtccactgagagggcctggaaatcgacatcccaataacagtgagcacactcagtgtccagttgttggtttctaaatataattagttctgctgtaacatttgttttgcatcatgagtttatttcagtgcagttaataagttaagaagcaggtgaaatacaatgtaaattttacatttatttctgcatgattttgtgtttgagaaacactaggtgaactcaggatactgtatgtagctgaaccgagctgtgtagaaatacacaaaatgcatacatgtgcacacctcacacatctaccagctacttcagttactgcttgtgttatttgtcacactcatttacaactggtgtaaactttccctgatttcatatagctagccctctgcactacttcacaataatccataaactaaaacccttctgacacccacttccacaagcaaacttcaggtctttttcaaaagtaaaatgccatgtttattatggtatttatgtatttcttaacctttaacatttataaaactgtgataccatttttattaggttcctatttttttatgtgccctgatgaaggtttgtagttttgtgcttctaaccccacttttctcataagccctgtggttttattgaatgactttgcatagtgcagtgatctttaggaagatgtatgtcaccttgtagatctgactgaacctctcttcattaaaacaaatcagagctccttgaagaaggtactcaggagctcttcctgattccagggctgggagagggtcagagtacctcctcacaaagtgcttattaattacaagaggaaaacaaattaatttatagtggagatgtctcccacttaagtcatcaccttaatcaagagatcacagtcaccagtaatcaaacaagtctgtcatgtgccatctgattaaatgcagtgtgaagaatagagcatcacttctgtgatattcctgccaaagatgcataacttaaatccaatcaggaggaatcatcagacaaacctgaattgaggcgcattttacaaaataactgtcttgcaatcttctgaagtgtaaaggttaaaaaatcaaagaaagattgaagctgtgtttcagattgccacacttgtcattttctaagttttaaaattatagccatcctggaggatatgacgtgatatctcattgcagtttttatttgcatttatcgtctgggtaatgctgttgagcatattttcatatgcttattagccatttttatttcttctttgggataagtctattcacatcctctgcccattttaaaattgtgtagtctttatattattgcattataagagttccttataaatacaagtccttcgtcagttgtattggcaaatattttctcccattctatgtttaccttttcatgttattgatggtgtcctttgaataacaaaagttataaattttgataaagtctaatttatctcatttttctttcattcattgtgcttttaatgtcatatgtaagagaggtttgtcttatcttcagtcatgaagattttcttatttttattttctaagagcaatgtaatgatagcattgtgggtgatacttagtaatgaaaacgatactggaaaaagaggaaggtctttgctccattttgaattaattttcgcacatgatagaaagactctcccttcattcttttgcatatgatattcagttgtcccaccaccatttgttgaaaagactagtctttctcacattgaattatcttgtcacctttgttgaaaatcagttgaacacaagtgtgagagtttatttctggactctcaattctttttcgttgacctatgtttattcttacatcagtactatgctatcatgatattatagctttatggtaagttttaaaatcaggaagtattaattcatcaactttactcttctttttcaaaattattttggctcttttgggttccttgcatttccatatgtattttagcatcagctaaaatttaatctatctttcaaagtaggggtgacatttcaacaataagtaagaaagtatgtttttcaaaagtatactaaatggagacagcactttggaaatgggtatttggaaacgggattttgttgttgttgctgctcctgaaaaatacacacataaatccttctgcctctacaataaaaaatttggaaacaactttttagattttaaaagatctcacaaatgaagaatgtcagtggattttgaatacatcagaaaaaaactaaagatgcagctaatgctattggtttggaacagcaactgatggctttcaaagaagatggaaagttactaggccttttttttttttttttttaaagagttaaggtcttgctctttgtccatgctggagtgcagtggcccaatcatggttcactgcatcactacaacctcaaactcctgggctcaagagagccttccgcctcagccttttgagtaggtaggactacaggtgcacaccaccatgcctggataatttttacaaatttttttgtagagatagaatcttgctgtgttgcccaggctgatctaaaacttctggcctcaagcgatccttctgcctcccaaagcactgggattgcaggtgtgagtccccacccctggcctcactgtctttttgcttattctctgctctgtggtataaagatattgttgaaaatgtaaaaaaaaaaaaaaaaaaaaaaaaaagcctgtacatacccctatgggttatagtgataagaaaaagaggaagcctttatgttgatgttgatatgtagtagagaaagcccagctattggagaaactggatagtagtttaaatgtgaaatgtcttacagaagagtatggtgttggaatgaccaccatacatgtcctaaagaaatagaaggatatatgtatacatatatatgaacatatagaaggatacacacacacacacacacacacacacacacacattattcagccacatttaaaaaagaatgaaatcctgtcctttacggcaatatggatggacctgcaggccattgtgttaagtgaaataaactaagcacaaaaagataaatatagcatgttctcattcatatgtgggagctaaaaaaatagatcttatgaaaataaggaatagatttgtggttaccagagacggggaaggggaggaggggatatgaagggaaaataaataatataaaagtatttattaccactgaagtatacacttaaaaatggtaaagatggaccagccatggttgctcatgcctgtaatcccagcacttgggaggccgaggtgggtggatcatttgaggtcaggagttcaagaccaacctggtcaacatggtgaaaccccatctctactaaaaatgcaaaaattagccaggcatggtggcgcatgcctgtaatcccagttactcaggaggctgaggcaggagaatagcctgaacccaggaggcggaggttgtagtgagctgagacggcgccactgcactccagcctggacaacagagcgagactccatctcaaagaaaaaaggtagtgctcgcttcggcagcacatatactaaaattggaacgatacagagaagattagcatgaggatgacacgcaaattcgtgaagcgttccatttcttttttcagcaccacaccccacctattccaaaattgaccacgtagttggaagtaaagcactcctcagcaaatgtaaaagaacagaaattataacaaactgtctctcagaccacagtgcaatcaaactagaactcaggactaagaaactcactcaaaactgctcaactacatggaaactgaacaacctgctcctgaatgactactgggtacataacaaaatgaaggcagaaataaagatgttctttgaaaccaatgagaacaaagacacaacataccagaatctctgggacacattcaaagcagtgtgtagaaggaaatttatagcactaaatgcccacaagagaaagcagggaaagatctaaaattgacaccctaacatcacaataaaaagaactaaaaaagcaagagcaaacacattcaaaagctagcagaaggcaagaaataactaaaatcagagcagaactgaaagaaatagagacacaaaaaacccttcaaaaattaatgaatccaggagctggttttttgaaagatcaacaaaatcgatagaccgctagtaagactaataaagaagaaaagagagaagaatcagataggcgcaataaaaaatgataaaggggatatcaccaccgatcccacagaaatacaaactaccatcagagaatactacaaacacctctacgcacataaactagaaaatctagaagaaatggataaattcctcgacacatacaccctcccaagactaaaccaggaagaagttgaatctctgaatagaccaataacaggctctgaaattgaggcaataatcaatagcttaccaaccaaaaaaagtccaggaccagatggattcacagccgagttctaccagaggtacaaggaggagctggtaccattccttctgaaactattccaatcaatagaaaaagagggaatcctccctaactcattttatgaggccagcatcatcctgataccaaagcctggcagagacacaaccaaaaaagagaatttagaccaatatccttcatgaacattgatgcaaaaatcctcaataaaatactgacaaaccgaatccagcagcacatcaaaaagcttatccaccatgatcaagtgggcttcatccctgggatgcaaggctgttcaacatacgcaaatcaataaatgtaatccagcatataaacagaaccaaagacaaaaatcacatgattatctcaatagatgcagaaaaggcctttgacaaaattcagcaacccttcatgctaaaaacgctcaataaagtaggtattgatgggacgtatctcaaaataataagagctatctatgacatacccacagccaatatcatactgaatgggcaaaaactggaagcattccctttgaaaactggcacaagacagggataccctctcttaccgctcctattcaacatagtgttggaagttctggccagggcaaacaggcaggagaaggaaataaagggtattcaattaggaaaagaggaagtcacattgtcgctgtttgcagatgacatgattgtatatctagaaaaccccattgtctcagcccaaaatctccttaagctgataagcaacttcagcaaagtctcaggatacagaatcaatgtacaaaaatcacaagcattgttatacaccaataacagacaaacagagagccaaatcatgagtgaacttccattcaccattgcttcaaagagaataaaatacctaggaatccaacttacaagggatgtgaaggacctcttcaaggagaactacaaaccactgctcaatcaaataaaagaggatacaagcaaatggaagaacgttccatgctcatgggtaggaagaatcaatatcgtgaaaatggccatactgcccaaggtaatttatagattcaatcccatcaccatcaagctaccaatggactttcttcacagaattggaaaaacctactttaaagttcatatggaaccaaaaaagagcccgcatcgccaagtcaatcctaagccaaaagaagaaaaccggaggcatcatgctacctgacttcaaactatactacaaggctacagtaaccaaaacagcatggtactggtaccaaaacagagatatagatcaatggaacagaacagagccctcagaaataatgccgcatatctacaaccatctgatctttgacaaacctgacaaaaacaagcaatggggaaaggattccctatttaataaatggtgctgggaaaactggctagccatatgtagaaagctgaaactggatcccttccttacaccttatagaaaaattaattcaagatggattaaagatttaaatgttagacctaaaaccataaaaaccctagaagaaaacctaggcaataccggtaattcaggacataggcatgggcaaggacttcatgtctaaaacaccaaaagcaatggcaacaaaagccaaaattgacaaatgggatcgaattaaactaaagagcttctgcacagcaaaagaaactaccatcagagtgaacaggcaacctacaaagtgggagaaaattttcgcaacctactcgtctgacaaagggctaatatccagaatctacgatgaactcaaacaaatttacaagaaaaaaacaaccaaccccatcaaaaagtgggcgaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggctgtcattaaaaagtcaggaaacaacaggtgctggagaggatgtggagaaataggaacacttttacactgttggtgggactgtaaactagttcaacccttgtggaagtcagtgtggcaattcctcagggatctagaactagaaataccatttgacccagccatcccattactgggtatatacccaaaggattataaatcatgctgctataaagacacatgcacacgtatgtttatagcggcactattcacagtagcaaagacttggaaccaacccaaatgtccaacaacaatagactggattaagaaaatgtggcacagatacaccatggaatactatgcagccataaaaaatgaagagttcatgtcctttgtagggacatggatgaaactggaaaccatcattctcagcaaactatcgcaaggacaaaaaaccaaacaccgcatgttctcactcataggtgggaatcgaacactgagaacacatggacacaggaaggggatcatcacactctggggactgttgtggggtcgggggaggggggagggatagcattaggagatatacctaatgctgaatgatgagttaatgggtgcagcacaccaacatggcacatgtatacatatgtaacaaacctgcacattgggcacatgtaccctaaaacttaaagtataataataataaataaaaagaaaggtaaagatggcaaattatgtatgtatattttacctcaataaaacatgaagaagaaacagaaatataaactgttgaagttctgtggtgaacgttatgaacagaagttaattaaaaatagaaaaactgcataaagctaaaaatgaattatcttgatcatacattgtaagagtggacccatcagcattccagtgaatacatgccatttaatggtatgctgttcataaaacaagcaaagatctttcatggtggactaaaaattaaagggaactgtgaaccaaaaaattaagggaacaggctggccttaactttttaaagatttgtggtgaatgagcatctgctgatcacaaagcagcagagaaattgactagttttccaagggatcgctgatgaaaatcagataccagaacaagtctataatgctaatgaaacattactgtttggtgttattgccccagaaagacactgactacagctgatgagatagttcctataggaattaaggatgcctatgacagagtaactctactgggatgtactaatacagcagacatgtataactataaacttgctgtgatagtaaaaagcttgcatctttacactttttttaaagaatgaatttcttgccagtctattcttatgcaacaaaaaggcatggatcaccagcgacattttttctgattggtttcacaaacattttacacgaatgacttgcgttcactgggaagctggactgtatgacaaccggaagattttgttattccttgacagctgttcatcctccagctgaaattgtcatcaaaatagtgtttatgccgtggaattcccctcaaatgttcattaattcacccatgtgaccaaggtatatttagattaatgaagaataaatataaaaacactgtcttgaacagcatgctagaaacagtgaacagaggcatggatgtggaaggtttgcagaaggagtttagcatgaaggatgctgtgtatgctgttgccaatactgggaacacagtgactaaagacacagttgtgcatacttggcataatctctggcctgtgactattttcaatgatgatgatgaacaaggtggtgactttgaaggattttgtatgtcaagtgaggaaaaaatgatatctgacctccttacatatgcaaaaagtataccctcggagtctgtgggtaagctggaagaaatggatattgaagacatttttaacatcagtactgagactccagttgttcatttgttgaccagtggtgaaataaatgtttctgaatcaaggtgattgtgataagagcaatgatgaagatgatgatgtttaacacagtagaaaaagtgcccatatgtgacatggcaaaaatatgtgatgggcttattgaaggactagagcagcatgcattcataacagaacaagatatattggtcagcttataaaattaaagagtgacttctaaatcaaaaactgttgctaatgaagcagatgactctggaggaaacactttaaaaagccatccagcagatgtgtccttatccctagaggacccacttcctggtccctcagttgcttccaatattttatctcacctaaaaaaataaaatactgtgtacacaataaccctttaatcaaaacatagaattgtaggttgttgctgttgtctaacagctgatacagatattctggtgatgctactgtgtttttaccgtgaatgcattatttttcactttgttaatggtatgccttaatttttcctgataagtacttatgtgtgaatatgtgtaagagagtgattgcttgtcattatagtgtataaattcaaagttgggattgatggtgatgccaaacaaccacagatcatttacatgggtggctgagctagtgacacctttgctttctgattgttcagtgtacacaagctgtttaatgcgcaaaattattaaaaatattgtataaaattaccttcagccgatgtgtgtaagttgtatatataaaacataagtgaatttcatgtttagacttagattttatttccaagatacctcattatatatatgcaaatattccaaaatccaaaaaaattccaaacctgaaacacttctagtcccaagcattttggaagagggtactaaacctgtaatcttttttttttttaaactgttaaaactttcttgttatttttgtttctgtttttgttttttgagatgggggtctcactctgtcacccaggctggattgcagtagtgcgatcatggctcactgcagcctcgacttcctgagctcaagcaatcctcccacctcagcctcccatgtagctgggactacaggcatgtactaccatgcctggctaatgtttgtattttttgtagaggtggggttttgccgtgttgcccaggctggtcttaaactcctgagctcaagtgatccacccgcctcagcctcccaaagtgctgggattacaggtatgagccaccgtgcccagccttatggataattttttttcttttttttttttttttgagacagggtcttgctctgtcgcctaggctggagtgcagtggcgcaatctgggctcactgcaagctccacctcccgggttcacgccattctcctgcctcagcctcctgagtagctgggactgcaggcgcccaccaccacacccagctaattttttatatttttagtagagacggggtttcactgttttagccaggatggtctcgatctcctgacctcgtgatccacccgccttggcctcccaaagtgctaggattacaggcgtgagctaccgcgctcggcccttatggataattttttatgtgcaggaactgttataagaattttacaagcattgcctcctttaatcctcgcaacagtgctatggatgaggtaagtgcagagagtaagtgacttgtgtgagtgctcagtgaatggaagagctaggatttaaacctggctggtctggctctagtcatttttttatatccacagtatagtctgccaaattccaaattaactttacatttgcctcaatgccagccaatctaatcttcttactaacttgctcatgcattatgctggactgatttcagtattctgttctaagtcagttatgcaaactattttccttatttgtttatatctcttctctctgactactagatctttcttagcctccgaaaatctaggtcaagttccatctacaactactttcaaatacagttgtcctttggtatgtgttgagggttggtttcaggactcccctcagatatctatcaaaatctgtgggtgcccatgttccttatataaaatggcatagtatttacatataacataagtacattttcctgtatgttttaaatcttctctggattacttatcataccttatgcaatgtaaatactatgtaaatagttgtattgtttttaaatttgtattattttttattttcttttttttccaaatattttcgttctgcagttggttgaatctgaggttggttgaatccaaggatggggaacccatgaatatagagggctgactgaatatgctcccttttttctgaactttttagtgtattggtagtactgtgagttttaccatttcatcattctcattttctttatggtgctaacatatttttcaagaagacagtcagttctttggtgcagaaatttaagagacagtaggaaaaaagaaaaaacaaaagacaccgagatatatagagtttaactggctgtggtcttataagttatcattaatggatttaaagtagaacttaacttttcttttcctggtccactatctctgtcatcattccctcctgcctcccaatttagtaaattttgattcagtatttgttgtcttatttaatatctgcatttgttggtaatatagacataccctaatgctatgagaccaatgaggcaataatgtgcacatttccaaaaaaatgcaacctaggcaagtaagagatattttctgtacagattggtgctgatgggaaggattgaaattaatattagcaagaatgaagatagttttggtaaatcacattacttttctgatgcacagagtgtattttgatgtcattaaggaaagaaatgctgaatctggtacataataaacatgcagtagacattatttgggtatgtttgattatcaaatataattctaagtagtaatacacttttgtgcttctagcccaggcttgagatgtaaactaaagggaagaaatataatttcaaaaagtattttagaagaaattgtcgtcacaatcataagtgagttattgtaaagtatttctaacattaaaaaaaaaccttttgtgaaattgtaatttaaaataaattgtggagaataagttcagagttctggtggcttaaaagtaaaaacatgtatttgttctggagaggagaaatgatttcagggagaaaaagtacaaatgaaaatcaacaataagtacattttcattttgtatccctaacttagcatctattttttatgccttattatttcttacatttggggtgaaatagtgaaacagtgatctataaatttattatttttgcttcctaactccatttgacaaaagttttattcataccctggcttaatgtaggttttgttaccagataattacatttgtcccatatatggtgaccatagtcatgatgctacataaaacttctgatggtgaagctataaagacatgctcagctcaaaagacaaaaagtaaattctgaaggacatcctctttttccttcttttctcgctctctccattcctcacttgaccaagttcttgttagagcctacaaatggctatttggatttaaaagggggaggggaatcctactaattgagttccagacaagttctgtttgttacttttcagtaagaaagaagtttttgtagtaaactttccagcttaaaagcaatataatcagaagagttttaataatgagtaaaagctcccactcactcccttcaaaataaaaccattatagtaggaagctgagtttagatatcataggcataactgttagaaaataattgaaattttgttcattagaatagtaacaggaattaattgctgttttcaagcgagaataaactgttgaaggatggatctgttcagtcattttgatagtgtaggaatttttaaaatacataaactggtgatccttagtgcattctcttttcttgcaggattcctatagcatgggtaaaatagtttattctaacattgtctaaagtagcaaaaaaaagtaaattttaaataatatgaaatggaataaactctagaacatgtaggtgaaagaacattatgaagctgttaaaattatgattttaaagagtatataatctgggaaagtatacctcacaaaatattacataaaaggatattttacacacagattattaccctgattctgtacagtacgtacacatgcatatgtattaatagaaaaaatacgccagtatagtggctgagattgtcatgaggattaggagcactgatgtttttatataatgaaggtttattactcttatcacaagaaactttttttttttttgagacggagtcttgctctgttgcccaggctggagtgcagtggcgcaatctcggctcactgcaagctccacctcccgggttcacaccgttctcctgcctcagcctcccgagtagctgggactacaggcgcccgccaccattcctggctaattttttgtatttttagtaaagacacggtttcactgtgttagccaggatggtctcaatctcctgacctcgtgatccacccgcctcggcctcccaacgtgctgggattacaggcatgagccaccgtgcccggcccacaagaaactttttaaacaaattttcagttaaactgaatgagtagaggtttgacctaaaactaagatttactatagagttttttttttttagtttgagtgctgtgtcaattctagagactacatattatgtcctgttcatatctttctaggaggatttgcttcattcatagacgatttataggtttctgaactttatgtaccaaaaataaatggtcagaattgatgcttctgtaggagaccctcaagtcccataatggcatttatttctattataatcttttggggaatgccacgtgagtggcatttagattgaaaacatgagtacaattagatttatgtaattctctgtgactgtgagaaggatttttgtgaggaggattttgtacaatgaaatgataataatcagcccttgcattctgcaggatttaggaatgccaccctttaccaaagttaagtagaaaatattaagtgtagggctagtgagtctgaggagcacataagcacctgaagagaatttcatttatgctaagaagtttactcctttgcatttagctgtaaattgtataataaagttgcctaactaaggttttactatctcaactcccctaaacacatgttgtgttttacctggtaacagatatcctaaatgtaggtagaaattaattcacctccatgtactactttaggttatagaaatgcttattgggttctttcattgcaagcaactgaagttggatgacaaagtaaaatgggcatttattgaaggatgttatggtggcacatagaattgaaagaacagaatattcagatcaattcaaaagaaaaaagtaggtcaactttggtgctcccagcagtgcaatgcatgaacttatttgtggaagaatgtttctcaaattgtctgcagcaaaaaaaaatctatatctgtttttttttaactcaatattttttcgttttttaaaacatacatttttaatttttgtgggcatgtagtaggtgtatatagttatagggtacatgagatgctttcatacagggatgcaatgcatagtagtcacatcatggagaatgaggtatccatcccttcaagcatttatcctgtgtgttacaaacaatccaattatactcttttaagttatttttaaatgtaccattaaattattattgactatagttaccatgttttgctatcaaatagtaggtcttattcattatttctgtttttttgtgttttttttttttgtatcagttaaccatccccaccaccccctaacctcccccactacccttcccagcctctggtaaccatcctttctctctctctctctctctctctctctcagttcatctgtgtccatttttagatcccacaaataagtgagaacctgcaatgtttgtgtttctgtgcctggcttattttgtgtaacataatgatctccagttccatccatgttgttgcaaatgacaggatcatattcttttttatagctaaatagtactccattgtgtatacgtaccacattttcttcattcatctgtcaatggacatttaggttgtttccaagtcttggctattgtgaacggctgcaacaaacatgggagtgcagatatctcttcgatatgctaatttcctttcttttgggtatacccagcagtgggattgctgggtcatgtggtaactctacttttaattttttgaggaacctccaaactgttctccgtagtggttgtactaatttactttcccatcaacagtgtatgagggttccctgttctccacatccttgccagcatttgttattgcctgtcttttggatataagcccttttaactggggtgagtctgtattttttctcttaaataattattttggttttgagcttattactgtgtttatacataaatactggttaattttgatagtttcattatttcattagtcagcatatctctgtagttgtctttgacatagccttttgcttcagtgctcagctaccttcctgtattttgttttatgtttttgtcttctgaaaatttccctttctttcagttacatgtttaaagagatgatgttttagtttgggcttctacagcagattaccatagataggttggcttaaacagcagacagttatttttcatggttctggagtctggaagtgtaagatcagagtgccagcatggttggttctggtgagggcttccttcctgattatgtcctcacatgccatttccttgatttgtgcatgtggagagagatctcatgtgtttttctctttttaatttaatcataagggctctatccccacggcctcatccaaacctaaataactcctaaaggccccacctccaaatctcatcatattggggattaagtcttcaagatatgaagggaggctggggagacacacagtcatttagtctgcagcagatggtttttaaattttatccaacatttttagatgttttgtgctatgaaggttgctcagagtatctaatttactttgtttccagaaatgaaagtctcagtctcttcaacctcaactaaaaataactttgtttaaaaatgcaccagattattttactcccctgcttactatcttttaaagtgttacatggccccttcatctggcggtccctctctcttcagcctcattttacattactttctctttcatttggtattgttaatcactgttggttttctttcccaagtcaaccttgctctcaactcccgcttattattatttttcctgcctcacatccctcagctccttctttatatctcaactgaagtgtttcagagactttctggatctttttataatgggttagtgcctgtcgatgtgctcccctagcattctgtgccttcctatttattacatacattgattgttcttctaattacttctttacgtctgttttctctcaaagcacagggaatgtgtttgcctccttcatcactatatccttagttaataaatagcatggtgcctggcatatagtagacactttaaaaatatttgctgttgaatatataacattgatatttaagattcattattaccctatcgtatgaattaagtagctcaggtagtggtattacaattaagtcattctcttgattaagtttgaattggttttttttttaatttgtctttaggccctagacattttgaattaatctgattttgtatgaaataattttaaacttacagaaaagttgcaagaatattacagaagagttcatatatactctttacccagctttccttaatgttaaaacgtactcaatcgtagtgcaattaccagaactaggagattaacatgttggtatagtattactgactcaactacagaccttactcaagttttaccaggtttttttcttcatgtccttcttggtgccaggaaccaattcaggatctcacgttgcatttggttgttgtgactcttcagtatccttcactctgtgacacttccttagtcatgactttaacactttgatgcgtattgtgctttgataattgatttgtacaatatctaagtttatttctgcctgatgttttctcatttttggattcaggttgtgcctttttgtcaagaataccagagaagtgatgttgtgtccttcatagtgcatttttttcagggggtacctgtagttgctatgtcttattttattggtagtattaaccttgattacttgtttaaagtggtgtctgccaagtttctccatggtaaagttactgtttctccctttggattgataaatatcttcttgttcctcaaactttgacccattgatttctattatctatggatggatcttgctcgcaagggttactactgtggtatttgcctagtggtaattctatatttttctcatttcttctacatttattaattagaattattctataaggaagagctgttctttctcacacatttattcagttatttatttattcatatcaacatgggcctttgaatatgtgctttattctatggattataatctagtactgttactgtcatttattttattgctttggtcattgggagcttcttcaagttggaagaatttatgtcattttgatctgccaccattcttttgggaaagtttcttattttctggtatcttaaggtattccaggctcaccttgtattttccctgacccagccctggaaatcaacttcgtctcctaagacccctgactccttttatttggagaatgttatttaggaaccaagatctgagtgctagacttattgttactagactattattgctgctagactctaccagcagaggagctaagaaatatgtgtgtgtgtgtgtctgtctgtctgtctttgtgtatgaactttgtatacacactgataaggtttggctctgtgttcccactcaaatctcatcttgtatctcccataaatcccacttgttatggaagggaccaagtgggagatgattgaatcttgagggcaggtctttcccatgctcttctcatgatagtgaatgggtctcatgagatttgatggttttaaaaaacagagtttttctgcacaaccgctctttgcctgctggcatccgcgtaagatgtgacttgctcctccttgcctttcaccatgattgtgaggcctcctcagccatgtggaactgtaaatccaataaacctctttcttttgtaaattgcccagtcttgggtatgtctttatcagcatcatgaaaactgactaatacatacacatatctgtatttctatatctatttgcatatatattaacaaccatgagttcacactgttaacctctgattttactctatcactctatcatacaaattttattgtagctccccagggtacagttccccagtaccctttctcctattctgtacttgaaatttacctgatattccttgtatcaagagatagagactagtaaatagtcaatcatttaatgtgttgaatatgctcagggttatgttggtcagtaatgtctctgaaaagggttatttaagagggtggcagatgactagggagaaaatgtgactatgaatgttgggatttgggaaaagagatggtttggggatacttggggaaaaaaaatgttcagacgggagaacaaacatcatgtattaaggtccagagataaggaaagtatggctgctcccaggaactgaaaattgctcaggatagctatataggttgagatatcagatgaattaaagctgaagagaagtagcactgactcttgtaagactttataaactatgttgcagggtatgaacagtatcctaagaacaacagagagttactattttaagctaaataattatattccctttcctttcacaatggaaaaccatttttagcataactctttgttattagacttaaaatgtaaaattgtactcatacttatttgtatctcatataatgctacaaaggttttgacataacattttctttgaaggagagtcccaaggaaaggaatttagtcattcttatgagtcagtgaatgtgtgtcattgaaatactcaggattactttctcccttttctaagatggcatgttttcttttcctttttccctccatgttttgctttaagagcaatgcagctataaagtatgcttcagttgcttagatgataaatttgtctatatgtaattaagagccaaaactgtgattttacattagaaattagttaaggtttattaatcgaatagaatgtgttctgttttcctcaagaaaatagagattttaccacttgtccagatcttctatttaaatatataatcactaaactttttttaaaaattgcattttcatagtcagttgtttccttaatttcattgttttatatacatttgctttgttctgtcatctttctcagtatgattctgtgatgtattttatcaattttcttttagtcattggaagagtgtctttatcagacaaacaagtggctgcatttctggtctaatttgaagaatactgaaatgtcccagaatatagaggaagagagaagtatataaaaccctggctttgagggaatttgagctaagaacttaattttctttatttggttatgttgctgtgaaatcagaataaaagagaatattgcaggaattttgcaacaaagatgtagtttatggatgttaaagaattaacaaaggataacccatatctggattttttaatactttttttaaaaaaagaaatctgtctttcctatctttttttttttttttttttttttgagatggaagtcttggtctgtcgcccaggctggagtgcagtggcgtgatctcggctcactgcaagctccgcctcccgggttcatgccattctcctgcctcagcctccctagtagctgggactacaggcacccgccaccatgcccagctaatttttttgtttgtttgtttttttgtatatttagtagagatggggtttcaccgtgttagccagggtagtctcaatctcctgacctcgtgatctgcctgcctcggccgcccaaagtgctgggattacaggtgtcagccaccacgtctggcctgtctttcctatctttttatatctgaccaatattgatgttcatcataaatgtgttttctctttagctatatgtcttagtccatcctttctgctataacaaaatactttagtctgggtaatatataaataatagaaatttatttctcatagttctggaggctgggaagtccaggatcaaggcaccaacagacgtagtgcctgataaaggcttgccttctgcttccaagatggcatcttgttgttgtgtcctctggaggggtccaacactatgtccttacatggcagaaaggatgaaagggactagggagatttcttcagcctcttttataacgtcactaatcccattcacctaaacacctcttaaagccccacctctaaatactatggcatgggtgattaagctttatcatgaatttggggggacacattcaaaccacaacattacatatatgcttggcagtttggagagaaatgagatggttacctgcctatcattctttgaaagctttttccctggagtaagtcaccagagtagttaagactcttatggttcattgttttactcatctttgcaacagtgagactgagcagtcagggccgagcaccatggctcccacctgtaatcccagcactttgggaggctgaggcagggggatcccttgagcccaggagttttgagaccagactgggcaacaaagcaagaccctgtctctatataaaaatgaaaaaaaattgaaaaaaagactgagaattcagttaagttaataatagtattcatcttggattatcctcagatatcttttgtttgctttgtttattgtaacttcagtcttaataataattttgatctgttgctttgcaagagtgaaaaagaactaggattactaatagtttagttaaaagtggatctaactagatagatttacttaacaaaatgactttaaataatggtatactttgtggtatataaagtgattaattagctaacagaattagaaaataaaaggccttcagttaaaaatacctaattctcttgaaactgtcatctgtatacaaagtagtattttgtcatatttgttaaatggagaagagtgctggaaaaaaaaatcccctttttattgtcctttaagagaattcatttccagatttatatccagatatatgtggatatattcatttacatatgtactaattcctgaaattgattggtctgaataattagtctacagtcaagaagtcctctttcaaattgcctttccttgactttataaaagaaaggcttgtctcttacgcaatctaaattttgctgtgatacgttgttgccattttggatcccaaacaaaggaattctctgaaatactcaaatactcattgtaggtattaagaaagtgagtaacagggtaacaaatcctttgcaagtccagttttttgttttcactgaaactgaaagaagacttaattgtaagcttatttatcattaaaattaattttcaataaatcaccatgtggcttttggaaaatacataggcattcaaagattgacattgctgcaacaaactttcattctgatctacttatttatgttaacaatatttcttaacatttatgtctataagatgaaaccaaatacataaagtagttattgaattaattcaagtagttattgaattattatggcatttaatttccattataattttggaaattgtataattgtataattatacaattggattgtataatggaataattgtataatggaaattatacaatttccattatacaattaaaacaaagtccttgtattttaaaatgtaaataattgcagggtaccagaaattacattgtttataattatttaaatgtgttcaaaatcagttatcatgacttaacaattgcaagatagttattcaaaattattttagaagttacaagggcaaaaatcatttgaaaaccactgttacattcctcccactttactaatgaattatgcccttgtttgaattatttattgatatttcatttattgttgttctttacctagcagacattaggtaaatactcattgggataataaatagcttggattgtattgtatctagtgccagtgagattgatttttttctcaattacatgtcactgttataagtgaaaagacttttttgtgtgtgttctaccaagaatattttaaacacatttagttaaacctcacctgataaaaccttaagatagactcagatcagaaaatcttgtgtagggactacttaagcctagttatattcagaatcattttgcagaaattagcagttttagttagaaatttgcaattaggaaaagacttagagattacctattcaaatgcccttatttttcaaagtgaaaacaggcctagagtgttacttgctcaagctaatataggtagttggcaacagaaccatatctagtctgcactaaaacctactgattttacctccagaatatcttttgaattttttcacttctctgtctccagtgccctcaccctagttgaggctattgtgatctctcccgtggtatctactgtactacgtctcactggtctcccgacaaccttatttagaaagcatatttgatcatactattctctctgcttaaaatccttcaaaaatgtctcattggtctcaggaagaaggctagtcctttattctaccctttgtatatttgtgagattatttgattaaagtttttttcctcagatagactgtagactgtaatgtcaaagggcagaatttatgtttattttgcttatcgctgtatccctacccctgccacattgcctggtacataggagggacttggtacttgttgaatgaatgactcctgatttagctctatttctactacaccagtgattttagagtaacattttttatctttgaaatctttgccatatgctttatataattcatctacccatctgttgatgtaatagcatctggaaaaaaagaatttcaagttagttattctcagtttataaatcacactcttaaaaaaacacacacctttttttggtacaagcatgaaacagtagtgctaaatattctttctatatttgatggagcatggtcatatatttaatttttatttatctgctctcataagcaggagaaactaagaaatcatagaaactattgtgtagggaatataattaaaatgcaaagaggtagtggtgatagtaaagttagtgcctctcaaactggtgttccacagaatactgtttcaggagatcttgtttttttattttaattttattttttgagacagggtcttagtctgtcactcaggctagagtataacgtgattacagctcactgcagccttcatctcccaggctaaagccatcctcccacctcagcctcccaagtagctgggaccacaggtgcacgctaccacacccagctaatttttaaaaaaatttttttagagactgggtctccctaagttgtccagactggtctccaactcctgggctcaagcagttctcccacctcggcctcccaaagcactgggattacaggcatgagccaccacacctgacctattcctgcagattttaataggtattctacaaccctttcctcatctttctgctgtcatatcccctttacaccaaggactatattcttataaataactttgggaaacacaatgtattagttccacttctcatagaataacagtgtatattagcatagtaaagctccttttgccttaaagcagagtttctcaaccttgatactgttgacattttggaccggataattctgtgtttggagcaggtagtgggaaggattgctgtcctggaaattgtagaatatttagcagcatccttgacccctacccattagactctagtaacactaacatactcgtggttgcccagctgtgacaaccacaagtatctccagatattgccaaatgtccctttgtcccctgaaagacaacccacctaagagtgagaactactaccttaaaaaaaatcagtttgatcgtgctttatactcataattcccagatttatttgaggatagaatatttctcctcctccttcatttgcacacctaatttcctgggaattgctattttaaaattatcatttaataaaacagaaactaattctcctatttaggcttccccctaaaactcatcaatattttccatggcacttagaatagagttcaaacttcataacatgggctttgtgcgtgaaagggcctttacctgcctccctgacctcacctcctatcaccacctggtggcagtaacattgtgagctgctttcagttctttaggcatctcagtttcttttctaacatgctgttccctctgttgggaattattttatccttgttctttcttatcctttaggttcagtcttagattaaatgtcatctcttaaaaagagatcttttctgatcatttcttactctgccagaaaggatagccatccatcccagttcttacactctatctcatcaccctatttgttgtcttcattcactttttatagtctataattctttgtttacttgtgtagatttctttctgtctcagtcactagaatgtaaactgtgtgagggcaggacctacatttatctcattcatcatatccctagcatttaatagagagcctggcatctaataggtacaattattatttgttgaataaatacatattattaatataattcacatataaaattcactcttttaaagtgtataattcaaggctgggcatggtggttcatacctgtaatcccagcattttgggaggctgaggcaggtagatcacctgaggtcaggagttagagaccagcctggccaacatggtgaaacatcatctctagtagaaatacaaaaattgggtgtggtggtgggcacctataatcccagctactcaggaggctgaggcaggagaatcacttgaacccgggaggcagaaaggaaagaaaagagggggagggggagagggagagggagagggaaaaaaaggaagatataattcataggtttctaatatattcacaagtttgtgcagccatcaccactatctaattcaagaacattttcatccctccccgctcctcctacccccagcccctgcctgccaaccaccactctactttctgtctctatggatttgcatattctggacatttcatataaatggattcgtacaacatgtgatcttaactatctggcttctctcttagcataatattttcagagttcatccatgttgtagcatggaacagtacattattcttttctgtggctgaattatattcaattgtatggatatgctacattttgtttatccatttatccattgggttgtttctactttttgatattataaataatgctgctctgaacattcatatatgagtttttctgtgaacatatgtttttacttctcttgggtatgtacctagaagtagaattgttgaatcatatggtaatctatttttaactttttgaggaactaccgaactgttttcccaagtggctacatcatttaacattcctaccagtgatatatgagggttctaatttctgcatattcttaccaacacttgttattgcctttttaaattatagctattctagtgggtatgaaatggtatctcattgtcttttgatttgcatttcactaatgactgatgtgttgaaatattttcatgtacttattggtcatttgtgtgtcttctttggagaaatgtctattcagattctttgtccatttttaaaaatttggttatatgtcttattgttgagttagaggagtctttttgacatattttctaaaagagatgcaagagttccatcctggctaacatggtgaaaccccatctctactaaaaatacaaaaaattagccaggcttggtggtgggcacctgtagtcccaactactggggaggctgaggcaggagaatggcgtgaacctgggaggcggagcttgcagtgagcagagatcgtgccactgcactccaacctgggcaacagagcaagactctgtctcaaaaaaaaaaaaaaagagatgcaagagttgaaagtccttttgtattctggatactaaacccttgtcagatagtcctgatatgggtttgcaaatgttttctcccattgtgtttgtctttttacttttttgatagtgcccttttaagcagaaaagtttttaattttgataaagttcaatctatcaatttttttatttgttgcttatgtgtttggtgtcatatctaagaaaccattgccccatctgaggtcaggaagatttatacttgtgttttcttctaagagctcatgtagttttagctcttacatttaggtctttgatcacttttgacttaatttttgtatccgtgtgggagtctaacttcattcttttgcatgtgactatccaattgttggagtgttgttttttttttactttaataaagtatcatatttttcacaaaatatgaacattgtttcaacatttacaattttaaaaatagtgtgtggagcacatactgtgtaccagacattatgttgggtatgtcgtctatacagatttaaaaaaagacataatccccatcctccatgtctcacagatctggaaattaagaaaattgagaatagtaatgaaaatttgaatggaacattaaagatatttgatggtgttgatagtggttttaaataaatggtttttgagaagattggccttttatgtatttaacccaaagattgcatgaaaaagcttgatgacattattagtataaaaataaaaatattcctgaatgttgctgtaaaaagcacttgatggtggctgctatgcaataggagtattttaccttgattggtactctttttttttttttaaacacccctggttttattttcccttcactccaattttctcacttgtttgcttttttttaaaattttattattattatactttaacttttagggtacatgtgtacaacgtgcagacttgttacatatgtatacatgtgccatgttggtgtgctgcacccattaactcgtcatttagcattaggtatatctcctaagaatcattttctttttgagacagtctctgatgcccaggctggagtgcggtggcacgaactcggctcactgcaaactctgcctcctaggttcaagcgaagaatcattttctattaacagtaatttgcggggtggatgagaaagcaattgtctgtcatccacaaatgcaaggtggagataagacaattatagagatgacaaagaaatcagtctctctttctctctctctcagtgtaactgtgtgtctctattttagtataactcactgatttaatatttatttaactcagagcaaaggaatctctaagacagtgttctcaaagtcattctttacctgttttttattttttttctctcgtttgacttccttttttctgttactgctaatcttacaattgttgatatatctttctaagatttgtacttatttatgcttgctctctctgaactaggcttagtcttttgtgactaattattgaattcaggacatatttagcccattgtattagtctactcagactgccatagcagaatactacagactgggtgctttaaacaacagaaatttgttttctcgtatttctggaggcttgaaagtccatgatcaagattcaggcagaattcgtttctagtaaggcctcttttcttctttgcaagcatttccccaaacatggcctatcctctgtgtgtgattggagtgagggaggcagagagagaaagagacagagagagagaaagagagagaacatacgtgtgtgttgggcgggggcagtgggggaatctctggtgtctctttttttataggaacattagttttgtgggattaaggctccattagccttaagtcctcatttaaccttagttgcctctttaaaggccctgtctccaaatacaagtcacattgtggggttagggctcccacatatgattttgggtacacagttcacttcataatacccatgtagcacgtagtagtcacttttatacagttaatatgtttatattccttatttgataataaaatacagtgatttttctataaaacttatattgatattggggtggggaaaactcatgtcacctaggctctttgtacctcagttttctcatctataaaataacaatattgggctcgttgatttttgaatgctgaaattctctgattctccaattcagagttactgatttctaacattattcagcaggtacattataggaaacatcttataatagaaattgatgttctgtaaatgagcattctataagcttctcataactgaagtgaaaggcttaatcattctatatactggtatagataatctatttcctgtggtcccagctactagggaggctaaggtgggaggatcgattgagcctgggaggttgaggctgtagtgagccatgaatgtgccactgcacttcagcctaggtgacacagctaggtgctgtctcaacaaacaaacaaacaaaaactctattcaactagctatgctgggctgtttagtttttattatgtataatttaaaggtctggatatggtatgtttctttttttcttccagttaataatatcctttatttatacagtataatttatcctttatgaataccttttcattttgatgggttcaaacaatttaataagtgaagatagcaaaatgtgagaatccttctcatacctactcccctttcaaaggaggtaaccacaacagattgttatgcatccttgcaatctttctatgaatgtacatatgaatattaacttatgtacatattttccattaatgggatcatgctatatatattctgttatttattttttcctcaacaatgtttcttgattttttatacacaccaggatgtatgtatattattttttaaatgcttaatgttacataatatcataatgtacttaaccactccccttttggacatcagtttgtttctttttcactattaaaaataatggtaaggctgggcgtggtggctcaaacctgtaatcccagcactttgggaggccgaggcaggtggatcacctgaggtcaggagtttgagaccagcctgaccaacatggcgaaaccccatctctactaaaactgcaaaaattagcggggcatgatggcaggcacttgtaattccagctacttgggaacctgagacgggagaatctcttgaacccggaaggtgtaggttgcagtgagccgagatcatgctgttgcattccagcctgggtgacagagcaagactctgtcttaaaaaaaaacaaatggtgaatgaatatccttggaaatacagccatttgtatagagattcctttagaatacatttcctacatgtgggattaaacactgaaaattttaatagctattgccaaattgtcttcctaaaatttacatttccatcaacaaggaatgagtgtgttcatttatcattaccattgccacatgataccactgttttaaaactctttctaacctgatggttgaaaagctatatttccttttttaaaaaagttgcatttatatgacatctggcatcctttcatttgttcattggccatttatatttctttttctatgaaatgctgtaatttacctacttatggaatcaaatatctttttaatattgacttgtaataatttttaaaaatatattttgcatgttaatcatttattttaaatgttgtagatatatatttatgctgcttctcttttaactttgcttgtggtgttttatggaatggaaattttttattttctgaaagtgtcaatcatttcctttatggcttctgtgttttgtgtaatattaagaaggccttccccatgtggaattattgaaatgttctattttttatagtattttatatcatctctttaactccattttgagtttcttctaaattgatggctggttcacccagccctattgatgtataattcattcttttctcactgagatttgaagcctcctttattgtaatctaaatttgtatacattatgcagatttacttctagactctgtattctgttctttttgctgtgtttttctcatttatttactaaaagtatacttttaattacagtagtttaccaagtcttttgaaatctgagaaaacaaaaacattgtccttcatttagcttattttgcacacaattcttgctgttttatttatattttttcgcctgttagtttttttcgtgtgtgtgtgtttgtgtgtgtgtgtgtgtgtgtgtgtgtgtgtgtgtgtgtgttactataaccttactctaccttcttctgattaatggctattttatgtctgaactagaaaactaaacaaactgccagtattttagataaaacaatctctctctctcttttttgtttccttttgagatggagtcttgctctgtcacccaggctggagtccagtggtgggatctcagctcactgcaacctccacctcctcccaggttcaagcaattctcctgcctcagcctcccgagtagctaggattacaggcacgagccaccatgcccaactaatttttgtatttttagcagagacaggacagggtttcaccatgttggtcaggctggtctcgaactcctgacctcaggtgatccctctgccttggtctcccaaaatgctgggattacaggcatgagccaccacacccagccagataaaacaatctttaaagcaaagaaataaattcttaggagactgattcatgggtagaatattcatgctttaacacatgaagtttatgtatattttagtttctcagaggcctggattttttgtttctgaattcttggtgatactataaatagttgatgttgaatatacaacctatgtgaacgttaatatatattaaaaattattttagaagagaagctatgtttgaatcattttgctgaacaattgtatttctattgctttatgttaataaaacttgtctgttaagaggaaaacacagtaaatacgaccaagcccatgttttgcttttgggttttctttcctaacaatagagaataaaataaaaataattagataattaagtagaataagctgttactcttattttatatcagctatagctagatgttagttattataagagctgcatctgttaccatagagcttccttaacgcaaactcagcttttaaaaaaaaaaaaagcaagggaaaaagaaaaagagaaagctgtgacctgcttcatgctttgaaaaaaataattcccggtgaccttgggcagctatagcccttattgtacctagattgcggagtttaaagtggccatcctgttttactctagaatcaatacaacatcctgcattatctgatcaggtctaaagcacatgaaatagagaagcaggtatgtgtaaataaaagttttgtgcagtcttattcaaataaaataaatagattcagcatgctttttagaaccttaagcttttgtttttctttaaaatatctctggtactacaaattataccatgcaataatatgaatttatgtatgtgtgtatgtgtctcacatactacttttggaccattttccttattcctagacagttggattattttaagagtttctgggtctgcactgagttttgggggacccggggctcagaaaggaatctatactttttctacacttttcaatcttagagtaccttagagatccaggaataggatagttctgtattattaattttattagcgtctagagagtctaaatagatctcacttggccgagaaacatacccttttaggcttggggttcctgaagttacatatatctctacatatgggattcagtaggttgataggctatgtgacagaactgagaaagtggatccagcctgcagaaacatgtattgattggcccacacagtgtttttaaaatatctggatttatagcttctcctgaaaaatggaaagatttgacaaactgggcccacatcaccacatggcagcaactagacagacatatgctttccagcttgtcagaatcccaaccactccttctcctgaaggtgtcactttgtcatttctcaccacatttgcacaatcatctacttgcccaacacatttatgttaccttcccagctcctgaaggtttggaacttgtaatttacactcttcagtgcagacttctttctctgtatgtggtacagttaaagtaaaaataaatagccatttaacatagaacaaaatcaactcgtttttcccagaaacacattatacattcatgtcttcatacctttgctttgcattttttccttccctaagatatttattctcttgctgaatgaattctactcagctcagctcctagtaccttgaattttacttgatcaattctgtctacagttttttttctcttctaaagtcttagaacacttgttttctccaacattgtaaatttattatagtagagctttaggaaagtctcattcacttaaagaaggtttgtgtgtggtcttacaaagaggttttttttgttttttttttgttttttttgtttttgtttttttgaaacggggtcttgctctgtcacccaggctggagtgcagtggtgcaatcttggctcactgcaacctccacctacctcagcctccagagtaggtgggattacaggcacccaccaccacacccagctaatttttatatttttagtagagacgtgatttcaccatttggccagtctggtcttgaactcctgacttcaagtgatctgcccgcctcggcctcccgaagtactgggattacaggcatgagccatcgcactcggcctgaaaaggtctttgagtagtcttttcttaatatggttcacagttcactttttcagagaaatacatataaagttgtcattttaaaaactcaaaaagtaatcttagtttttgtttccttagttttctcaattggcctttggacattaaatttaaatattgttttcctgtctttcagttacagatgaggacacagtaaagaggtattttgccaagtttgaagagaagtttttccaaacctgtgaaaaagaacttgccaaaatcaacacattttattcaggtgagtaattaagagacttttttttttgctgccggggaaggataaattgtaccatatcattgtttaaacttctgatcaatgtttttaaattgagtcttgttttccttactatactgcacttaagaggtattttcttgagctgggataagaacacgtctggtttctcaatgtttaagctttctgtggtcattgcctagaaactcttgcagtcaaaaggatattgggacttcgttgagaggcaatacctcggtagagcttcactgtggcccagttcaaagcttgaagagtcagaaacttgattttatcattttggccagagatgaattacacagttccagcttatcagtgatggcagttttataccttttcattgcctagaacacttatacttatttctctaaagcactggcctccagagtggcatctacagtatgccactcgaatgtgagaataaaatattggaacttatatatatatttatgtctgactcttttgaactttattttttgtacatgtatgttgcaatgtacataatatacattagtaaaacaatgtctttatagtgaaaaattttggaaactttagagcactaccgtagacatcaggagtcctgtgagacctagttaataatcagatagtttcatgagtacagaatctgaacaaagtgagttagattcagaaggatatttcatctagactctggaaacgttacacatagttcctgttacaccgccagatatacagcctaatagctggaatacctatcctattgaatgtaatgtatctattccctgagcagtaattgatgaaaaaaaaagtagtctgtaattttatttaatatccaaaatataaaattactctattttttattttcatatttaatatgcacattacatgcctgctattgagaatatattctcatctcttggcaaagactttggaaataccataatcttataactagcacaatcataaaccaggtattagtgtgaattagtctaaagatgaatagtttcatgactttactaatttgtttttcggatgatttttttcctggcttgtccacaacttctggaagcatcttactcagatatcctttttcagcatcttactcagatatcctttttcagcagccccttcaactagaggctgatcattctcttttatagagtattgggagacaggagatggaaaaaggtaaaaagagtcagtgagaaacagctgccagaagacaagagactgagtccagcattctcttagctatcattgttcttccaaatcagtatttctgtgtatttctataaaaatgaatcttcttctaagcatcagtattgttctatttctgccactcctatttgttagcatctactgacctcttggttgctcactgtgaacttagactcctggctcccagtctgaataaatctctatcttaatttttcatatcatgctggatgacttcattgtccttgtggacagtcattttcagttacactgtactttagccccatacacacatagccatacccatcacccagaattcctctcctctaaaatactaaaacctaatacgagtctatgaccatgtctcctagccttttagctttttactcccctactcctttaacatctgtttttccatctcacagagctctagtttcttgactctcccattttatttcagtttatcatacatgtcttagaattatttcctactctttttttgtcttcttttttcctttttttttggagaatggggtcttgctatgttgcccaggcaggtcttgaattcctgggctcaagctgtcttcttgcctctgtcttcctaagtgctagcattatagacatggccaccacacccagccagaattattttcttctccatcaatcattttaaccattttgacccctgtgtttttaatccctttaccctcattgccttatgttgcatctgcctagtaaaactcaaccaattcatcctttaccttcttcatgcctaccccagaggctgcgtaggacaacagcagaataaattggaaccactgtaaatttgttgttgcacctgtaactgtgccctcaaagcttcctgtgggtcctaatcaatatcatttttcatgctccaaagtgcttttgtaaaccttatatcattctccagaattctctaaccccaccatcttccccgtcatgctcattatacccccagctttacaaataaaaataaaggccatcagcttctgttgatgtataataccatgcagatatatggtattatatctgcatctctctcccaaatgcctatagacattctcatccttatttattttcctccaatctttgtagaagagatatccctctttattccacgggagatctttacgactactgactaaatttcaactcttcaagaccttgctccagtaattatttcctctaagaattattaaataaatatatttaacttccctttataccaattcaatctccttagcaagtcattcccttcaaaaaaaaaatgagcaagcaaatttcttaactttatatcctccccctcatctttcatttgtagctgggctttttccttaggcagagggaacagtttatatacaagcaagagccatgaaagaacatggcatatatgcatgtctctttcaccaggatacaggcacctagaagacagagacaaaatatacattttcttttttttgagacggagtctcactctgtcgcccaggctggagtgcagtggtgcgatcttggctcactgcaaactctgcctcccgggttcacgtcattctcctgcctcagcctcccgagtagctgggactacaggcacccaccaccatgcccagctaattttttttatatttttagtagagacggggtttcaccgtgttaaccagggtggtcttgatctcctgacctcgtgatccgcctgcctcagcctcccaaagtgctgggattgcaggtgtgagccactgtgcacagccaaaatataaatattatttaaagccatgcaaacaggtagattttctgtatgggaaaaatatacagaaaggatttcagtgttctcaagaagaaagataatttctataattaggagatagaaagataaagaggaaccagcaatgtagacagagaagaccatatagcaggaggaggaggaggaaactaaaagaggagggcatttgcagtgaaacaaatgtctagattgagaaagcgtattggaaatgatgtaaggctgtagactatgaatatataaaatcaagtttattagcttttttcttttactatgacattttttgaaaaagaaggatctctaagctcaattctaaatggatgatttgtatcacaaagaatagaaaatgcttctttgtttatgaagaaaaatatctactcttggtagtagatactttgttttttttgtttgtttgtttttgagacaggatctcactctgttgtccaggctggagtgcagtgtcatgatctcggctcactgcaacctctgcctcccaggttcaagtgatcctcctgcctcagcctccagcatagctggtactacaggcatgcaccaccacacctggctaattttttatttttatttttggtagagatggggtttcaccatgttggccagggtggtctcgaactcctgacctcaggtgattcacccaccttggtctcccaaagtgcttggattacagacatgtagatactttattttgagttatagtaaaaaaaaatgtacattatgacccagcacacatatacagataaatgtttgttttatatatgtttgtatgcatctatatgtgtgtgactacacaatatatttaaataatttaagatattttttcatgaaacagtacatctttagtacttgtagtatattgttttctatatttttctattctatttgattttttaaatgctaattatgatccactaaattggttttatgacctcatattgggttgcaaccttcagtttgaaacatgatttctttaagttaggtcgcttctcaaaaataattttaggctagctactattaaaaattttggtgctgtaatttgatgacttcctgttttgtgtgtgtattggcagggccagtgaggcacgtctcttgatgtcctcactggtacaaattggtagtctctagagtgactcctgccagatcaggaagtggtaggtaatacgaagaaatgattcacagaaatagaatttgtttctggtcctcaacagtatcttttttccctcatttagccaccttctccccagaagattgtagactgcagttgtcagacactagggcacaagaaaaactataaacaatatggggtgagttgagcttaataactcacctccacccacttatatctcacacattaaatagctaaaaatgctccatttttaagtgagatatttttgactaaaacctttcaatgtccctaaacaaattgctatattttattttgtctgtttctagtcatatcaaaaaggccaaacaatcaaaatatagcatgaatgctgctaaaatttggaatttttttcttgccgatgctatttactgtttaaccttcctaggcttccacacacttgcttataaaacaaacagattgattcccaaccctctagggttccacatgttaggatcagaagctattttcaatattcagaaaacctgatgtaagttactttgttagtctttattgtttattatgtatctttggttaaaaaattgacatttatttagatttatagataaaatcagtatttgaagatcataggaagagaagggaattgtgaaagggaggggtcctttgtggtaaaaacattgctaatccctaacctagaagtctcttagttctcttctgtcactaaaaatggtatcaatcatgaaggctataccgttagaaacctttttttttgtggtgatcagtaatgtctttttccagtggacaagtgatccaactgatcacttttttcaaaccagtttgccttttctctttattcaaaatacttagtttctaaacagtgtttatttgcctaatgttaaaaaaaaagtcagaatatatgtgttgcttctaatatttcacaaaacagtcaagccttttttattggctggaattttgaaatagctaagtgctttttctttgtttttgaataacttcttttttttctggatgacttttttgacttcggttacattgggaagtcatagcagtgttacatcctttttctttactaaaaaggaaggaaaggagggagagagggaagaaggaaggtaattgcattggtgttttattagtaggatcttgcctgtagaatattttcttgtttcatataaatgcaagaccgattagataatagttactaagagctattcttattatatagttattcctgttattcctgtaatcctgttttacaatgtcttgctgtatgtttttattattgatttatattgtttttatacaagaggaatttgaggcactgaatattgttataccactaaatgtgtgcaatgaatcatgagaatcttttacactgaaatagtaaatgttcattttacaaatgatacatgtgtctagtatgcatgtatttaaactatgacttaatggctggttttgttctttgctcatgtgtgtgttaaaatgtagattaagtaggtatttttaatgagagtggtcataggttggtatattgttttaaattcccatgtgttaacgtatcttcctgtgtcatgattctcttgagttcattacagtagaatcagttacttaagaactgtttaaaggagcagggagggtagtaggggaagtgaaattaaagcagccactcttgcttgctttgttgttaatacatctgaaggaaattacaattacaatatttatattgtccacaataaattttcctttctttattttgttaaaaaaaagtgttttataagcatctattaaaaacaagccacgtgaaaaccaccctcattttctttctctcctttttttctctttccttccttccttctgtctctctcctatttttccttttttctttctgagactgaaagaaaggatgaggaatgtctatggtcatgagtaacacaatttccaaatggcatcttcacaaacaaacacaatatcatgtaaataatgggttttttttaaattgtaggtcacaacccaataaattggtcagaaaatgaaaatatagttacgtgtcacttaatgacagggataattctgagaaatgcgtcatgaggtgatttcattttgggaacatcatgtgtacttacacaaacctagatggtatatcctattacacatgtagcatatatagtatagcctgttgctcctaggctacaaaactgtccagcatgttactacagagaatactgtaggcaattgtaaaacaatggtaaatatttatgtatctaaatatagaaaaggtacagtaaaaataaagtattatatcttatgggactactgttgtacatgctgtcagtcgttgaccagaacgttgttctgtggcactacgactgtacgtgggtcatcacaggcattttttaaaaaatatagatagaatatagtagaatagaaagtatcacagtgttatttactaaatacatctgttgtgtgtatttacaaattacatgtactttttaaagtttatgtgcaatatgacatttagtattttacagttatgcaaagtactgtgaaaactgacatgaagaagccttgaatttacttggaggaagaaagtgggattgaggaaaagcctttagaagaagtgaaatttaaattgggtctttgaaaatgtgtaggcattagccaaatgctcttaagggaggttgtttggggatggctgtagggagaggtgggatttagtgctccagagcaagggaaaaaatctatccagatgcacagtggtgttaaagtacatgacatatttggggatgaagacaataacaaatagtcttttgaggctgaagttgtaagatattaaggagtgagttgctggttagagagaaaagtggaaaaattagatgttttattcacatacagatttcagactttggtatttgaggtacacagtttcaagtagtaagaattccagataaaagataaaagcagtataaaaaatgcatgtaatgtaacaaagttaactatcttgaatcatctgtgatgggtcaacattctcataaacttactttatattttgaataacaccaaggtccataaattgaattagcaagatggtaatattgtaagacaggtaaacaaataataaaaatattctaagacactaatttgattttagaaagagttattcttcaattgcataacaacataacagctttgccattctgaagatagcttgtagttcttgaaataactttttctaaaagtaaaagaacgatgaatttggtgaaagcaaaatatattgctaacccttattctagctctttgagggatacataggtgctttgaaaattcttgaatggttattggaaatttttatcaaatatttagtatgagagcttatggcgttaacatattattaaaataataatatttgttctcatattcaggtcacttgatttactggcataagtagaaattgtagtttattggcaaaatagtctgttttcatcaatattataaaattgcttagaaatactgtgtgtaatattttttcagatagcttctaagttgttaggacataaatacttaagttgtttgaacctgactacttaataaatagaaacattaggtatttcttttgtcctagaagcatcatgaaagtattactgagacacaaagtatgccgtgaaccaagaaagaacttagaagttctacactgtttttggtcttgaggataagacagacacatttgcaatagaaatgtttaacatatgtaaaaagagccctgagattcattcattcactcattcacttatttatttatttattttgagacggagtcttgctttgtcacccaggctggaatgtggtggtgcgatctcagctcactgcaacctctgcctcccaggttcaagcaattttctgcctcagcctcctgagtagctgagattacaggtgcccaccagcacacctggctaatttttttgtatttttagtagagacgaggtttcaccatcttgactaggctggtcttaaacctcctgacctcgtgatccactcacctcggcctccaaaagtgctgggattacaggcgtgagcgactgcgcctggcctcatttttatttttgtaagtgtatttgtagattttcatcatagatcaaagtatacacttttatatatacacacacacacacttttccaggttctgtgcagtcccatgtgtttgagctttctggcgatctggctctagaaaactgaagtgtcattgcaaaatagattgggatacttggtgtcaaaagcagtatttcttattctttttaaacctatacccctttgatagatatgaaaatctcataccatagctgtagtaatattgaatatgattttttcaaactacatatggtttatattcccctacccccacctacggattctcataggctcctctacatagttatgcccttaaggaagagagtcattactttaaagaaagtagcaaaatacacctgaaatgttgatttcttcatcatttctatatgggaatgtaggctactagagagaacttttacctatttattcattcagcaaacatggattgagtatactgtatgcaagctctttatggtacaaagataatgatgataggccacgcaaaaacttgtatgagagtgttaacagcagcattatttacatagtttaaaaaactagaaacaattcaaatgtctgcagactgaagatatttaaacaaaatataatcgcttctcggccttttggctaagatcaagtgtaaacaaaatatatatccacacaatgaaatactatttggcaataaaaggaactcagtataacagacttacattatgatacaaaatggatgaaactcaaaatcatcctgctaagttaaagaacccaaacacaaaagattatatattgtatgattcttttacatgaaatgttcagaaaaggcaaatcagcagagacagaatacagatcagtgtttgcctggggtagggggtggaagtggggattgacagctaatggccatgatggaagtataggaggtgacagaaatgttctaaaattggatttttatgatgattgcacaactctataaatttactgaaagtcaatgaattgcatgtttacagtagatgaatcctatggtaggtaagttatacctcaaacaaattatttaaaataaattttcattataaaaaaagataaagattttagaactgttacctttagagttcagtcagtcagtgaagcaaacataaacaaagaattatatgcagtgtgctttggctgcatgtatgtggtcccatacaagccctaaggtgggagtttcatttgtgactgagagagttgttaaatatgaaaaactttatatagaaagcagtgtttgagattagccttgcaaaacgagtaaggagttttccagatggagaggcatttgtgtcttgacttattgttggcacacaggaagtaacaggtcctctttcttttcatttttgggcttcttacatttttaatatgcatgtaatgagaagagtaaatgtattgacagttctgactgaggacattaaacaattagcaaatttatatactaatcttttaacaattaaagttaagcaattttattacatatgatattctgttttctggctagtttacctgcagtttttagtcagcagaataatttatagtggcccttagataaatccttgtattatttcattttatgtttgtgtgcatattgtatgtagtattttttcaggtagcttctaagtcattaggacataaatacttaagttgtttgaacctgattacttaataaatagaagcattagttatttcttttggcctagaagcatcatgaaaatattactgaaacgctaagggcatcatgaaccaagaaagaaccaagaagttctatactgttttgatcctaaggatgataagacaaacacatttacaatagaaatgtttaacatgtgtaaaaggagccctgagattcattttctgttgacttaaataagagattttaaaatatatgaattgttctgttttttacaatatggaagactggaaagaaatcctaataatctcttacttcaaaacactaaagtgatacataaaaaatacaaaattatcaggaaaataataaaaatatatatctaatatgattaaaaatgtaaaggagagcatgaaaaccataaacaaagaagaaatcattaaaattgactaggcattttttttaaaggaccaattagatcttttacaaatgaaaatataatcacggaagttagtatcttaatagatcaatcaaactgtagatttaggtagacttaaagggacaatttataaactggaagatagagctgaaaatttactcagaatgcaacacaaatcgataaagagaagaaaatatgagagttgtaagagacaaagtaaaaaggtcaaggggttataattggtatctttattttcccaagacccgttccatatttcctttgccctcagccagaaccccaactggttattaggtgagatgacctagactttaattcctagaggatctgaatctcagtagttcttttattaattgctgtagggtttttttgtttttgtttttgagacacagtctcactctgtcacccaggctggagtgtgtggtggcacaatctcggctcactgcaacctccacctcctgagttcaagtgaatctcatgcctcagccttctgagcacctggaatcacaggcgtgcagcaccacaccctgctaatttttgtaatcttggtagagatctgattttaccatgttggtcaggctgttctccaactactggcctcaagtgatccacctgcctcagcctcccagagtgttgggattacaggtgtgagccaccatgcccggcctgttgtagttttccattaacatatattattggtcatggaagtaatgggaggtgttccagaatctcctgggttccagagcttgttgctcctattatgtttcagcagttcacttttcccttggtaatcaggatcagtcaaggggtttacttttagccagtaaaccccttctttgccattgtttcattagtacaaagaacccaaaatggccaggtgacagtttcatcttccaattcagtagaaccattgttgtattcctctgatggaagcattttccccttgagaactaaccaacagtcagagtttaagttgtagattgggaagcaaaaattatgtgagtggattattacttacagtattgagaggaaccactcctacttctaccccttgattcctagactggatattttggttatgttggggacttatggcctcattattgtatcctgtaaaacagaaccccatcctttcagagtcttgtctcccaacttttctgttaggccattgatcagcttttctattaggccatctatttctgggtatatagtaaaagaccattttcttccatggctatgagcccattgctttactgtctttgctgtgaaatgagttccttgatcagaagcaaggctgtatagaataccatgatagtggataaagcatttcaggagatggtggtgctggagaagcattatgggtggagaaggtacatccatatcaagaatgcttttattccagggaggacaaatctctgcccactgcctaatagaaggcatccaacacaatcaacctgccagtaggtagctggccagtcccaggggtgactctggggttcagtgctagtctctgctgcctggtgagtagctgcattatcagatgtgtagctgcatgccaggggctagaggttgtattgattttcctcagtgaaaataccatatccggaatagcagctgctatcacagagaccacctagtttacacaatccagttattcaccaagattcatccaacttgcgtaaacaaatgagttaagagaggatgtggtaggtatcctatccctttgtctttaaagtctgtgattgttgtactaatttctgcagttctatcttgataaggaaaagttccaggaactgttatagccctttcttcatcatgttccttccttcatcatatttcttacctgtggttcagaatcactagagagtctaccagtggcctagtaggtctattccaattatacatcttggaactgaaaaaggaatcataggatgaatctgtggaccaactgggtcttttgtgagtctcatctgggctgatatttcatctgtcacctgaatatcataaatgtatagtttgattgctaaaccacagtggtgcctggagtctccagaagtttgtcactcctagggaaaaagattcaaagtatgagagggacttgaaatgagcaagtttctccattgctgactttgaagatagggttaagagtagtctcgaagagctaaaagcagaccacagatgagagccagcaaggaaacagtcttaaaactacaaaaaactgaattctgccacaaccaagtgagcttgaatgtgagcttgagaaagcagcctagctaacaccttgcgtttagccttaggagagcctgacagagaacctagccacatcatgcttggacttctaacctacaaaacggtgagctaataaatggggtttctttaaggcactatgtgtgtggtaatttgttatacaacaatgcaaagctaatatacaaaagccaatgacgagtaatctttgcaaagtctggatatttccttttcctcagtgcacagtcactctagtaaatagacacgaggccctttgaggaaggattagaggaagatctacagtatatacttgtggcagtgctacaggaaccacccgaaagcaaggccagcttccacttcagtcaggggtcttgggtttttgaactagcgttgatctggaagctggtaagaggtagtgactctctgttgtagtgactaatatcaagtatttggccaccagacctggagtttttttctgttacatcaattaagcaatattctagtaggttgcccatttctgtctttcctagggataaccatgatcaattaaccacagccaaaatctctgtgtgcaaaaacatctgtcctgttgccttttatggtaaatgcacccaccttgttttgatagttaagtgctgccatctggcctttctgttccaaggatcattgaatgtgcattgcaatcagggaacccatctcaatagatacatctctcatggccattcctggccttcactggggagtaaacatagagctttttaaggatgcaggtgctctcctcactaacgtaattctggatgccttaatgaagggagtattttctgggccccctcagggggatgtgattggtgttggagaggcgtaagagtggtccctaggagctaaaagcaggtcccagatgggttgacccacataaatggatgaaatttatttggaaagaggaatggaaacatgatttttgttttgaatacagtcttagatcataggaaatacaagaagatataaatagattataaaagttaagaaaatgaaggtcatgtaaaggattaagaatagagatgaatcttggaaacatcctatagaaggaaattctctaggagaaagagagagtgaatcattaagcagtgccagacaggacaaaaatactaaagattgattgaagacaacagcaagacagtatagcagtagataaagcaaggaataggagaattatgagaaagcataagttgtaaataattctttgttattattatataatttttatcattatttattgagtgctatgtcccttggcatttttttttttttgagacagtgtctcactctgtcacccaggctggagtgcagtggcacaatctcggctcactgcagcctctgctcactgcaacctctgcctcccgaattcaagcaattctcttgcctcagcctcccaagtagctgggattacaggaatgcaccaccacgcccggctaattttgtatttttagtagagacagggtttcaccatgttggccaggctggtctcgaaatcctgacctcaggtgatccacctgcctcagcctcccaaagtgctgggattacaagcatgagccattgcacccagccggtcccttggcatttctatgcctcatttaatctttacaaccactttatgagggagttggtatttccatttcatctatgaaaggtgtagaagagttattaaaaaaaaaaaacttgactaaaatcatacagctagttaatgaggcaaggatttgaacccaaatctgcctggttccagtgaactgaattgtgaccttggaagaaaaatacagagtattatttttaaatgtatgtgtagcacaaacacatatattcagatatacctagtatttttaacacataatttgcaagtcttaatctcttgtaatacctggtttagagaagtaatgaagggtagtgggaaatacaggagattacagatctaaagcccaaattctaatcctgtttctgacctgaactgtataaccagaaacatttcttaatggcgtttttaaattgagatatttctataccataaaatttgccttcttaaggtttgtaattccatggtttttagtgtattcacaaggttgtacaaccatcactaccaattctggaacattttcatcatcctaaagacatatctcgtacccattagcaatcactccccattcaccttccactcagcccatggcaagcagtaatctactttctttctgtgtggatttcctgattctggacatgtcatataaatggaaacatacaatattgggtattttgtgtctggtttctttcacttaatgtcttcaaggttcatccatgtcagagcatgaattagcacttcattcttttttagtggctgattctattgtgtgtttatatagacacacatgcatgcacaccacattttgtttatttgttcctcaattgatggacatttggattgtttccactttctggctattataaatgcaagttagtatatgtatgcaagttttcctgtgagcatatgttttcagctctcttaagtatatgcctaggaatggaattgctgaatcatatgtttaacctttcgagaactgccagctattttccaaataccagagaggctgtaccattttgcgttttcactcttagtggctctttacattttatttattcatttgtaaaaagaaagggtacatgaggttttatggggggtaaaatgaaaggagagtgttacacaaaaatattttttcctatagagttctaaatattacatgtaacggttttcttctagaaattctaagggagcaaatgggaattattaaaaattcagaagtcagtaggaacttttttatcttactgatttgacagttccgttctatttcttatagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcaggtacttagattcttaccctagaaaatggcacctttaagtaaatgagaaatttcaataaatggaagtaccctaaagtattaccagtgggtcagttccaaaaaggaaaatccttaacatgttgttattcttggggttcctactggctaaaaaccatgtgtcagaggcagtaaaactgtgttaacaagacttctgtttttgaagattcatattccaaaaactttcctataatatttaatatttagggatagtccacaactcaaggactaacagtttgcttcctgtttttagaggcagctctgatagtcatgaatagaaataatacatctctccagccactgttggctatgtaagggcttttcttttttttcctttcttttttttttttcttttttgaaacagagtctcactgtgtcacccaggctggagtaaaatgacacgatctcggctcactgcaacctccgcctcctgggttcaagcaattctcctacctcggcctcctgagtagctgggattacaggcgcacgccaccatccccagctaatttttgtatttttagtagagatggggttttaccatgttggccaggctggtcttcagctcagtgagctgcctgcctcagcctcccgagtgctgggattacaggcgtgagccaatgctcccagcctgtaagggcttttatagtcctcctaaccaatagcaaaatttctacaaaagctatcagatagttaatttttctgcagctgacactaataaaacaaagaccctgacttttcaacttgcagctgaaagaatctttccaattttactgtccatgggctgcaataaaatcatattttttaaaagttattgagaaaagcatctatctaatctttagagagaccttatgcactattttttttctattttattcttgtgattattacttataatgagtggttaggatcatcataggatgatataccatattaaaactaaagattatgtaacaaaagtattacctggaatattagaattttaaaataaaaagtagttaaagtcccatatctgcagtaatcttaaattgttaatgcatgtgtttatcattttcttctataattctactttgttctttagtgatttaatattctatcatttgaagacaaacctagtaagaaaacaatttagtagaaaaataattacatatatttatatagtgataaattcctttgctttgagatttgttcatcgctttataatttaaaaaacaaaaataaaatgtatttcctctttcctataatggtatagcaacattaccattttatagttcataaattatgtttgtgtgttacatggaaaaatctttgttaaattttattgtattaactttcctagcagcttttgttcggagtcattataaaatgctccttgggaaaacaaaagtaataattaattatgaaagttctgctttatcttctattctttgggggtcatctattctgtaagaatacatttattttgagaatgaaggagaaaggaagattgattaaaagctatctctaagtcatgatgtatgtatgcaccccacacagactttaagatcatacattaaagcatgagggaaaaatatgtaaacaaataagtaaggaaagcctgttctggagtgagtgcacaatttcttactgttggggacatgtaatcagcaaatttgggagacctctggtttaaagatgtaaccttgcaaattgagtttttagcttttttgcatgctgggcaaagaacaacaatttgagatgttgaaatgtatagtattttgttattgtagaaattgaggaaaaatagggacttctacccattataaactgaaccctgtaagtatgatcacttcctcctttctacttactcttcttagcactcccatacccaaactgagaatgagtgaaaggaaaatgaaagttaagagcactagatgatcttccattttccttactggaacatgcatgattgcatggcagggggagatacatactcctgtaccagtccttccaaaaataaagaactaaataaatgtgttcagtgcatgggcaaatgcaaaacattttctgaaaataattcttttgaccaaagcagcaaaataatagaaattagctattttgaaaataattatacatagaaaacaggaaacaaaaacattttgagcttaggactttcattaatttacttgaaagagaaataatagggttcatagttcagggtttctttgtgttactaatagcatactaccttgaaatgaataaaaggaataaaaaagaagagtcatccttttagtagtagatgcttttatgaaagctttgccatttcctagagtacttaatctttgtccagccagctctgtcagtgcttagtgcttattctttttcatcatttttgatggtagtagaaattatagttgtgtttctcatttctttctgtagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggtacaataatctcgtttatttacaacgtattttcagttacacgttttatatttagggaagcaattccttatttctgttattttgtaactagttgctagctttgaatatatatgccttacctgtgattttttttcattttctttatcagtatatattcaccaaaaagttgtcagaatataatatatataaatggtacagaattatttgtgcatcactcaagtttagtataacctaaccaaaatgtaataatttgtctttctaggctgtagtgaccaatgaacttgaagatggtgacagacaaaaggctatgaagcgtttacgtgtcccccctttgggagctgctcaggttagtatttggttccagtagtttgtttggtttcacctatttaataatcaacacagtatttagctggccccattatcttaaaaaaattttcagccaaagtttataagtagttgctatttttcttattttagttttttaaacattatatgctatattttacttcattctgaattataatgtcttccacctttctcttctcatactgtactttcttgtttattcttactgacatgttaacttactggtatcatcaaatgattaagatgtgatttaaaaaaaatgatctggtgggttcagatatactggattgctatatagcttactccaaaaaagcatttattaaatgatatctacacagtagttataaaaaaagaaaatttattaagtgatatcttctgtgtcataaaacaagtctcaataaatatagaaggatttaagtcatgcaaagtatattttcagacaacagtggaatagaaatcaataacagagcttccatagcctaatgaaaggcatctattaaaaaaaaaataaaacctctacaattattatcatactcaatggtaaacactgcatgctttctccctaagacttggcccaaaaaagggtattcacttttaacacctgtattcaacattgtgctggagattatagccagtgcggtaagggaagaaaaagaaataaaagacattcagggtagaaacgaagaagtaaaaccagtggggttttgccagtgacttgatgatctatgtagaaaatctagtgaatctatagaatagctactataactaacaaatgagtttagcaaggttgccaaatacaagaccaatatgtaaaatcatttgtctagatacttgcaagaacaattggaaatcaaaaaatgttaaagcaatgctgtttataatatcatcaaaatatacaatgcttagtaataattctgacaaaagatgtgtaaggcctttacattgaaaactacaaaacactgctgagcaaaattaaagacttggatgagagagatgctatgttcatgggtatattgcacaaacccagtattttaaagatacgttgtttcttcctgaggtgatttatagatataatacgttccagctcagaaatctcagaagacttctttgtaaaattgataagcagatttaaaaatttatatggaggccaggcacgatggctcatgcctgtaatcccagaaatttgggaggctgaggcaggtggatcacttgaggccaggagttcaagaccagcctggccaacatgatgaaaccccatctcgactaaaatacaaaaattagctgggcttcgtggcacatgcctgtaatcccagctacttgagaggctgaagcacaagaatcacttgaacccaggaggtggaggttgcagtgagccgagatcgcgccactgcactgagtgacagagcaagactctgtctccaaaaaaagaaaagtatatggaaaggcagaggacctagaatagccaaagcaactttggaacataaattgaaggattaacattaccttatgaaagcttattaaagctgcagtaatcaagagagtgtggtaatagtgtcatggtaggcaaatgatcaatggaccagaatagagtgtccaaaaatagactaacatattacgaacaacagatatttgataaagatataaagcagattagtggagaagggtagcattttcaactaaggatgctgaaacagttgaattccatataccaaaaaaaaaaaaaaatgagctttcatccatacttcacaacatacagttctaaatgtaccatagatctaaatgaaaactggaaactacaaatttctagaagaaaatatagaagaaagtcctaatgactttgggttatgcaaagatttcttagaaatgacaccaaaagcacctcatcaaaattaaaaaacgtatgctcttcaaaagacatattaagagaatgaaaagaaaagcaagagactagcagaaaatatttataaaacatatctgttaaaggtcttatatttagaatatataaagaactccaatactcaatagaaggaaaacaatcaacccaacttttaaaaatgggcaaaagacctgaacagttcttcacagatgtacaggtggcaaattagcatgtgataaaatgctcaatatcattaggcattatggaaatgccaattaaaaccacggtaagataatacattgtctgttagaatgattaaaaaagactaatcatactaatgatggaggagtaggaactctcttttctaatatgctttggtggaatataaaatgtataatgaataagcacatttgaaaacagtttggaagtttcttaaaagtgtacacctgccatatggtctagctattacactcctaggtatttacccaagacaagtgcaaatatatgttcatataaagatttctacacaaatgttcatagcatctaaacaacccaaatgtctatcagtaggtgaatggataaacaatttgtggtatatccatacaatgaaacactacttagcaataaaaaggaataactgattgataaatgtaacaatgtggataaacctcaaattaattatgtggagagaaagcagaaaaaaaaggtacctactatatgatatcattaacctaagactccagaaaaaatgcaaactaataaatagtgacagaaaggagatcagtggttgcttgtgaatagagtggggtagggtaggctgggaggaaaggattacaaagacacatgggaaattcttgggagtcgtggatatgttctttgtcttgattatgctgatggttttgtagacgtttatgcagtttcaaaacttatcaaatcgtacaccttaaatatatacagtttattgtatatcaacttagtcagtaaagcagtttttaaaaatcctaagcatattattgtcaaactgcttggaaataaagagaagaatcttaaaagcatccagagagaaaagacacaaattctatactttaagtatgtgcaatttttttatgtcagttgtttttgaataaacattttaaaattagtttcaaaaaattagggtgtttaagaatgcctgtagagatggtaaagctaaagaaaatgtggaagtggttatctctggtgcggagggaaggttttgggatcagggaggaatagggaattcaaagttaatggaaatgttcagcttctaaatatggatagtagttatagattcactttattattcatttctaacagtccaaataaattatatgcattcttttgtatatatgataaattaaacaatttttgaaactaaaggtaactttttatctttggaaaagacaaatgaccatcttttggatgctttcagtcagaaactaacaatacagttagaatctgttactctattaagtaataataagacagaggggagtctcaatgctttgtttttgaaggtttttagaaaacaaaatacctgaaatgtactatcatctctaacaacaaaaaattttataacattcacagcaaatatttaagtctataagattatctctctctgtgtttctcatcactttacaatcttaggcacttgctattacatatttattttagaaagcagaagtttcaaaaatcgctttctaaatataaaattaaattataatagataatatttttgagcctacatacacgggagatttggatatatcagtctcttaagaacctctcgtatatcctgaaaaatttactttaaattaccccagtatgggctgcacactgtggcttacacctgtaatcccagcactttgggaggccaaggcaagtggattgcctgagcccaggagttcaagaccagcctgggcaaaacagtgaaacctcatctctacaaaaaatacaaaacttagctgggcatggtggcacacacagtagtcccagctactctggaggctgaagaggggaatcacttgagtctgggaagttgaggcttcagtaagctgtgatcacacccctgcgctccagcctaggcgataggacgagaccatgtctcagaaaaaaaaaaaatgctacctcagtataataatgtaagtactatcagaaagtaagcgttcttgtctccgtcatcgtctctaattttatctgttgtaccaaatgtgcaaactctgagtaatactgactttaaaaatttacaatttcattgtaaaaatgaaattgcatcttaactctctcctatttacaaaactcatatgtatatatatatgtgtatatatgtatatatgtgtatatatatgtatatatatgtgtgtatatatatagtcgttccttagtatctgttggagattggttccaggatcctgtggatagcaaaatccgtggatgctcaagtcccttataaaatggcatactattgcatataacctgtacacatcctcttaaatactttaaatgatctctgggttacttataaaacctaatacaatgtaaatgctgtataaatagttgttaatactcagtgcttttatttgtattactttttcttgttttgttattttttactggtttttgttcctgaatattttcaatacacggttgattcctcgagtgtagaatccacatactataatttaatgcctaagattataatcttgcttatttcatgacacagatttctataaaaaaaagcttgattaattggcaacttgaatagtattataggatgatgaaggttgattctctggttcagatttataaaaatttagaacattaaatattattttcatggtagaactttgagactcattctactattttattacagcatatagtaaatacaatcagtgttttgtcctgtactcaaatactatttttctgtccacagcctgcaccagcatggactacttttagagttggcctattttgtggaatattcattgtactgaatattacccttgtgcttgccggtaagtagtttaaattttgaattaatttattcttaccaatatgcctgtgtcatattctgcccctctgtaaggaattatgcatgcaactaccaaagctactgaaagataaatctatcagggctaagttttttgtccttataaatgtggttttttttagttgtttgttttgttggcgttttttccccatttgggtatggttattctctaaaacattgctcatgtatgacttctttttcttcatcattttccagtttctgtatataacttctatataatttttcagagtttatttatcaaaaaccttggctttcttgatcatagatgaggataaataatgttacaaaactcattcacaaagctctttcactttgcttattggagaccctctcgcatccttttcagaatctatttacaattactttgcatatagtgttaagaagcttggttgtataatttcctattctatagaagtaaaaacaattagaaagagataggaaggattcctaggagcagctgcactcacaacatcaaaaaatgatataacagcaaaggaagcataatcttactaaatctccccaaagaatttgacacaccccacagtagcatttgacattatcagtcaccacttcttgaaacactttgattgttttttctggagaaaccacactctgctggttttcctgttaaattttactggcagtttgttcccagtctcctttgctagctatacttttctttgtgacatcaaaatgttagggtatagtgctgggctcaatccttcaatctcctctgtctatatttgtttcctatctaggcaatcttattcaagactatggctataaataccgtctatatgctaatgactcccaaatatatgttctctcttctgaaagatgtctacttggctagttggatttgtctagtagatatctcaaacttacacagacaaaagataccttgatttttacccccaaatatgctcttctatctggcatcacctttcatccatttctcagtccaaaatcttttagtttctcttgtccctcatatttaatcttcagtccatcagcaaatcttattggtctgtcttcaaaccatgttctaaatgtatttacttctcaccaccttggccagtgccactcttgtctaagcagccatttctttttttttttttttttgacacggggtctcacactgtcgccaggtctggggtgcagtggtccgatctcggctcactgcaacctctgcctcctgggttcacacgattttcctgcctcagcctcctgaatagctgggattacaggcacacaccaccacacctggctaattttttgtatttttagtagagatgaggtttcactatgttggccagactggtcttgaactcctgacctcgtgatccacccacctcagcctcccaaagtgctggggtttacaggcatgagccaccgcgcccggccagcagccatttcttgtttagtgtatagcagccttctggactcggtctccttgcatctactcttgcctccttatagctactagtgtcttttttcccccccccccaatggaagttagatcatgtcactctcctattcaaaattcattcatggctactcttaaaataaaatccaaactccttgccattgcctgcaagaacttacaggatctcacctctgtgggcctttccgatattatattgtcatcttccccccacacttagcttcactttgtttccgaccacacttgtgttagtacttcttagatgcatcaagctcattctaatctaagagcctctgcagttgcctaaagagctcttccccaagatgtctacctagcttatttcatcacttgtctgtattcaaatgctacattcttagtaaagcgttccctgatcacccaaccctaaaataatctattctgtccctttagcctacgttagttttcttctgagtacatatacttacctgacattatatattatatatttatatttcttgtgatctctttttccactggaatataaattttcttgatgcctgggcatttgtctctcttgtatctctagcacgtagaacactgcttagaccatagtaggggcttgaaaagtattggggaagtttggctggaagagaaggagaaagatgaaattaaatgatatttagaaaacacatgcacaaacagcagaaaaacagacacaaatctcaaagcttcttatagtcaaggacttttaaggacagataaccttggtatacctaagggtctatgtaattgtgctcataataataactgaatcattaataaagggctaaattttgttcagtgaagtctgcaaagaaatattaggctggtgcaaaagttgccattacttttaatggcaaaactgcaattacttttgcatcaacctgtatgatttaaaaatagatgtcattatttgaatatccataatattccatttcagacttttagtaatcataataatgcccaaataaggaagctttatgtcactgtcatacttaactattcttgattgcagggactatgtattgttgcattttaagttcccaacacattgtcaagtttatagtagatgttcgagagataatttactgaactaattattcctcataaacattctgcttaagactatcaattgtatattatgaaatgataacctacattgtaatggcttttagagaacatatgaattttacctattaacagtgtgttttcatttgtattgttagagttcttcttcctaccagttactaaaaatcaactctaatagttatggtcaatcctgagtttatgatgtagtgttgctataatttataatcatattttaatctggttctatttccttaggtgaatacagtttacttacatagaatacatgaaaataatacaatttaaaaactcagatctatgttatcaagctagctgtagtggagagaacaaaaggcctgcatgggtttcagtttcagctccactgttagttgttttggctttaaggacatcatttaacttctctcaaacagtttcctcatctgttaaatgagcttaacaccttaaatttgcagggttgtttagggttcattcattcattcagcaagtaaattttatgtgtctaagggttatgcttgatgcctacaagtcttaagataaataagagaatccctttccttatgaaatgtattatgccagggagattaaggcatatattaaagcaatatactgcaagatagaaggtgttaaattttctaagcggttcaaagagacaactgattacttttaaatgagagcatcagggaatacttcatggaagaaataacgtttatgctagacattggtggaatcaaagccatttcgagagaaggagacagttgagcaaagagatttagttggcctggggtggggatggagtgtagaaggagggagtgagttatgaaggagagaagtgataaattggccaaaggtgaaggagaatattagatgataagggtgaaaagatagcttgaggccagctcatagggatcagataagaagtgtaagtaaaacatgtttgtagttgcaaagtgctatgtcaatataaggtatatatggtgggggttgttctttctatagaaaatgccttagtcattagtgggtgcaatttttttgtttaattttcaagatgagcatggtggtattatcatcattaaaaaaagacataaaaaatacatttttccattctttttatgtgaattaattgctacaatttgagggtttttttgtttagtatatacagactatgtttttgtaagacattctgatttgttttttatgtgtgctgtgtatgcatttagtgttacgcattatgttttctcacttcagaacccttctttgtttgatctttgtgtatgttgtagggggagggtaaatatagttaaagccagctgtctatccttatttatcttccagcgggtgcttaaaagataacagtgttgagagtcaaagagaaacacagtcgtagtatgcatgtacaagcacgattctttttttcaaacattcacattaaaaaatgtgcataattgctgtggtttttcaaggggacatgacctagtatttaataatttctctgaaaatcacgtgtttcagataattaatttcattaagatgaaaagttgactgtttagatttttttttcaaacttgtttcttttgcaggttcctactaacatatataacttaatttggtacaataacagtataccatatttcacttactggtttggccatttacagtgggtataaggtgtgaaataggctctggtacactagtggtaagagtactcattgttgctatctctttggaggataatttggcagtgtgtgtaaaaattttaggcaaaattatgttgattaagccgttttgtttctagaaatttatcctacaaacatacttgtacatggttgcaaagacatgtatgctaggaggatagtcattgccattttgtttatagtagaaaaatcctagaaaccactcaaatattcataaattgatagctctttaaattatattacctctgtacagtggaataccatggagatattaagatgaatgaggtaatggtgggagtgaaaatggacacagcactttggagaactttttggcaacaggaatcagttttgtggaagacaattttttcactgggctggcgggtaggagaggggatggtttcaaggtgaaacccttccacctccgatcatcaggcattagttagattctcataaggagcgcgcaacctagagatccctcccatgcgcagctcacaatagggttcgttctcctctgagaatctaatgccgttgatctgacaggaggtggagctcaggaagtaatgctctctcaccagccgctcacctcctgctgtgtggcctggttcctgacagagcacggaccagtactggtccatggcctggagattggaaacccctgtactaacctatgacccagttctaatagaaatgcttacatatgtccaccaaaagacatgtatgagaacacttaagtaatattgtttgtaatagtatccagtcatgtaccatgtaacaatgtcttggtcagcagcagactgcagatatgaaggcagtcccataagattataatggaactgaaaaattgctgttgcataatggacagcatagccatcatagcataacacattatttagatgcttgtggcagtgttggtataaacaaacatattgcactgccagccatataaaagtttagcacttaaaattcatgtacataatacttgatcatgataataaatgacttactgatttatgtatatgctatactatttattattttagagtgaactcctcctacttattaataaaagagttaattgtaaaacagcctcaggcaggtccttcgggaggtgttccagaagaaggcattaatagaataggagatgacagctccctgtgtgttattgccccgaagaccttccagtgggagaagatgtggaggtggaagacagtgatattggtgattctgatcatgtgtaggcctaggctaatatgtgtgttaatgccttagtttttaagaaggtttaaaaagtaaaaataaaaattaaaaaatgtaaaaatagaaaaaagtttatagaataaggatataaagaaaaaatacgtctatattgttatacagtatgtccatgttttaggctaggtattattacaaaagagttaaaaaggtttaaaaattttttaagtttataaagttaaaaagttacagtgagctaaggttaatttattattgaagaaagaaaaaaatttttttataaattcagtgtagcctaagtgtacaatgtgtataaagtccgcaatagtgtaatgtcctaggtcttcacatttactcaccactcactcactgactcacccagagcaacttccagtcctatagctccattcattgtaagtaccctatacaggtgtaccattttttatcttttataatgtatttttactgtgtcttttctatgtttagagatgtttagagacaaatactaccattgtgttacaattgcctacagtattctgtacagtaacatggtggacaggtttatagcctaggagcaataggctcacataactgtaagtaatgagaataacaaactgtagctacatacaagaacatgatggctctcacaaatgttaaacaaaacaagccagacacaaagaatacatattacatgattccatttacatggagttcaaaaaacaggcaaaaatcaggagtttacccttggggaatggatagcaattggaaagaatatgagccggaacttctaggatgcttgtaatatgctgtgttctgggtgctgattcacttcatttttcatcatgttgtatacttatgatttatccatttttctatatgtatgtaacacttaaattcaaaaagtttacattagaaaatgagtgagatctttgtgcactgatactggaaaatctccactccaggatataagtgaaaaaaaaaaaggcctggaatagcatatatagcatgctcccagttgtaattggtgatttgttttttaaaaaatagtatgtgtttctctatgcatcaagaaattcttgaaagataatagacaaattgttagcatggttttcttcagaagatctggagtgagacgaggcttctcatattctttataatatttgtggttcttttcctatacacatacattacttgttaaaatttttttaatgttcctttaaagaaaagtgagttggcaacttaatacagagaggactgtaattttgtaagttttagaacaaacttctgtttgggttttttttttttttttaaacaggtacatatttgcttactaacacaacctagccccattgttaagtgtgcaggctttggagccagattgtagggttattacatccttgtgatcctgggcaaggaacctattttgagtaagccttagtttcttcatgtatctgctgagaaaaaccaatttatagtgttgctgtgagaactaatgaaattatgcatgaaaaacattgagtatattgcttaccccaaaataaatgcttaatgattgttagctgatttttaagttaaaaattcatgaagccatgggaagtttgtgatgggaccttatatatcttttatttttgggactcatggatcagagagatgatatacttattcttaaaaatgatactaatttgttttttgattccctggaattttttatgatgatcttgtctagcaagagtattgtggtttaatcccagtaaatctacaaaagtttgcttcagggagatcatgccaaatgaaggaggtttcattgtattgcttatatatgcccttaggttttagatttatgtgcaattgaaagttttggatctttgatgaataacttgactattaacagttaaaattgccttttgctttttgaaactttttttttccttcagagacagggtctctctctgttgcccaggctggagtacagtggccccatcctagctcactacagcctagacctcctgggctcaggcgatcctcctgcctcagactcttgagtagccaggaatacaagtatggagtagcaccatgcctggctaattttttaacttttttgtagagacagagtctcactatatcgcctaggctggtcttgaactctttgcctccagtgatcctcccactttggcctcccaaaacactgggattacaggagccaccatgcctggtccctgttttttgaaccattttgaaagtaaataagttcattagcttaaatatagtattttcattcagaagaatatatctttagcatttattgttttacagaggtccttggggtttttgttgttgttgctgctgttttggttttcgctgacttttctaacaaattgtggagttcaaggatattttattcagatcatatttactgaaagccttagagattttctagttcctatgttatcaagtagaacttaggtaaatatgtgtttagattttataaatatggattacattttctgttcatggcaattttcttcctatgtaggacagaatactactgttgctagggtcatgaatatttgaaccctaagcaggctatttcgctttcttttatgtatggccacagatattaactagacagaattagaaaattttgatatattagagcaaatctatcaccaccactactaaaacagttcaaaatatatgcctaggccgggcgcggtggctcatgcctgtaatcctagcactttgggaggccaaggcgggtggattgcctgagctcaggagttcgagaccagcctaggcaacatggcaaaaccccgtctctactaaaattacaaaaaaattccctgggtgtggtggtgtgtgcctgtaatcccaggtacttgggaggctgaggcaggagaatcacttggacccaggagggggagggtgcagtgagccaggatcatgccattgcactccagcctgggcaacagagcaagactctgtctcaaaaaaaaaaaaattatatatatatacacacacatacacacatacctaacatagaaattagtaatgacatcttaagatatatttattacttttttccttttctgttttttttaattgaggtgaagttcacataacataaaataaatttcattttaaagttaataactcagtggcattcaagtacattcacagtgttgtacaaccaccacgtctatctagttcccagacattttcatcagcccaaaaggaaaccccactctccattccctctcctcagctgctggcaaccactaatctgccttctgtctctatgaatgttcctattctgggtatgtccataaatggtgtcatacaatatgtggtattttgtgtttggcttcttttagttggcgtaatgttttcaaggttcatccatgttgtagcatgtatcagtacttcattctttttatggctgagtaatattccattttgtgtatgtatcacaatttgtttatccattcattcattgatggacatttgggttatttctatcttttggctattgtgaatggtactgttaggaacatgcataaacatggatttgtttagtacctgtttaattttctgaggagccaccaaactgtttttcacagaggctttaccattttccattcctactagcagtttatgaggattctgttttctgcacatccttgccaacacttgttttctatgtttttgttttcttcattatatccatacaaatgggcgtgaagtggtatctcattgtggttttaatttgcatttccctaatgactaattatattaagcatcttttcatgtgctcattggccatttatatatatattttggacaaatgtctatccaggttcttagccctattttaattgggttgttcattgttccattgttaagttgtaagagttcttcatgtgttctagatactagacccttatattagataaatgatttgcaaatattcctccctttttttttttactttcttgataatgtctactgatgttttaaattttgatgaagtctcatttatctgtttttccttttgtttcatgtacttttgttgtgatacctaagaatctattgccaaattcaaggtcatgaagatttatcattatgttttctttggagttttatggtttgaattcctatattgaagtcatcaatgagttttgaattaatctttgtgtatgctgtgagacaagggaccaacttcacttttttgcatgtgaatatccagttgtcacaggactaagctgttgaagagaatattcttttccactgaatggtgttggcactcatgttgaaaatcaatcagccatcgatgtataggtttatctctggattctcagtgctattccattcatctatatgtctgttttcataccagtgccacaatgttttgattactatagctttgtagtaagttttaaaatgacaaagtatgagtccctaactttgttcttttttcattattgttttagctatttgggacctcttggaattccatatgaatttaaggattgactttttcagttctgaaaaaaagccattggaattttgatagggattgcattaaatctgtagattgctttgggtagtattgccgtcttaacaatattaaatctttaaatccatgaacacaggattcttttctactttaatttctttcagcagtgttttgagtttgtagtatacaggtctttcacttacttggtaaaagttatttctagatgttttattcttttgaatgctattgtagttagaattattttcttaatttcattttcagattgctcattgccgatgtatgcaaacacaagtgaattttgtgtgttgatcttgtactctacaactgtgatgaatttactaattctagtagttttattgtggattctttgggatttgtgttatttttgtttcctgactgttgtaatgcatctgtggtctttgcttaggaatcaggatgtaaaactatatatcattttccatttataacttcctaactaatcttgcctttgtacttgttcccttgtagtctgttcacttaacagctagagtagccctttaaaataattcatgaggtcatgccgtgtatgtacaaaaccttctacaggcttgtacatcagagtaaaagcttaagtcttgacaaagtactgaagagctctgtctgatctactgctgaccagttctttaccactatacctttgtttgttccaatcatagtaacttggctttcttcctagagcaatctatcttaaggccctttgtactttccctctctacaaggagccgtcttcccccaaacatcccaatgctttgttctctatttccttaaggtcatctccttaagtgtcatctcctgagagtcttccctgaccgccctacctaaaataacacctaacatcattctttatctccttactgtagttttccttcaaaccccttatctgactttatgcagaacagaaatttcctgaagataggtattttgtccgttgttcatcactgaattgctagctcttagaatggtgtcaggtgtaataggcacctaatcaatacttgtcaaatgaaggaataaagtttcctcaagtaaaaggaaaaagaaactaatatatactgaatactcataatgagccaaacgttattctaggcatttgatatatgttgttcacatttaatcttcttaataaacttatgagaatagatattatccccattgatcaacaaagaaacagagactttaaaaaaaaataaataatttggcatcgctaggatttgaaatctggtctgtagtacttgattccaaagcaaaggctttctctaccgtgttattttaaaattattaaatcttctatatactacagagaatacaaaggtaaacaataaatggttatttaagtatataaattagtatataggctgggcatggtggctcactcctgtaatcccagcactttgggaggccgaggagggcagatcacctgaggtcaggagttccagaccagcctggccaacatgatgaaaccccgtctctactaaaaatacaaaaaattagctgggtgtggcgtcacgcatctgtaatcccagccactcaggaggctgaggcaggagaatcgcttgaacgcgggaggcagaggttgcagtgagccaagatgacaccactgcactccagtctgagcgacagagcaagactccatctcaaaaaaaaaaaacaaaagtttgtatgtaattaaattccaaatgagcagtactgtcaataaattttatagttatttggaaaatcattagaccaaatggaagtgtttctcatacagtgggcttaaaacgaaatatgttgattcagtgaatttatgaacaggtaaggatccaggatctgtctcttaaatagtaagtagaatttgaattagtggagagaaagaacaaggccattttaagtagagggaacaacataagtaaatgtgaaaaacaaacttattaaaaggataataaaattcatcacgagtcaagagttaatattttaggggtgctgcgagataagtttgggaaaagtgagttggtgattagattatgaagaatttgaattgtgaggctaaggtatctaaagtatttgaacattataattactggcgagccatagaataatgatattgaacatttgtgtggacataatgggcaatagaatgtagtgcttaagagtatgaactttggagcaaaactgggttcaaattctagcttaggtcagtaactaagcaaatgacaacctctctgtgctctagtttcctaatcaaatggagataatggtttttaactcaaagagccattgtgatggttaaatgaattaccaattattctatgtaaaaatactgagaacagtgcttagcacatagtaagcattccgtaaatattaactgttgtcatttatatgacatttaaattttcacactactttcatgtgtactgttccttctcattttcatggcaactctgtgaggtagatattactatatccagtttaataatggagtaaatgaagccaaagagaggttttgtcatgccggatccccaaatgacagaactgatcacatgattctaagccacttcaccatgattctttgtaatctaaaaaactaatagaacaatgggatgacatgctgaaagtcaagttttgggaaattattctagtgacattctgcagagtaaaatgaagacgagaaagaacccacaggcgactttttaaggctcttaaaataatctaggtttggccaggcggggtggttcatgcctgtaatcccaacactttgggaggccaaggtgggtggatcacgaggtcaggagatgaagacaatcctggccaacatggtgaaaccctgtctgtactaaaaatacaaaaattagctgggcgtggtggtgcgtgcctgtaatcccagttactcgggagactgaggcaggagaatcgcttgaaccagggagtcggaggttgcagtgagccgagatcacgccattgcactccagcctggcaacagggtgagactgtctcaaaaaaataaataggtagatagatagatagatagatgatagataatctaggtttaggttttatttatgaaaaatttctatgccagggctatatcattgagaatgaagacaaaagattattaattcaagggaagttatgaattttataactgaccaatatcttaatattctttcagctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgaggtaatcaaagcaagacataacacctcatgaatatagtttgcattagctatatagctatctggtttagtgggtacttaaatccatcctctacttgaagaggattattagcttaataactaatcatgtttcttacttttgttttattaaagatattttaagtaatggtaaaagtaaaaataacaatttttctctatctttctgtcttccccatcctttactagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctggtaagtccagaaacttgtgtaccacttttagagtggcatattggttattgacttcctctaagataaaaccaaggctgctaggttgtacaactgcagaggccgtggttcacattatagtttatgtgagtggaggccctgggaaaaagtactcacgtatattttcctcctgagatcgagtatcaggtggccaaatattgagatgattttgtaaattataaacattttttacttcgcttaactagctgtgataagatgtagaactttgtaagtttccttcccccaaaaaaatgtggtaaaagaattattttcctgttaagttgatgtgagtatcaaccgaacattttattttaggaaagatttgttctctaaaagcagtaggaatatcttaccagattatcaagtttaatttgaaaaattgactttgggctgggcgcggtggctcacgcctgtaatcctagcactttaggaagccaaggcgggtggatcatctgaggtcaggagtttgagaccagcctgaccaacatggtgaaaccccgtctctactaaaaatacaaaattagctgggggtggtggcccatgcctgtaatcctagctactagggaggctgaggcaggagaatcgctagaaccccagaggtggaagttgcagtgagccgcgattgtgccattgcattccagcctgggcaacaagagcaaaactccatctcaaaaaaaagaaaaagaaaaattgactttgattcttgtttataataagttctttttttcttccactttacctgtctcttaatgatctcaaaatcatttagcctcagcagtgaaataaaatttcctgcaaaactgtaaagctttcttctgtaaagataactccggaaggggacttctgtttacttgtaaattgagccagctctttttgaaaatcatttgaggccaggtacagtcgctcatgcctataatcccagtattcgggaggctgaggtgagtggatcccttgagcccaggagtttcagaccagcctgggcaacatggtgtaaaccctgtttacaaaaattaaaaaattagctgggtgtgatggtgcacacctgtagtcccagatacttgtgacgctcaggtgagaggattgcttgagccaggaacgtcaaagctgcagtgaaccatgttagtgccgctacactcccagcctgggcaacagactgagaccctatctctaaaggaaaaaacaaagaaagaaacaaagaaagtaaatcaattgagaaaactttcatatgattatttcttaggttatgaattacagctaacaataaagattagtgattaaattgaccaatctctataaaaactttcagaattgctctattttctcacctctttttcactttataagtatacgtccttgaaaactgcagttcctattgtttttcttttgtatgccccttatgttagcaaaggtttttttgttcttagccaaacataacaatttttttttaatctgaagacataaaatatggctttctattaagaaaaactgtagaaccaggtgcagtggctcacgcctgtcgtcccagcactttgggaggccgaggtgggtggatcacctgaagtccggagttcaagaccagcctggctaacatggcaaaaccccatctctaccaaaaatataaaaattagccgagtgaggtggcacgtgcctgtaatcccagctactcaggaggctgaggcaggagaatcgcttgaacccaggaagtggaagttgcagtgagccaagatggtgctgctgcactccagcctggacgacagagtgagactccttctcaaaaaaaaaaaaaaaaaaaaaaaagggggtctcctttgttgcccaggcttgtctcaaacctcctggcttcaagtgttcctcccgccttggcctcccaaagtgctgggattacaggcatgagccactgtgcctggccataaaattatttttaaatgagactttggaagattcagaaaactcaggttttactatgattacgtaattacagtaacaggataatatagttgtgtacattgtgtgctaagtgggcatttccccagtgtatcctttgtttaaatagcaagctgtgattcatgcatgactagttactcctattagcagaatgattgcccattgagtagatatttatttgtgcatctgctgtgtttttgctaataaatgaggacttgttgatggaataggttgacaatggtataagcagtaatagaataataaaatgtactatcagatacactgaaatatagaaggaataatttccttctatatttgtggtttgttgtttttgtagtaactgttataaacagaacagtgttatcatttgtagataattttagtattaattgacctgctgacttattttaatttaaatctcactgggaaaacttacccttagactgattcctagtgaattaacaagaatgtgttcactctagttatgtttttctgataccgctttttaaaagcttcatcctaaagtaaaagtacatttctttctttttttctttaatttttttttttttttgagacagggtctggctctattgcccaggctgaagtgcagtggcgtgatctcagctcactgcaacctccacctcccaggttcaagtgatcctcccacctcaacctctccagtagttaggaccacaggtgtgtgccaacgtgcctggccaattttttgtatttttggtagagatggggttttgccatgttgcccagctggtctcgaattcctgggctcaagtcatctgcctgccttgcctcccaaagtgctgggattacaagtgtgagccaccacacccatccttttctttaatttttagtgagaaaagcacataggtcataatggtaggcactgggtgccatttatatccatatttatattggaatctatggaattgatatatgctatgctcctaaaaacaaagctaaaaaaatttataagaaattgatttattttgatatgaatattgtatgtcaaattagtatagattatttacatccattaggttatactttctctccttaaatctatatttacctcaatcagaaatctaattaggtagcataaacagtgcctcagattttctaaacaaaaatataaattttaactcactatattaaaagtaagctaattaaaaattttaaattatagtcctttgttacataatttagacatcagtttttaccaacagtctctttagttctatagtaaaaattttacacatttctattataagaatagagaggtgttgtcatttagtaactactttatgtattttaattttaaaaataacccacaagttggagctgctattaatccctattttataaatgaagaaacctacattcagagaagttaattaacttgcctaaggtcacatagccagtgaagtgatgaagatgagttatgaacccaggcagtcgtttataatctgtactcttaaacactaacatttaacacttagccctattagtcacttatgttagatgtttaactttgatctagtggatcaaactagtagaatataaaaatcaaatttgaggccaggcacagtagctcatgcctgtaatcctagcactttgagaggcggaggtgggaggatcgcttaagcccaggagttcgagaccagcctgggcaacgtggcaaaaccctttctctacaaaaaatgaaaaattagtggggcatggtggcacgcatctgtagccccagttacttgggaggctgagggaggaggatcgcttgagtccagcaggttgaggttgcaatgagctgaaattgtaccactgcactccatgaaaagtagaaattaaaacttcatcttcttagctatttatcagtattaacttaaaagaggatgttaacatgttctttgtaataatttagtggcttttttgtgtaggtggtaaaatatcagctatccagaattgtctctggctttcataatactgttactctaggaattgtcactttaatcaaaatcacagggtagaagtggagaagttgaaaggccttatccagattaagaagagaaggaggagtgagttacagaattctctcccagaaggcgatatcagataaatctagaatgaatttgactgtgtgtaaatgtcagtgagttgagtatgatgtttatgctctccctctcacccggcctctgacagagtgacttcttcttttctctgtatttccagggtattttgtgtgtatctctataatatggtgctataattatacctttatgtatttatttgcccaactagactgtggatcattaaggcctgtaagccgcagtgcctgacatttaataaatacttgataagtctttgttaaatacatgaatgactgtaattatattcttcccttcattggttgtattatataacatttactactcccttctttcttccttttttcattttctctttttgtaaattttcccttcttcccagttttttttttaaattttcatgtcagtcctatcctttttcagtcccatcccaccatcccttttttccttatttaatgcattatctccctcttctgctcttatggagattttctgaattagccaggttttgaggatggggttggcagagtatgagagtaatgatagtctgtctcatgtcagttataaagaaatttgtcctaggctaccagtttcataatagttcatgattagagatggatttagacttcctgatcttttggtgttatatcctaaattattctatatttctgtcactttgaatcctttaagtccattctgcacactagagtttcttaaaatattacagaaactggtgccagagcttcttcgtgcatagatgactaccatcctacagtccccctcttcctcacaaaaagtttgctttatcgggcgcttatggttgcaaatggtatagattgtctctctggtttgttggactcatggaaagattatgagagtggttaagagactgagccatggaatgaaagtatatcagcaccagaaaataatgtctcaaagcctgtatgatgtcccacagacacctggtctagcttccaaagctccaagaaagtacccgtcataggtagttgacatccaggattgagtcataatgtgaccatttatctccctgacataataaaaataaatatttagagaaacagaagacagatccagccaagtctgagaagagagttacagattcccaagtagaatatgtctatgaaatgaatataactagataatcagagctagagattagattcattttctcaaaacttctacttactcggaatttcttctttcaggagtcacatttcctactgtataagatagaaaggggtcctttaggatgaggattaaggcttccttcatcccatcttcacttcacacagcgcttatcaagacaatctgcacaatttgagcctatttctggtaattgcattggtacctacttcccttctctgcaatgccaagatttccctttgtagtgataaacaggcttccacagaatatgttaggaagagtctgtgtcggtcttctgtaaaatggggatatgaatagttcctagctcatggaattgttatgaagatgagttaatgcttgcataaagccttgaggaaaatacactgcatgagttactgcccaatacatttaatacatttatcatgtgttcagaacagtgggaagagggctgatttttgtggtataatttcaagatgtacacagtcattaccatgtcattagtgaaaagaaagtggctttggttagataatgaggcatgcctcagatggagtaccatcctttcctacttatcctctgtaagcaaagaagagttttgtattcagttagctaagatggagaacagtctagaaattatagcacttgcctctccagcaaaacttcctaactttagagcctctcagtgcttctatcttttgctgctctgtgctttcaaattcaactcttcccacctctttgctttctattttcttttctttttctttttcttttttttttttttttttgataacatgggtgaatttcttttttttatatatactttaagttctggggtacatgtgcagaacatgcaggtttgttacataggtatacatgtgccatggtggtttgcagcacccatcaacccatcatctacattaggtatttctcctaatgttatccctccccctgccccccaccccccaacatgccccagtgtgtgatgttcccctccccatgtccatatgttctctttgctaaactcccacttatgagtgagaacatgcggtgtttggttttgtgtttgtgtgttagtttgctgagaatgatgctttccagcttcatccatgtccctgcaaaggacatgaactcatccttttttatggctgcatagtattccatggtgtatatgtgccatattttctttatccagtctatcattgttgggcgtttgggttggttccaaatctttgctattgtgaacagtgccacagtaaacatacatgtgcatgtgtctttatagtagcatgatttataatcctttgggtgtatacccagtaatgggattgctggttcaaatggtatttctggttctagatccttgaggaatcgccacactgtattccacaatggttgaactaatttatactcccaccaacagtgtaaaagcattagtgtttctccacatcctctccagcatctgttgtttcctgagtttttaatgattgccattctaactggtgtgagatggtatctcattgtggtttgatttgcatttcactaatgaccagtaatgatgagcattctttcataagtgtgttggctgcataaatgtcttcttttgagaaatgtctgttcatatccttcacccactttttgatggtttttttttcttgtaaatttgtttaagttctttgtagattctggatattagcccttcatcagatggatagattgcaaaagttttctcccattctataggttgcctgttcactctgctgatagcttcttttgctgtgcagaagctctttaatttaattagatcccatttgtcaattttggcttttgttgccattgcttttggtgtttcagtcatgaagtctttgctcatgcctatgtcttgaatggtattgcctagattttcttctagagtttttatggttttaggtcttatgtttaaatctttaatccatcttgagttaatttttgtgtaaggtgtaaggaagggatccagtttcagctttctgcataggctacccagtttttccaacaccatttattaaatagggaatcctttccccattgcctgtttttgtcaggttcatcaaagatcaaatggttgtggacggtgtggtgttatttctgaggcctctgttctgttccaatacatgctgttttggttactgtagccttgtagtatagtttgaagtcaggtagcatgatgcctccagctttgttctttttgcttaggattgtcttggctatgtgggctcttttttggttccatacgaagtttgaagtagttttttacaattctgtgaagaaaatcaatggcagtttgatagggatagcattgaatctataaattactttgggcagtatggcattttcacaatattgattcttcctatccatgagcatgagtgttttcccatttgtttgtatcctctcttatttcctcgagcagtggttcgtagttctctttgaagaggtccttcacatcccttgtaagttgtattcctaggtattttattctctttgtagcaattgtgaatgggagttcactcatgatttggctctctgtttgtctgttattggaagcactaaacatggaaagaaacaactggtaccagccactgcaaaaacataccaaaatgtaaagaccatcgacaattatgaagaaactgcatcaattaatgggcaaaataactaggtagtgtcataatgacagcatcaaattcacacataacaatattaaccttaaatgtgaacaggctaaatgccctaattaaaagacatagactggcaaattggataaagagtcaagacccattggtgtgctgttttcaagagacccatctcacatgcaaagacacacataggctcaaaataaagggctggaagaagatttaccaagcaaatgtaaagcaaaaaaaaacacaaaaaaaacaggggttgcaatcctagtctctgataaaacagacttcagaccaacaaagatcaaaagagacaagggcattacataatggtaaaggggtgaatttatttcttaagatttgagtgcaaacttaaaaacaagaacaaagcttttcatcaagaataaacacaaaagctaaacaattcttcaggcgtgcatttcaacagaaagtacaaatatgaatacattataatttttaactgcatttaaaaattaaaatatttctctccaaatccaaaacagtacagtctttaatctgttctcatcttttttagatgaattataaacatttgtcatatgctatctggaaaatatagacaagaattactaatcagttctttatgatcaaagaaacattattctccttaactgtgagtttttgaatcatttatctgtatttcagttcagaaataccatataattacacctccactctagacaaaaaaagaatacaaatatcaaggagtaggaacgttcatagaattaaagcagaagtcacaagtgtttgacttagaaatgtacatattgtaataattttttttttttttgagatggagccttgctctgtccccaggctggagtgcagtggcatgatctcggctcagtgcaacctctgcctcccaggttcaagcaattctcttgtctcagcctcccaagtagctgggactacaggtggccactaccatgcccggctaattttttgtattttaatagagatggtttcaccatgttggccaggctggtctcgaactcctgacctcatgatccacccaccttggcctcccaaagtgctgggattacaggtgtgagtcaccacacccagccctgtaataaatttttaaagtacaactttagttaatggctgacatgtatgtaataattgtgaacaatttaggtataaaaatgtgagatcaaaatctttaggctcaaatacttgaaaagtcagtatgaatatggaaagatttgtttacataaacgtgtatatttttagatgaaaaatcagggggtagtggcatctccctgatcccttaacaatatttggatttttgcaaagaattagcagcatccatgctgttttctaactatagttattcctgctttttttcctcctttacttcctttcttagttatccattcagctcattcctttcactgctaattctcaacctagccactgttgccaggtctctgtatttatgattggttctttggtttccattttatcaactaaagtaatcatgctgaatggtcagacatgaaatggagacatttaatacgacttttcttgtttctgtgttttctgattttttttttctttcagtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaaggtagggtatgaatttgcatctatactactaaatcgctggtgtaaaccaagatatattgggaaggataaatgagaaagttaaggtcatgatgaaaacttacccaataatattataaacttaatttaatgtacttggcattctgttagcagtctccttatctgatataatttggcttttaaattatgcattaggatttcgtctgtccatttgccaagatatttacaacttacacttaaagaattctaaaactttcttctagcacattggtagttatattgcaagtgctttcatgccagcaatttgttgtctcactattgctgtataatgtaacatatataccagtgatcagaaatactaattatttagaaatagatcaagtgctttgagagtaactacagattgctttttaattcttacttgggatgttatttttcttctggccgttttcgcaccccccccttagtttatgccagcagttcaagttattaaggaattttgccttcatgacaaagatctcattgagatagaatatgtaacatgtgactaacgaaagttgatgaagccgatgctgacacattcttattgattgccagtggatcacagttctgttgtaggttgatcacactcaattctgaatttcagaattcaaggaaaagttgatttaccaactccattcttatttaaacacacagtttgttcttggtttaaaaaaagaggggaggtgggtgtacaagagaatgtgctcttgggtgtcttgtgttgtggtggtttggaattcacaaaattgtctagaatcactggtgatacttgtaggttttccagatgtttcaaattacagagccaacccgttttttcctccttctattagtatactcatcttctaattttcttacagttttatcacactccaaagaaagtgattcctggacagatatccataaatctgagagagcaaatttccccactagttcccccacaacatattttaccttctctccttgacttatctatcactaaaaagcttgagaatagactgggcgcagtggctcacacctgtaatcctagcagtgtaggaggctgaggtgggcagataacttgaggtcagaagtttgagaacagcctgggcaacatggcgaaaccccatgtctactaaaaatacaaaattagctgggtgtggtggtatgcacctgtaatcccagctactcaaaaggctgagatgagagaatccctggaaccgggaggcagaggttgcagtgagctgagattgtgccactgcactccagcctggaccacagagcgagactcagtctcaaaaaaaaaaagaaaatcttgagaatataatagttgcaaagaagaaagtgattctgaaggttttttgcttttttagacttggtattagctacactatatggctaaatgatgtgaacaagttactttttttcaatggtaatttttcttctttgaaatcttcacagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaaggtattctgtgattgactctgaagagatttttttaaacctggatttttactacctgactctatttcttactctggctacttttccatttgtcatgctcttttttttccactgaaatttcagttccttcagttatatcagtttgttcttgaatgcagttttagtctcattccagtatctactgataaagtaccattgaaaagaagcacagtcacccagaataataatttgtgataatgtttaaaattctgaattatgtttaatgggttcaatctatggatatcttgggtttccatttgtttttagacttccttgttcattaatgaggttgggaaatgtcttggtgaaaaaaaattccctgtggcaatcaagtatatttttaatcgctttccttcaccaagtagtaagaattgtttccagcccatttaactgcaaattgagttctctgattcctctagtttctcatctccatggcaacgtattattacttgagactgctcttctgttgagaagagaaaaggcttttaagttctgagccacatgcagccactccttttgaatttttaacctttttccaagaactgtcagtcaacaatctcacttccttttagtaaaatgcgttccatctttgtctttttaagtcaacatcaaccaacaccttagatgctgcactttctcatctgtaggttgtaaagagatgttactaattgaaattaatagttatttttaaatactttgcaaaattttttttcagtgatttttttttcttaattgagagactatattttaggagctttggccagtgctacaaaattgctgtcaatctaaagtgtgtctaacggtcataaaagatcagaacattgcttcaataaaccttgagatttgatgcagcagatgatatttataatataattccactttttgcagtagattctgtggttggagtaggattgataaatgtagccaataattttaccaccatgtaggcattcttgttaaatgatataatttaagtatgtcagtgaaggaaacacatccccaaagttcccataattttaactcatactgtggaatgctgttgttaagtccaggcatatatcataattcaggaggttgttactagagaatttataaattgggcaactgatttaatacatggtatttatgactccatttactaagttataaagaaccctttacttttcttccatcccaggtaaaaatgagtactgttttttggtcgaatattttagaacataatatacctttaactgcagttgacgcctgaacagcttggagattagggacaccaacctctcacacagttgaaaatccacagataacttttaactcccaaaagcactactaatagttaccattgcctggaagccgtactgataaagtaaatggtctattaacacatatttggtatgtcatgtgtattatatatactgtactcttataatcaagtaagctagagaaaataaaatcttattaagaacatcataaggaagagaaaatatctttcctgttcattaagtggaagtggattatcatgaaggtcatctatgtcatcttcacattgtgtaggctgaggaggaggaggaagaggaggggttggtcttgctatttcatgggtagcagaggcagaagaaaattcatatgttaagcggacctatgaagttcaaacccatattgttcaagggtcaactgtatactgatagcattcagtaaaaagctgaaaatccaaattcctcaaatctgtgaacagtccaaatctaaaacaaatctaaaacaaatctaaactaaaaaagtaacagtttagatagtattgtgggcttaagacatttcttactgacatacttcttgaaagaattttataaaccgtattacctttcggacatttttaagtttacaactgaaatttttcatcttaagtttaaataattacaaaagataccgtttcagtgtattttaaatgttcacattttaaaataaaactgctaaatatttctattgtgcaatagtcagaaaatttccatctctttgctgttgaactataatgtatctttattttaatgtaatatatttttgttttaatgacttgtctgctacataaacatgtaaattgaaattaaattatttctgtcactaagagattaatttgttttctgttctgggttgtaattactattaccctgattattacctacagttgatcaaagcaacattacaaatgtattacacatttaatttttataagtaattgttgcagataaacatttcttaatgagataaatttatgttattactatttcctttttcagtttttatataagtaaactcagaaatcttgtggctatgcagatgagaataggagtttcgttgttgcagtatcccacagttttatgagttcagtgagttatttatgggttatttacccaattctgagttatttgttcaaaaaattgtatagtgatctgtcatcaataaatatttttagtaatgaaattttcttggttgaaagcaaagagttgaaaataaataaagcaaataattgaacatgaactgaatgaaaaaggatttgataaccagccattggagtcattaactttctaacctagacagtagaccatcgtatgattattaattttagaagctctttgtctaatgcaacatatgcaaataattgttaggaaaataaaaatattgttaatttcagtacacatttaccagtgcaatattttatgatgaaataattttatcatattctttaaatgtgcttttgcaaaaaatctggaacttcagattacactcatctgagctatggaaaatatctgcaatatacctgtaggtgaggaaaaacttactcctctaccctcttaagtaattggggcctgcaaatgaaattgacaacagatagattaataaaagaaatggtttgttatgtacacagaggtcttcatagaaaggaagacccaaaagaagtgtttagactaggggttggagaggggcttatataccatttttacaaagaatgataaattgtgaaaaagtaagtttagacaaaagtaggggattgggcttctggatggtaaattgtgaaaaggtaaatatatggagattctaatgaaagaaaaggattatttagtaaggtttgttatgcataccaaagttggtgtcttctccattgataagcgtcatctctggtaaagaagtgttgccctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggagcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaagaagtgttgccctcctcttcctagtatgggagtgacagcgtcacctttagaaatggaaatttatattacatttacaaaaggaatttatgccctgcttttagacaaaaagagggagggcagatatatttcccttcatctgagggtttcttagttaccttcagctcaaaataatccttatgccaaagttacatatttggggtggcatactctgatcctcttcataccctaattgggaaatcagtcagacaagtggaaaaaattttgacttcaggttaacatatttgtgtgtgtgtgtgtgtgtgtgtgtgtgtgtgtgtgtgtgtgtgtgtgtgtgtatatatataaactggacaaaattttttgcccacagtaaaagttttttaaaaaccagaaacaaaaatattttttagatggaccgttggttatatatcttaatcatattgctaaaataaaaaaaaccttatagttacatgttaaatattcatatcactaaaatttttaactaaaaagcttaaaacagagaggaaaaaattgaaatatatatatatgtatatatgtccatgtgtaagcacctcgttccttcattctagttctgagttagatgcatgaccaggtagataggtagacagggaggcagagcaggcatacattcagcaagtacttactaagaatattttatgtaacatgccgtgctaagcactaaaaaaaatagcaacaaagcacaacacaattcttgcccttaataatttataatctagtgggggaatagacaaagtaaaaaggcattaattggttcttaatagtattgttaagtgtactgttttagacatggcttaaaatggtaaattttatttgtttttaccacagtttttttttaaaggcataaaaatagagtataaagagataagcagggtaccgaaagaacccccagcacaggtctctaactcagtctcctaggcctcagaatgggaggaagacttctggaggtaacatctaagctgtatcctattgtttatattaagttaaggaggattctagttaccctgttatgtgccttgctcaaggacatgtaatttgtgagtggtggaggtgtagtagttctcagttctattcttcagcctagggattttttttttttccagacaaagcgacatctttaaagtggagataatggtacctattctgtttgtttcacaggtttgttttaaggagtaaataatagagtgcacatgaaatccccttagactcttaacatgctacgtaaagggaatttatgataaaatgaaatattttctttgctgactagagctgctatatgtgtgtcttcctttacagccttttaaagagaaacccttaatgattgtcttggccaggggacttgcacagggcaagtatcgattagaaatgtgtttggctttttgcccaagtaacatagctacttactcaccgaacactattcagtactcactgtcaaagttttttaaaaaccagaaacaaaaacactttttagatggaccattggttatatatcttaatcatattggtaaataaaaaaaaactcatagttgctacatgttaaatattcatatcactaaaatttttaaccaaaaagcttaaaatcgagggaaaaagattgaaaagacaactcagaggaaccattgacagaaaatttgacattgaatattgatcagaagtagaatttgttaaagaacatgggaaatgggaaaaataaaaacatcaaataagtggaatttgatttctgttattttcttggataatattccaagagaaaaggcactagaaaacatggactttagaaataatcattaagccaaaagaaaagattcaatatgattaattgggtagatacttttctatgaaatgtatgtgtactgttacaaaggataaattttagaggggcaaggagtaaaagacagtgaggtaaccttgtttggattcagagatctgagtcttttcaaagaactagcctgcaagagttaccatagcaacagcattatattaggggcattttcaagattgtttcagagtgtctcatgttttgctgcatgatttgtaaaaattgagatgtaagagtaaaccgtgtgtctagaatcattttttggaaagtaagggaggaggttggaggtttaggcagcccatttgagggaaattaaggatgataatataagtgagctagcactcacttatattaaaaaggaaaacacgtttgaaatatttcagtatattttttctatcattgattttagaaacaaaggaatttagctagtagccagtctccatattttaagaattcacatttcattacatggctaaatttgaaggcaattcctacaagtgttttgttggaattgggattggaggaggcacaaacgtgttttaaatggtttttgtgtgtccttgaggtttcttggctttggcaaagaaaagcctgtgggaggtacaataatagaaaaggccattatgttgttctttctaagtggttgttgagggaaagcatttcattagattttctatttttcatttacagtttctaacattctaaaatatttgtaaatttttagtgatttagttagctctttgttactctttgattttgtattttactttagactttttgttagtgtttgctaaaaagcatttgctactagactttataaaatacttggaacaaagaggtattctcggcacaattaagagttcatttatgtctgtgtggttgttttccaatgcccagatctttctagatcccttcttgtttaacgttctctaagggctgctgtgcgccctaatgaggattcctcagtaggagctcagggccttcagcgcctatcattgtttgagtgagcacacatagtcctgaagtgcttcctccctggggtatgaccagtttattaccctctgtctaccctgagtaatagactgttatgccaaaatgtccacattttagtcttcttatgctataatagaaacactaattgtttttcattctctagggaaatttttgtttcattaactttaaaaaaaaaaagatatacacacatttttaaaaactgatttggataaatgctctcattcttggcttactattaaagtagctcaaatttttaactctttcaaaattgatatatttctgctgtaatttcctagcctaactaataatgcagaaaataagcaaattatttgggaatttatcttggcaatatttgcttaagaactgacgatgccgtaaagccaaatatgagacttttttcctgattattaattttactttaattcaacaaatatttcttgagtggtttttatctacttggcattgttatttttaaatggttttataattatatcccatcttaaattgcttttaaaatattaattatagctttgaataaatttcctttgcatcttctttgttacttaaagaaaagtctttaaaaaaaaaaaaaagaacacatatgcttacacccaataccattttggtagtcttatctctagtcacctttgttttcttaattgctcttaaaactgatagatgtaattggcatttctacataaattatgttgcatttgtaacactcgtgtacaaaagtttaaagtttaaaaagtctctactattttattgcttagaaattgagagaggatctgtggtgtttaaaagaaatagttgaccgggcacagtagctcacacctgtaatcccagcactttgggaggctgaggcaggtggatcaccaggtcaggagttcgagaccagcctggccatcatggtgaaaccccatctctactaaaaatacaaaaatgagttgagtgtggtggcaggcgcctgtaatcccagctactcgggaggctgaggcaggagaatcatttgaacctgggaggcggaggttgcagtgagccgagattacaccattgcactccagcctgggcgacagggcaagactccgtctaagaaaaaaagaaatggttgaaaattttttatacaggagtttgtctaattgaagagaaatttgaagaccaattgcttgaaagttgaatttttaattttcattttaatttacatactttatattatacataattttacatgagaaagctatggtgaaaagtataaacatcagaaaatgtcatatctaggtatttacagcaaaaagaaaagaaagagaaaaaaatgagcaggcaaatgtacttacagaccttgagttcctgctaagtatatggtactctaaggaacataataaattgtatgtgactctctttcccttagagttttataatataatacagtaagtgtactcatcgactattaacagcataataaaccaacccaaaactcagtagcttaaaaacagctttaatccattcttgcttatgcatctgtaggtcagctgggaattgactggactaggctgggctcggctggatagccttcaggctgctattctggcagggtttggctcctcactgcaggttgggtttgggtctatttcatgtgtgttcattctggcgcttcaattgaaagagcagccacttagccaggggaaacttcacatggcactgacagaaacaagacctattacacaaattttaagcctctgcttgcttcatatctgctatcctccaaaggccattgcaactgctaggccaaagcaagtcaccaaaccctacattaatggggcaagaaagtatacttctgccatggaaacagggatgggctgaaagggagagaagagttttaaaatgtaatctaatctactgtgatacagaaaacaatttaaactgatttgtctaaagtggcaaaggacttaaaacagttaattttgtagaataaacataactaataaacatgaaaaattttccactttggtaataaaaacagaaatataaattaaaataatatttaatcaaagaagtgatgatgcctatcactggcaagggtacggagagatgaaaactcattctgttggtagagtataaatttgtaagcaatttgggaattctctcgaatcttaaaatcattcataccttttgacctagtaagtacctttccacaactttttcctaaatagagaattgggcaaaaatgaatgtatctttgtaacattatatagtaaaaaactgaaataatctaacaaatgttcagcaataggagaatagcttacttacagtaactgcatagtatatgaaatattatacagtggcttgttaaaagtcacacagtggacctgcaaatagtagatgaagaataatgactgtgtgtgtgtgtgtctgttttcacagatggtcttgctctgtcacccaggctggagtgcagtgagtagcttggtcatatctcactgtagcctcaaactcctaggctcatgggatcctcccacctcagcctcctgagtagctgggactacagggtcgtgctaccatgcccagctaatttttattattgtttttagatacagggtctcactactgttgcccaggctagtctcaaactcagtcttccaaagctgggattgcaggcctgagcctgctgacacacttaaattaagagcaatgtggactcggccaaaatacgaaaataatttctctctgccagaaaatcgaaagtcattcttgaattggagggaaacaaaactaacatattaatgttgtttcaagtgatggcagaatcatttgacatgattaatttgcttagtgttgtatccttttttaggtcttaagaaatatcaagggggctgggcacggtggctcacgcctgtaatcctagcactttgggaggccaaggcaggcagattacctgaggttgggagttcaagaccagcctagccaacatggcaaaaccctgtctctactaaaaattataaaaaattagccaggtggagtggcatgcacctgtaattccagctactcgggaggccaaggcaggagaatcgcttgaacccaggaggcggaggttgcagtgagctgagatcacgccactgcactctagcctgggctacagagtgagacttcatctcaaaaaaaaaaaaaaaaatgtcaagggtagttagggtaatttgttaaagctggctagcaattttctcaatttatattgttaataaataaggaatgttgtgagcatgctttttagaatgtaatgaacgaaagaccagtgggctaatgttgaatttcttgtttgtttgtttttgtttttgtttatttatttattttttttttgagatggaatctggctgtgtcacccatcctggagtgcagtggcacgatctcagctcactgcaacctctgcctcccaggttcaagcaattctcctgcctcagcctcctgagtagctgggattacacacgcccaccaccacacccagctaatttttgtattattagtagagatggggtttgaccatgttggccatgctggtctcaaactcctgaccttacctcaggtgacctgcctgcctcgggctcccaaagtgttgggattacaggtgtgagccacggtgcctggctaatacttaatttcattgatactttggataggtataagatacggttttcatgaaaatattcagagtgaagaaacttttcgtacactacacacaatattttcttcacatagtaaaaaaaaaaaaaaatgatgccacttaataggaaggaaaataaaacatctacctaaatatctcattgataagtagcatttgtatttctacttgttcctctcctgtgggctcctcaggcctctctctaaatactttttagttgcttctgaataataccccagaacatctttcttttaaaggtagaattgtactacttgtaactattttatccttaccaggaatcttctcaaacgaagtaaatatctcccaaagtagaatgttgaagtctacacaacacatttcatagctggtatagaaaagactgaatcactgaagaaaattaggcagaaactctaagatctgttatatagtcttctcacttatgaatattagactaattctgtttcctttctcaactgaaaaagttgatatttgaaattaatttttaaatctgtcattaaactttctattgcagaaagtagtatttcttacctaaagagcaaaatacttagctcttctcaatttaatcaacccttcttccagtaagaattttaaaagcaccatcttagtgaaaggcacgttttcacattgagaactagaatgtgggctttggagttaggactaggttaatttagccacttactaattatgttaccctgagaaagtgactagatttctttgatttaaaattagtaaaattgagagaataattcccacctcataagtttattataaagattaagttgtgtaaatacactataactggtgttaattggtattgatatcctctccaccatctgtgatgaaagcgtgaaaaaactcacatgcaaaatattagggaagggattttcattatagatgtggaagaatttaaaataattatgagtaaatgtctagataaaatggaccatttatttttaggaaattagaaattaacaaaataaatgcaagaaggcagacactctaaattatggactaagaactattgcaggaatagggaaagttgtctttgaagtgtcagaccacagttttttcacaagtgaaactttgtaaaacctttcaaaccttcaaggaatggtttgtgccatttaaaccgtttggaaacgtagaaggaaagcatcttatttctctttacaaaactagcataattctgaaaaatatcacactcaataaagctgtagtctaatgttacttattaatatacatacaaaaattctttaaaaaaattgatacaagataattatacatatttatagggtacatagtgatgttctgtatatgtgatcagatcaaagtaattaggatatccatctcaaacatttatcatttgtgttggtaacactcactatccttctagctatttgaaactgtatattattgttaactgtagtcatcctactgtggtatagaacactagaacttattgctcctatctagatgtaattttgaatcctttaacaaatctctccctatccttctctcccctatgcttcccagcttcttgtaacctctgttggactttgtacttctatgagattaacatttttagcttctacatatgagtgagaccatgtggtgtttaactttctgtgcctggcttatttcacataatgtaatgtactccagttccatctgttttgctgggaattacaggatttcattcttttttatggctgaatagtatgccattgtgtatatacaccacattttctttatccatttatctgtggttggacacttatgttgatttttttatcttggctattgtgaatagtgctgcagtaaacatgggactgcagatgtctctttgttatactgatttctttttctttggactgaaatgccaagtagtggaattgctagatcacgtggtagttcctatatgcagctttctgaggaacctccatactgctctccatagtgactatactagtttacattcccaccaacattataaaaagtcttaataaaatgtttgcagctagaactgagcagtatattaaaagaataatataccatgactaagatattttagtaatgcaaaaaataattcagtgttaggaatccttaaaaattaaatgttaccatatcactaaaccaaaggagaaaagccatgtggtcagctctgtaggtgccaaggagatgtttgttaattttttaagaaagaatataagaatacttcctaagtatagcaaaatactatacacacatgtgcgtataatatgtcactctgtatcttagaccaatgactagaatcacgattaaaggtaaaaaaaatttttaagttgttggcctagactttctaaggcccctttagctctttacattctattagtctgatagagctatttgcaaatatgtcatgtgttggcagacattatgtcattttgaacctgataccaactccgaaagaaaggaaacaggtgttattctcattttgcttgcgcaaggtcacatgacagtaagtagcaaaaccagaattttgactctagattcattcctttttttaactctaaaaagttatttcctacaaggcagcgtgctataatgttgtgatcctcaaattttggtgtgtatctgaattactttggatgcttgctttaaaatgcattatcttgggttttaccttcagtctaattgagtaggattagggcgatccaaaatttgcatttttaccatgtcttctgctaaaggtgattcactgaggacacattaagtgcatgcaaacaacagatgttgtaaacagatgtggtgttgagcaaatatagagacaaataaaagtagatttgaatactacttcctcctactgaactatttgtaaaatcttagcagtcaagtgatgaatggtacataggcaataaagcatactgggtgagagtgtgggctttggatcaatgaatcttgggcatgttgcctgatgataatggtactcacttcataaggaggttttaaggacatatgtgtaagttttcatagagaggaatgagaaagcagagcagagacagtcaagtgttagttatacttcagtggaagtctcaatacaggtacatgcgtgcgcacacccacaaagcacatcaagaaaggggacccaggagttccccaccaacaaaaagattttgtttctcccatcagcttttattctgctgaaagtcattagagactattgaaattttttatttttaattatatctcaaagtggattgatactgcagttggtgaagtagattccacagtaaatatgtgagtaggtgtttcagaagtactgactttgattttttggtagcatttgagataatacaggttttactctacttctaaaaatattttatttaaaagaaaaatgaaatgaaggtttatataaaaaggcatcacagttttggactgttttactctgatatttagaattgtttcagatggattttttagatctgatatgttttactggtgtagaatattggcaggctgtatgaagaaaacgtggaagagattttggctttccttctctctgtgcctatctcctattatatttcttctcactccctttttaggtttgttaactaaccataatatggaatacatattgttatttctcacatttctagaatacatctttgtgatctgcatttattttatattcaattctgattactatattctgtattatagctgcttaaagatgtactccaatcttatttccatttttaaatgactataattttagcttatgtttatcacttttttcagttcaattaagaaaaaagtttctgcccatatgtatgtactacctgaagctttcataaaatgagcacttgagacactgtgtaaaatgtatagaatcctggccaggcatggtaactgacacctgtaatctcagcattttgggatgccaagttgggaggatcacttaaggcctggagttcgagactagcttgggcaacatagtgagacctcatctctaaaaaattattttttaattaggcaagtgtcgtggtacacacctgtatttctagctacttgggaggctgaggcaggaggatcacttgagcccaggagttcaaagttacagtgagttattattgtaccaatgtactcctgcgtgggcaacagattgagaccctgtgtctttaaaaaaaaaaaaaaaaggattatagtatccttatatttcttttaaagtggttatagttgttagcatttcatttagttaaataaatgaaattgtgtcttttccaggagagaaggcagaaacacatagtttatctgctccagaattgttatttggttatagaacaaaaggagtggggaaaagcagaaatagatattttttaatgtaaaaacaccaaacttctatttaactcatgaattaaagaggaaaccagccagttgtcactactggttcaaaggagaggcaatatattttccacatgatggttagttaacaaacctttactgtggagtaaaggaatgctgatatccatttacaaatggacacaaaatttgctttttctactggaggtggggtgtggtggaggagtagagggtaagatggaatctgttggacctccgtcagacagaatttatttgtgtgcctatagacagaattattggcatttatccacaatttatacagaattataaaataactccaagaccagaaaaggcacaaactccatagaaacataacctagaaaggtatggtgtaaacaatgcataattttccattttagtgcatagtaattatttttgcttattccaaagtcttaacttttccttacagcaataacctactacaagaatgtttccaaggctgttgatcaaatgtgtaacagaaagggatttttaaaaataagcctagacacacatacataagaaagatattggaagaggttctgatgatctgatctgggaaggggtatctgatacagcagaagaaaagttgctaaactctgtcaagaaaggaagtcctaaatggtgtcattgatgcttttataatcactgaagaggtaactttgttattgaggagccagtaaataaggatctatatggataataaattgaatataaatagtttaataatcaaattactttcttgattacatcagtcacatccagttttattcaacaaacatttacaaaacatcttcaatgtatcaggcactactagatgctaggcatacatagatgaacaaaacatatcttgcctttaaaacctcctcttggagctcacggtttggtaagggaaatagactaattacaatagaacatggaagtgcaataatactatattatcagtattgtatagggtataaggtggtttcaaagaggaagtggttaactcagtgaaggttttgaggaacagtcaagttctgtggtttttttttaattaaacattttgttttgagataattgtagaatcacatgcatggcaagaagtaatgcagagagatcccatataccctttgcatagtttccccagtggtaacactttacaaacatagtataatatcacagccagaatattgacattcatacagtcaagatacagaacatttccatcaccacaaggatcccccctgttgccttttttgcacagtattcccccgaccctatccataccttcactttctgcagttttacttatcggtggtcaaccacagtctgaaaactttatgctattttgagagagaaagagaccacagtcacataactcttatggttttcgttttgttttttgagacagggtctcactctgtcacccaggcaggagtgcaatggtgtaatctcagctcactgcagccttgacctcttgggctcatgcagccctctcacctcagcctcctgagtagctaggactacaggtgtgcgccaccacactggtttaattttgtttattttttgtaaaggtgaggtctccaactcctggactgaagcaatcctctcacttcggcctcccaaaatgttgggattacaggcgtgagccaccacgtccagccttccacataacttattacagtatattatgattgttctgctttattattattgctagtctcttgctgtgcttaatttatagattaaactttatcatagcagtactatccatggtttcaggcaccaactgggggttttggaatgtatcccccacagattgcaatggtgcaatctcagcttactgcagcctccacccgttgggttcaagcacttctcatgcctcagcctcccaagtagctggaattacaggcgcacaccaagcccagttaatttttgtatttttaggagagacgggtattcgccacgttagccaagctggtcttgaactcctgacctcaagttttccacccgcctcggcctcccaaattactgggattataggcatgagccactgccactgcgcctggcttcttttcattttttaaattcaacctattttctttcttgttcaggttaggaaatttctattctatctttcagttgccagttctttcctctgtcccttctattattctgttaacagtgagttttatttcagttattgtatttttggcttctaatatttctatttggttcttctttgtgtttcctgtatctttggtgagactgtttctttgctaaggcatttttatcatagctgctgtgagatctttgtccagtaattccaacatctctatcatctcagttttgacatctttgattgtcttttcattaagtttgagatcttccttgttctttgtatgactagtgatttttttaattgaaaactggacagtttgggtattttgttattagactatagacacacacacacacacacacacacacacacacacacacacaccctacctcttaattatcctttggattgagaacatttcctgcttttgcatggtattgctagctgctaactgagagctttggcagccttaccttctgtggcacaaataatagtgcattcatgtggtttttttttttttttttttgtattttgttgtattttgttcgtttttcttgaaatcagtgggaattatctgtggtgatattacacacaatttttttaatgtctcataagtgtaatacagttaaaacagctataggaatcattaggcatgcagaaagcagcaacttttaaacatcattgtgacactcattgaattaaaagcagctgtgttttgttgtaaaggaaaaaaatgatgtctacaaaatgttagaacaatgccgttaaaggttgtatctaaaaggcaaggaaagtttaataggggttttgctttatctatttttagctctcaggaacttatcctcatataagtctgttgcttaactttttcacattcaacttattaacaaaagaccatgagattggcagaggaagcaaaaggaaagctttatttcctgtaaaggattacaatctgcaggtcaggaaactaagcttccagccaaaaccaaatacataggcttcagttacaaaggggagaggttggaatttatccccagtggggttagctccgcatacatatttagcaggttataggagaatttatgaatatttatgagggaaaccaaatgtgtggtgagtaaacatatatgttacatatgtcccatgttcacttcggagtaggcagttaacattaaagtgaagtgaaattcggctctttgtgtcaaaaggtgaaacacagagcagagcacagaggcatcttgtgctcagtctctgtggaccagccagaacgagtctgtgatcagcagtcatttatcaaaaaggaatgctttgtaaggctagtcacctatcgtggcaaaagcacgataagggaggggagtttggccacagtgtcagatggtctgttgaggttggggaagaaatcttgcacacattgtttttagggactggtttctgtttaattataggaaagaaagtcttggcggctgataatgagataagggaatgtggaggtgtgactgacctcctgcctttgtcaaagccttagaatctggttttaaagttttctgtttgccacagctgtccatttcattttgcctggagggcctaggagctacaaacttaataggtgttttcagggacacattatatgtgtaggctgcccagagactatgttgcctttcccaagtatttgttggaaggtaaagcattgtgcagaaaatacaaaaatgagtgaaacatagcctcaattcagtttggcaaatattaattaagcccctactatgtccagcatggtacatgggccctagaaaaatgctgatgtgagatctttctgtgaaagacattacaatttaatggaaaagacaaatatatattcaatttgctctactctaaagttaaattcttttcacaatgctagatagaatacaatattacaggaaagaaaaaaattgtgtatatacagaatgaaagacagtataagcacaagcaaaatgttttgtgaaaagaatgtcataggaaggagagattaacttttttctaaactttaatgtattttgtcctttgttaacatattattaaattttttatctcaaaaatgttaacttgaaaaggggtttttacagctgggcacagtggctcacacctgtaatcccagcactttgggaggcccaggagggcagattatgaggtcaggagatcgagaccagcctggccaacatggtgaaacctcgtctctactaaaaatacaaaaattagccgggtgtggtggtgtgtgcctgtagtcccagctatttgggaggctgaggcagaagaatcacttaacccaggaggtagaggttgcaatgagccgagatcatgccactgctctccagcctggcgacagagtgagactgtgtctcaaaaaaaaaaaaaaagtggggggaggggggacggttttactataactttcattgcttttctcagctcctaactcagccttttcctctttattcttacagaccaccttgtctcctactagcttaagaaaattgaggctatcaggaatcattttccttcagctaccttctccctacatgcttatttaatctaaacccctttttactgtattttccccagtctaaagtaacaaggtgtccttcctcctgtgcactgctctcatttccccttgtcccaggatctagctctggcagttgtcccttgtttttcccaaatcttcaaactgtttgtcattactggctccttccttctagcctatgtacatgcttaagagtcccctactctaaaaagatttcccttacctcattaagccatctggtctagtcttttttccttttctctatcctacatctcaaaacagtaatctatctattcttattcttactgtctccattcctataaccacaataactctatagtaattaacacatatttagaaaccttgaaatgtaaacaaacatagaattagaatttaaattttttaagagataaagagaagctctgtaacatttcagagagttctcatctctttgagtctttggtattaaaaaaaaaaactggaaataaactcaaccaagtgtagtcaaacacagtgtgattccccttatagatggaagacttatctctcattgtagcctgtccttttcatagaaagagcttctaaattattttgatggttgcaaccactgtctgtgtgactccccagtctgtatccgaagctttttagttttttccagttgttttctgggcttcctccacctcgatgtttcgtaagtaccttaaagtcaacacgtcaaaaaataaactcattttttttcctaagcatgcttcaagccccatgttctctaacctagtttatggcaccatgccactcacccaggttaaaaactaggagttatttttgactgtatccttcatctcaccttcaaaatttaccaagtcctgccaattttagttcccaagtatttcttaatttttgccttacctctctgttccttaaacttatactcaattctagtcctcattgtttctcactgggctgttgccacagccatattaatacactgctttcaatctttacacctcaaactcatctccccaaagatacctagagctgcactgttgcataatttaactaccagctacatcagtctgttgagcatttgaagtgtgcctaatctaaatcgaaatgtgccgtaagtataacatacaaactggatcttgaagacttagtttgaaacaaaaaactgtgaaggatatcaattttattttgactatatattaaatgtaaaagtgataacattttaggtatagattacataaaatatattattaattttacctgtttccacctttttgaatatggttactagaaattttattattacatatactctttctccaccttcacatgaaaatgtggctggttccttgtcagtacccaagtcccaacttaagaaaccttctctgcctgaacgctgtttctgcctgaatactgtctgaaggaattttgtcttatcatcctgttctgttttcttcatggtatttttcactgtgtgaaatcatcatctttacttatatatctgatcattgtctacccctacgaaataggaggctttactgaggcaggaaatttgtctgaccattagtaaataagattcactgttgtgtacctggtacctagaataatatctggcatgtgcaggtactctttattgaatgaatggtttctattctgcttgaaatggttctctctgccccataaacttgtttaactcaagtcctttcatgattcagctcaagtagtacctccttcaggaagattttcctggctatttcccctcctggcttattgattccttttctatgcacagttccagaactgtacctatacattgtgtttttgactaaattctctctcctcttttagacttggcccttagtagttcttcagtatattctcattccctagaatgtacctagttaggttacccagtagacattcagtatttgtttgctgaatatacaagcaagcagatgtttttttggagttagtctttagtattctagttatacaataaataatgcaggttatagtatatactcagtagtaaacagttcttgaattagtaaaggaattcctatgtactatttttattataaaaacaatatagtggccgggtgtggtggctcacacctgtaatcccagcactttgataggccgaggcaggcagatcacctgaggttgggagtttgagaccagcctggccaacatggagaaaccctgtctctactaaaaatacaaaattagccgggcgtggtggcgcatgcctgcagtcccagctactcaggaagctgaggcaggagaatcgcttgaaccaggaggtggaggttgcggtgagcctagattgcaccattgcactccagtgtgggcaacaagagtgaaactccatctcaaaacaaaaacaaacaaaaaatatagcaaaattaaagtcttacttaaatcatttgtataaccaccctaataacaattattttcctcagcccactttcttccttaatcttacttccctcatctgagataaccacttctgtttttttcccataaacataattttatatacagtatgaaataagcaataatatgtgtaataacttttaaattctattttcccacactatgttagaaattttgtaatgttacttcatggttttatgaaactacttttttcgttttaaagttgagatggacttagagaagcaatgctgtctagtacaaaatgttccttagatgaggattcctcattctggttcccccatttagccttaggccctatgagttccttttttgtctcaatcattttaagaatgtgaattttctgtaaccacaaagcttggaagaggcagtctatattcaaacccaggtctcctaactttaaatctagttatctttccatttattaactatctccctcaacttcagtttccttaactataaaatgggaataataatgtctgtcttgtctgccctaaggataaagatgataatcacctgagggattaatatatgtgatctcacatgtaactaaaacacactaaagatcggggaatatctatatttgttcattttttggaggacagtattaatctgacaattcaaaggtttgatttttcttttttttggtaatagaaatagatccaggatttgctagatcctaaactcagtcataattcagtttacctttataggtttgggctttgaaaactaggtccagtctgttgtgttttcttattttatttcaaaccatttctcttttcacgtggtgccacatttttcatttttgaaatatccaccctgaaacatgattcaagttgatttccatatgtaatttttctgatttctctctttagtacttttccttctctctttttaaaaaatcattcccacattgtccctttagtattttagtccttttccttttttcttttttaatcattcacacaatggctatgggtacaaaactgtaagaaatttatttttatttttatttgttttaaattcatggataccattgccataaatatgtccaatatgaattatgctgcgaatgtggcaggcgtatactggatagaagcttagagtagaatagcaatgacttgattttctgtgattctgaatatcactaaagtgtgctaccagggttagccaagagagaataagatgtaattgcttgcctaaagtgataatatctttccaggacatctcctgaataccaatgaaggcagatgatttcagggagagaggcattcttcacttgagagatgggaaagatcaaataatggtagtaattaaaatgagaccaaaatgtagcatttgtagaccaagtgtgtgctaatcattgtttgaagaagttcatcagataaaatattacttactctgaaatattctgtaagaatatttatttaaaaggcagtaagtcctcatgtatgtttcatagaaattgcatagaaatgatatggacttctaatataaaaaattagagtgtgattcagaaaagaaagatacttttaaatggtttttaatcaaaattgtcttaatcaaaattttaaagttgtgaataaatacattcaaaaatgttgtttggaaaatgaaaagacaagccacacattaacagaaaatatttgcaggaaacctatcagaaagagaactggaatacagaataaattttaaaatttcagacaatgcaataataataagacaagaaattccccctcaaaatttttggccaaatattttaccaaatccatcaccagaaaagatacacatatgacaattaaacacataaaaagatgcctgacatcactagtcatcagaggagtaaagattaatatcacaactagatactacaaaatgtctattagagtagctaaattttttttaatgacagtatcaaatactgttgaagaagaggaggaactaaatttctcttacattgctggtgaaaatgcaaaatggtacaataactctttaaaacagtttgaaagattttcataaagttaaacatccacttaccatacaacccaacagtctcactcctatccaagggaaatgaaaacatattacataaagtcttgtgtatgaatatttgtaaagtgacttttttggaattgtcaaaaactgaaaacagtctgtatgttcatcagcaagtaaatggataaacaatttgtatacatccttacaaagtaatactatttagcaagaaaaagaaataagccactgatacatgcaacaacatggataaatctttaatatattatgttaagtgaaaacaaccaaactcaaaatgctatatactaagtggttccattttatgtgactgtctcaaaaaggcaaaactaccagaagagaacacagactggtggttgtccgtggggctacaatggagtgtgtgggaattctttggagttatggagatggtctgtaacttgattgtagtgatgggtacatgactctgcgtttgtcaaaatgagcaggatgtgactaaaaaaaaaaaaaagaaataacatgggcttgcaagagagaaacaccagatccattgtaccactgtaagaattacactctaaggataagatttacatttaaaatctaggagaaataccagaaaattagcacattgcttttagtttcattattaattcctttttcatgtaacatttttactcctcttcacaatctccttttatgtaataatttacacttgattatttcttcagtaattagtaaagaaagaaagaaaatcagctttctgtaataagactccatatcacctatactcacttgagaaatactcattttgttatctcctactaaatgtatctattactctattctcatgtccttttactagcagacaaaacaatagcttattattaggaaaattaaatgagacaatatttgtaaaatacctggcacataccttacattcagtttttttaagtgttgtaaatataaataagttccttgcctttttatctctgtgtggatcttgttttgaaaatatgaggagtgaattttactaagttgccaaatttgctttattctttgtgaaccttagtagatgaattgtagtatcttttttaatgtagccatgatgtgaattattgaatgacacttctcagctagaccctatatctgcacatagaatgaaataaatacatgtcagaacacacgaactatacctagatagtaagtaaataattttttaggcattttaagttgataatttatgacataatgttgtagtataaatattcagctcaatttgtttttaatgaagaaaaatttttgtggaaatagtttaaatgtgaaaatgtgattatatcagagctgggctattcatgagaatcacatgtggaccatttaaagaaataccaatttctttccctaccactgcctttctaagagaagcagctaaacagtgatgtgctagtatatgttcaagaaaccagctcttgggtgggagtggggataaggagcattgattcctagtgtttgctgatttccacggtgtaaatacttccactatagccaatttcaagctactaagatgataacactgaatgtggagtgaggaaaagatgtacagtagcacagcattatacagtatttccatcatgcaagtacaataaatacatccaacctcgagaataaaagcaaaaattaataaaattaaaaagtaatgaattttgagtatgtgttacctttgttttaatatagctatttataaagttatgtaagttaatttttaataatgactgagtttgacaaccagcttccagagtttctgaaaatttaacaattggcctctcataagctgatgagaactgatgttcacacaacactgaagctccaaggcaactattttttttttaactaattgattgcaagtaatttgccaaccagttgtttttctaaaatacagatctgatcctaaagcccacgaaggcgttccacagtcagacccagatgagtctttttcagcctcattttaaatcataccatttctctcacatcttctatatgtcacctacactagatgtaggtaacttgtagcttctcaaacacacctgtacttccccccaccttctcattatctgccttctcagtatcttccttcagcctcgaatgacctcaccttatctgcctgacttttgcaatactatttatttatccttctagaactaactcaaatgctgctttctcttacttcctactgttggaaacattcccatttgccttggtgctctcatagccctttgtttatacttcattttgagctcaaatttatcaatttataatgaatgaatgtttcactctctagattataaacttctaaggggtgcctttaaatcatactgtacttattaacacattaatataacctaaaagtggttaatgaacacttgcttattttaacagaaaaaaattatgaacgatgcatgatatatccttcactttctatatctttgagaaactgaccaaaatttaaacttttttgaattagatttgtacgcctttttttcctggtgatgcagaaccatattagtagttatatacctatagcacacctagagacatttcacaatggactctagagcttaccaaagaagaatttcattagatagtatatgaagcagaaatgattaaattgtataactatatttgtgaatcattattctcatttagtgtgccttataataagtattttcagcataaagccaaaggttactttatagtgttcccagcaaattaggcctttgtatcaataaacaccctctaagaaaagctaaaatatcatactttgctttgtgacttgagagaaatttgctttcatacatatccttaagggtaaaatccttatcactctgttgttttcgggcattttatctagacttaggattatctggttgccatcatgataagtatggacaacatctaagtgtatgaaggaaatgttctaaagtaaaaacaatccaagaatttcttgaagcaaatgcacattccttgttagtagtgtttcaggaatctttttcatattttgcactaggctgccacctgatggcaaaagttaaaattgcatcttttgtaacattcgacgccttcattgcaattatacagatttttatgtattcagcatagagcctccaaaacttttatacatttgtgtaagtgttatgtattcaataaatgtttgatgattgctttggacctcagggaaatcatatttattatttaacctttgttagacagtgatcttcctacgatctgtttaaagctttgctttcttatggagctattttaagaatctgttttaattagtgttattaatgaaaaattttacttaaatgtagtaattttctcttttctctttccctcttctttcttcagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagtatgtataaagagtgtgtttgtttaaaagaacaaacttaggtataccactagctaatcctgttgcagtacagacccaacctctaattatattactctaatataattagaaaaataattaacaaaaatactaattcattcggtcagcaaaaatatattagatgtttactatatgctaggtactataggaaatcaaaacaaagtaaaattctcattctcaaggaaagccataaactatgttcagataagtaaacaaattgcaatacaatgcgataaagactggaatggaagaataaataacttactgtagtttatgatttgtttttgaacatggaatgccctcagtctgaaacactctctctcgtctgctttgtaaacacctgttcctcctctttaaaagtcagtttaagtgttactttctccaagaagcctttctttatttttcctagcatagtcagctattcatcttaatctttttttaccctatataaactaccattatagcagttatcacactgtattataataatgtgcttaggtgtccatattcttcacttccaagcataattactggtctatagtagacttaatgtttctgggatgaatgaataaatacttgactaaatgaaaagtgtcatgaaaagacaaaggagaaggagtggctgactctgcttgattgcatcaagaagacttctcctttcatttatttcatctaatatttgttaaaatcaagtgccatttcaatcagaaaacatagataattctttaggaataattctttaggaattattttaggattttttctatgtattaataaaaagacaagaggggctgaattaaaaagtcaaaaaatcaaaaatatctgtactcagatattttagtaaaggataaataccatgattagaccttgaaagaaattaaacaatgaactggtaatcctgaatgtgaatgtaaattctaatcccagctctttcactaactagctatataattgtctgcaaccagactatagtggattcttgtttatgaggtaagtatgttaaactagattatctcttgatcttttcccagtctaaaattctgtgatggagagggaagtgtagattaggtcactaacattttatactctatcagcatgtcactagaaccttaaaattgtatttggaaaagtgtatggatgtgtaatattcaattggtaagtagggaaggccattttcaggtgtgaggaatggtgaattcaaagaatgatatgtagagtaacttcagatgaacaaataaaggggaaaaggggagagttgttgacagtgatcttttttacctaaactatagcaatacccccaatgtgagaaattagaatatatgaccaagatattagacatatttttataaatctaatttgaaaagaaaattaataatcagagagtagataggagctcagttaaaaatggcccttttgtgctcaccaaatatgtgtgttttatttctgtttacattgttcttgccctctgagagctataaaacatttgtttctttttttttttttttgagacagagtcttgctctgtcacccaggctagagtgcagtggcacgatctcggctcactgccagctccacctcccaggttcacaccattctcctacctcagcctcccaagtagctaggactacaggcgcccgccaccacgtccggttaattttttgtagttttagtagagacggggtttcaccgtgttagccaggatggtctcagtctcctgacctcatgatccgcctgcctcggcctcccaaaacatttgtttcttattatgataattgcttagataaattgtttgtatctttatataaatgttgatccattcccgcttttacatagttctaacatagtgatttctaggtaataaaattagtgaatataatttttcacttagtttctttgctgttacatattttcatgactctaaaaaacaaaataaatactttcctacattataatttgcaaacttataagaaagatgttctgctggatcaccacattcctttaattttaaaaaatactggccagacgtggtggctcacacctgtaatcccagcactttgggaggccaggacagaagaattgcttgagttccagaccagcctaggcatcatagtgtgagacactgactctactaaaataaaataaaataaaaataactggatatggtggcacacgcctgtagccccagctactcgggatgctgaggcaggaggatcacttgagccctggagttcaagactgcagtgggctatgttcatgccactgtactccagcctgggcgatggagcaagaccctgtcttaaaaaaaaaaacaaaaacaaaaaactaaaacaaaaggcagatagttggaataaaattcatccagcttgaaaagtgtggaatccagtggagcttcattaaaaatttagaacacaggtatatgaaccttaaaatcagttcttagggattaacagttcttaaaatcagttcttaggaatgcataatattaagcaccacatcccaggtccaggaacaatttttgtcatctttatattcacacttaatttttctgtgtctcttgacctcaaagataagtgtattcctcctgaaagacttccacatttttggtgacaccagtttccacattggtcatggtgaatagcttaagactgactctgaaaggcacatgaaattgcagttcttcagttaagcctaataataaagtgaatgtggatttacccaaaaattgcattatcactatattgcgaggaaggagagggaacagtgagccatgtgaatgtgttaaaatcctcataataatcctcattaaatttatcataatcatcagtcagtgaataatatctaaaattgagtaatcaagatataacactatacacatattagtttattttttttttttaatttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttccattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttagagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgagtttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattacttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagatgtccttcacatcccttgtaagttggattcctaggtattttattctctttgaagcaattgtgaatgggagttcactcatgatttggctctctgtttgtctgttgttggtgtgtaagaatgcttgtgatttttgcacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggttggccagtattttattgaggatttttgcatcaatgttcatcaaggatattggtctaaaattctccttttttggttgtgtctctgcccggctttggtatcagaatgatgctggcctcataaaatgagttagggaggattccctcttttctattgattgggatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagagtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacgctgctttgaatgcgtcccagagattctggtatgtggtgtctttgttctcgttggtttcaaagaacatctttatttctgccttcatttcgttatgtacccagtagtcattcaggagcaggttgttcagtttccatggagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatactctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttacatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttccagttgatcacatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgctgtgtgaggtgtcagtgtgccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgccccctcccccagcctcgttgccgccttgccgtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccccggattattcttattacacatattagtttaatacatggaggctaagtagaagaagtagctacaaattttgaaaatgttcggtctctagggatggaaagagaaggtggccaggggactttttttttttttagaatagcattctcacaatgactagtattactttgtttaaaaattttttaagtaaaataaatattatggcttaatacatagtagttcctcttcccaaaaatttcacattctttaaatacatatatttaaagagctgatttccttgagattaataatgagcaaatctatgaattatatagttctgctctattggcaatttgtgtacttaagacttttgtgtagctaaaactggactggactcctaaatcctgggtgctagtacctgcaagtattacttgagcaccgtcttccccatgtaaaaatagaacatttcttaaattcaaccacggttgtgaaatccaagcttaatttcattcacatcaaaaagcaaggcaaaactttcttcaaatacagggtaaggcaaatggagaataaaagtacaaataacacagtgaataaatctgctaatcttttctgatattagctattaagtctactgtacctgttagaatgtaatctcaatcaatcaaggatcttaaccagcttatatttctgggccctagaagaaagcctggtatacagtatggcagtgaaatatatttgttaatgattactcaaattcagtaatacttcatactggatattataccatttaagaaaaaactaaattggtagaaatcattctaaaatataatgtgtacttccctgcaaaataaagtacaactttcctcttgagcctgtgcttattcgtaggacatgtgtgagtcttgtttgtaggacatatgctcattggtatgcctatttatgagaaatgtgatagaaaacatactcaatttctttattatttctcaggcctactactactgtgccataatagaggatgtgattctgcgctttgcttggactatccaaatctcgattacctctacaactttgttgcctcattctggggacatcattgctactgtctttgccccacttgaggttttccggtaagcaaactactgaaaagtttattaaagattctttttaacctaaaagacacccaatacttacaaattagaatttattataacttgtacttgaaaacctttaattttccaacttttctcaaatttctcctcagccttagaattggaaaaccatgttggccaggctgatctcgaactcttgacctcagttgatccacccacctcggcctcccaaagtgctgggattacaggcgtgagctactgtgcccggcccagaggttaattcttacaaagttaaaataaccattgatgatgacttaaaagcttctttagaacggggttccattgaaaggataagtggaaattgggaggtaaaatggcttaaaacagaaatcaatcattttttgcaatttggcagtctgagttattcagcccagccttctcactgaaaacaataaaaatgctagataaaatgtgtttaaatctggccaggtgcactggctcactcctgtaatcccaacactttgggaggccgaggccggtggatcacctgaggtcaggagttcaagaccaacctggccaacatggtgaaacgctgtctctgctaaaaatacaaaaattagctgggcatggtggtgggcacctgtaatcccagctactcgggaggctgaggcaggagaatcgcttgaatccaggaggcagaggttgcagtgagccaagactgcactgttgcactccaacctgggcaacaagagcaaaactccgtctcaaaaaaaaaagtgtttaaatattctaaaaaaaaatcagacaagataatccaaaatctaaatgaaaacaggagccccaagataaacagagcactaacactacctttgcactatagaaatttgccaaatctgtagactttgaaattcacttgtgactgccaattaaaatttgtatgcacctaataaaatgccttaaaattttgtaaagcaaaagctggcgttgctacaagtaaatttacaatttcagattttaacatatttccttcagtgatagataaataacgggtcagttaattaattaaacctgaatgacatacgtagagaactgcatccaactactaaatacatattcttttaaatacatgtagaacatttaccaaaattaaccttacactgtgccataaaggaagtctcaacaaattgcagggattataatcacaaaaagataactcaaaagtcccaaatgtttagaaattaagcagtacatgtctgataaccccaggtcaaaattgtaatgcaaattttaaaatattttgagtagccaggcatgatggtttatgcctgtaatcccagcattttggaaggccaaagtgggcagatcacttgaactcaggggtttgacactggcctgggcaacatggcaaaacacatctctacaaaaaatacaaaaattagctgggcatggtggtgcgcgcctgtagtcccaggtactcaggaggctgaggtgtaagggtcacttgagcctgggaggcagaggttgcagtgagtcaagatcatgccactgcactccagcctgggtgacagagcaagactccgtctcaaaaaaaaaaaaaaaaaaaatttttttttgaacagaatgtaattgaaaatgtgataaaagagaaaaatgtaaaatgcagctagggccatgcttacaaggaaatgtgtaactttacatgtatatatcagaaaagtatatagctcaggaaataagaaagatttaaaaaacagcaaatcccaaaagaaagtagaagtaaatataaagaacgtaaattaatggaacagaaaacaaacacacaatacagaaaattattaatgataaagccaaacttaatttccttaaaatgccaaatactgttgataaagtacttaagactgataaagcaaaaaagaaaaggaagtacaaattatgaatatcaaaaaacctaaagacatttatttaaagagtaagactatcttatgagcaactttatatcaataaatttaaaaatttagatgaatggacaaattactgaaaaagcagtgtgccaaaaccaataaagaagaaatagaaaatctgtattaaagaaattaaattcatgttaaaatactttgcacaaagaaaacgccaggcccaggaattctttcaaatatttgaggaagaaatattaaccaattttatacaaaactcttccagaaaaaaaaagagcataaaaggaaacactttctagtttgttctctgcagccagcataactttgatatataagcctacaatgacattttaataaaaactaatctgtctcatgtacacagttgtaaaaatcctgaatgaaatattagcatatgaattcaacaatatataaaaagggtaatacaagttaggttcgttctaggaatgtaagatttaacattcaaaaatcaatcagggccaggcacggtggttcacacctgtaatcccagcactttgggaggctgaggtgagtggatcatttgaggtcaggagttcaagaccagcctggccaacatggtgaaaccccatctctactaaaaatagaaaaattagccgggagtagtggcgcatgcctgtagtcccagctactcaggaggctgagttgggagaattgcttgaacccaggaggaagaggttgcagtgagccaagattgcaccactgtactgcagcctgggcaacagagggagaccctgtctcaaaaaaaaaaaaagaaagaaacctgtctcacttatattaacagaataaagggggaaaaagaacctctatatttgtagaaaaggccattgataaaagtcaatacctgttcatgaaaaaaatgttttctacaaaaacacaatcaagaacatatttaacagtgaaacactataaactttcccttgaaatcaggaatgagacaagtgtgtctgctgttcccacttttatttaatatcatcaaagtatagctagcgcaatgaggaaaaagaactatcataattggaaaggaaaaaataaaactataattattcactgatgacagttacacagaaaattcaaaatagtttacaaataattagatctaatgtcacagttctgaatacatggtcaacataatataaatcagtcatttttaaaaacagtcataacaactagaaaaagaacattttaaaaaccatatcattttgaatagcatcagaatatatcagatatatacctaggaataggtttaattaaagctgtgtagacgtgagaaaatcgacaagccagttctgtaatttatatgggaatatgaaaggtcaagaatggccaagactatcctgaaaagaacaaagttaaaagacttatactgtcagatatcaaaattgattatatagttacagtgagtaagacagtatatggtgttggtgaaaggatagacaatccactggaacagaatagggagtacagaaagaaatccactcgtgcataccttgatacttcttgatttatgacaaaggtggctacataacagtggaaaaagagggcctttaataaatgatattgagtcaactggatatccatatggaaaaaaatggttcccagctcctactgtatactgtgtgtgaaatcaattccaggtggattgtagaactaagtatgaagagtaaatcaatgaactctctggaagttaacataggaaagaaccctaaaggtggttttcagtgtatggtaatgtatttcatatttctggatggtaattacacagtgagtccctttatgataattaagctgtacattttttatttgcatactttatgtgtgatatacttctgttgaaatgcttatcttaaaaaaaaaaggcaaattagccaagagaaagaaggactaactttcaacagcaacagtgaaagtcagaaattattaaaatgaaatctttaatgtgctgaaagaaaataactgcttacctagactctgcccagtgtagatatctttcacaaataagacgatataaagatattttcagataggtgtataacattcgtctaagtcaagatcgacaaacactgcctgttaaaataagacagaagctggaaacggaagataaacctgagagagaaagcatgactctggaatccacctgccatcagagctctctccagaccagtgctccttcccttcctcaccttcctgaatgcctcggcctggcacctgaactccccatcgctgctgccaccttcccccacccacttctttctctttcatgtgtgctacttcatcaattttttaaaagaaattctagtaaaaaaagaaaaatacctcatgacgattttctttttaaaatcatttgcttactaactaaatcaaatgttctatcccatttaaaacaaacaaaaaaaccatctttagatcagctttctctctccaactactgcccatctttctgctgtcctttatagcaaaactcttcaagaggcgtctgcacttgctgtctccactctcacttctctcccattctctttttcattcaagtatgtattcccaatactcaaactaaaccacttttgttaataatctataataataatattgtagtgcctactatgtagctgacagcgttctaagccttttacctttattaaatcctcacaacaatcttaggaagtaggtgctgttatcatgtcttttactgatgacactgaagcataggttaagtaactcatccaaggtcattacagctagcaagtggtagagccatgatttgaatctagacagtctcccagagcctgtgcttttagatcgtactgcccattttgctaaatccccttgtcagttctctgtacttatttaccttactttacttcccagcaaagcactttcttcacttgacttctcagaaactacagtctcctgtctcactagctattccttgtccactcctttactggttcttcctcctccccccaaacttttaagtgttagagtgttccaggatttaatcttctgccctcttgtctcctctagttgtattattcctaaacctattatgtgaaatactgtctttatgctatctccagccataaactttcccttgaactgcagactctcgtccacctctctactgaattctcccatatctaatgattagctctaacctaacaggaacagccctgcatctctgatcttagtaaatggtgtcacctttcccttagaccaaaaaccctaagacgactcacatcgcatgtcagtaagtcctgtcagctccatctttataaataaatcctttgtctgtctgcttctcatcacttctgttattaccacctttaagtcaccatcatctcttttctggactgctgcaacagcccttctaattggtctgtcttcagctgttcttgtctccctttgatctcttcaccattcagcaggacctttttcaaacaaatcacttcattctcctgttgttctctcattgttctccattagacctaaaatttaaactatgggttataaggccctctgtgggtgggccctcttccacccctccatcattatctcctgctattttaacctcacttattcttagcccccactgaccttgctgttgtttccaacttgcctttttatacttgccattttcctctgcctgggatgctttcctccaggatttttacatgacttgcttctttgtatcagtcaggttttcaatagctgccatgtcttcaaagaagctttccctaaccagtcttaatgatggcatactctattcccttgtcctgctttattttcttcacagtagttatcattagccgattgattgtttacttgctcattgtctgtctccaccactagaaattacaccccataagggcaaaaaggctttgagtcattctgtgcctttactgccttatggcagacattcagtaaatatttgtcaaataagttgaaagaatgagcactctaaaactgcattgcataagtccctccctttttcatagtctagtcttgtttcccttacccccccaccaccacctccccgcaacaccatctttccctattttaatattcaagcccttaattctttgtttttgtttccatgagtggaaacttgatacactgggaggtttacaggtagcagaagtatgttacaatttcataagtactttgatctaccccattttgctaaggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcagtatgtatggcttctacttctgtgaggcatatttcctttgagttttagcattgggtagcatgtaagctaaaaagctatcaggttgaaccaaatgaaattgccaatactcagccatttttcacctacaaaaaaacagtaataagcagcaattccatatgatacaacctatgactgtctaaatgagcacatagagtaaatgtcatcaatgcataacctagtaatttggcactaaagatccactgtctggaggaaaaggttgttggagagtgatttattaatacttgactcttctgtgtgttgtgtatgcaaataatttttatgttataaactttaggaatcctgccatctatgccttgaccaaatgacttaatttctgttttctgcccccatctgtaaattgaaattaatatggttcttgcttatagggaggttaagtggattatattcattattacatagaacttggaccagttccctcacagaaagagcctactaagaataaactattactatttttatcttcttattaaatacctacaacaatatttttatcagtcattgactacgtatgttgctaaaagttaccataaatgtacagtatatggtgactgcatatgaaatttagagacaatagatagcacagtagattggaatgaaggaggcttaggttgaggatgaacggttttctaaaggataagggagtgaatagactagagacacagtaaagaacataaaggtagaaatgaagtgcagaaagaaaaaccatgtgactagaattatagtaagaataattttgctgaatagatgaagtatgattgtaaaaggctgaaaatgcaaacttgatcttgtaggcaggaatgagtcacagataattttttttttttgagatggagtctcgctctgttgcccaggctggagtgcagtggtgcaatctccactcactgcaagctgcacctcctgggttcacgccattctcctgcctcagcctcccgagtagctgggactacaggcgtccgctaccacacgcagctaattttttgtgtttttggtagagatggggtttcaccatgttagccaggatggtctcgatctcctgacctcgtgatccgcccgcattggcctcccaaagtgctggcattacaggcatgagccaccgcacccagccacgagtcacagagaatttttctgtagaagaatgacattgtgaaagtagtatcctaggaagttttaatagcactgtgtaagatatattaggcaagggaaaaactgaaggccagaaagccagatgaaaagctatgcagtacttcaatgtatggggcagtgaaaattcagatcaggatgcttactgttggaccagaaggaacataaggagatgttttgaaggaagtaagaaacaggaggtagtatcagtaactcattggatatagaggagtagagtagaacctgctgaactttaaatagagatttggaagttctctgaagaaggcagagaaaagcagagagcagggaactgagtcttaatccctggctcaaccatagtagccagggaacaaacacagacaagagaaaaaaagaaaataaacaaaagaggtaggaatagtcagggaggtaataggaagagcatcaaaacaaagcatggttggtgctgtgatcccaaggaagcagagtttgaagaagctggggcaggggagcactgagtgggtcagtgagataagtgccacaaagggctggaagaaaatgctaagtgtgattggtgacctcattgagctcctgattttgaagtctaattatccttgttagttaccagcagagggcaatctaaacatatactatttctgcttaaagaaggggctctttggcaatagattattctgttccatttcaggtgtttaacggagaaactctgggaaaccagattgcaccaagagtaagacattaggaatggaacagttggtgtacagcggagagagcagggaatccaaaataagatctgagtttcagtactgactttatcactcatgcaacctttagcatatccttaatgtgtgtggtttttttgtttgtttgtttttttgaaacagtatctcgctccgttgcccaggttggctcaatgcagcagcacgatcatgactcactgcagcttcaacctcctgggttcaagcactcctcccacctcagcctcccaagtagttggcactacacgcctgcacccctctgcccagctaattttttattttttatagagacagggtcttactatgttgcccaggctagtctcaaactcctagcctgaagaagtcttccctccttggcctcccaaagtgctgggattacaggcaagagccaccacactcagccacctgattttattgttggtatttatagtggtaaatggtttatgttgggctgaaatgtgcttcactgtaatttcactataactttaacaatttgatcctatttgggctctctcacataacttataatgagtctcctccctcttctgcattgtatgttgtcaactctttgaagagaaataactgttatgcctctccttaggtcttctcttctgctggctaactcttttggtttctcatgtatgcctcaagtggtgttttatcttatcctcatcatccttatcacaatttcttatatttgttttttgggggttggttgtttttttttggagacatggtctcagtctgtcacctaggctggagtgcagtggtgtgatcataccttactgcagccttgaactcctgggctgaaatgatcctccttcctcagcttcctgagtagctggggctacaggtttgcactatcatacctggctttttttttttttttttttttttaagacagggtctcactgtgatgctcagactggtctcaaactgccgggctaaggcgatcctcttatgtcagcctcccaaggagctgggattacaggaaccagccagtttcttaagtttgtttaatgcttttttcatccatgttctcacttgatatgcatactgtctccatgaggtgaaagtggtattcagtgaaatcggtgttaccattcctgccttacagagatggaaacgggcactcaaagggttaaatagatgcatcataaaatcaaagtcaggtggccaggtgcagtgactcacacctgtaaacctaacactttgggaggccaaggcgggcagattacctgaggtcaggagtttgagaccagcctggccaacatggtgaaagcccatctctactaaaaatacaaaacttcgccaagcgtggtggcacatgcctgtaatcccagctactcaggaggctgaggcaggagaattgcttgagcctgggaaacggaggttgcagtgagctgagattatgccactgcactccagcctggcgacagagcgagactctgtctcaaaaaaaaaaaaaaaaaatcaaagtcagtactcaaacccagatcactaccttctgcgttgcacataccctgccattgttcttgttaccttcctctggttgtgatctagtttcttagtgtttttccaatagtatctgaaattgaataggaaactctagaataatccgtctggtacagcagatagtccctgtttaggatgtatgtttaatgatggtaagactggaaatgtgtctaatactgtgaaagtgtttatatttgggtaatggactaagtgctttttgtcccccttgttaccactagatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcataacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgtatccagagacatttgaattattaactttattctttattagtgaatctctatgatggcacacataaaatcttacagttgacttctgctgtttgaattccccagtgtttttacattaatgtatcctatggccagtttagtctttcttcaactgttacagttctaggccctaatcggtcttattctttcacatatgatgcaatgatagatgtaatccttttctgaagtgtttgtcggattggcatagtctattcaaaaataaggcttatgtaactttcagcttgctatgtgacagaagtttaaatgtgtatttaagtacacagctttatgttcctcttaaagctgtaaagagaaaagaggacttttcctcatcaagagagcttgggagacaaagcatacatttaatttttttctttcaaaaaaggcaatgtgcactttcctctcctaaattttatatgccctagcagttgcgaatgttgtgtccaccttacaatttgattggaggctcccatacactgaaactctcaatagaattcttaaaaatgaacatcagctgggcgcagtggctcacgtctgtaatcccagcactttgggaggccaaggtgggcagatcacgagctcaggagttcgagaccagcctgaccaacatggtgaaaccccgtctctactaaaaatacaaaaattagctgggcgtggtggcgcatgcctgtaatcccagctactcaggagactgaggcaggagaattgcttaaacctgggaagcagaggttgcagtgagactagatcatgccactgcactccactgccactgcctgggcaacagagcaagactccatctcaaaaacaaacaaaaaaaatcacagactcattttaaaggagcagcaacctaaccaaatacaaacttcatttgattttaggtttagaaattctagttttattttggagaatcactcagtttttaatatcaattaaaatagtcctcaaaggaatgaagaggaagtctaaataaatgaataaaactcatttttcattttatggtagtatagaaagcattgatgtgtgtagagaaattaaaagacaagagtggtttactgtctatgcacaaatgagtgcctatatttaaggctgcctataccattacagtggcgtaattggtgatttcatagcatacagagaaacaatgaaatcaaagattaaatcattaggttatgatggtcatttgtaagattggaaagtagtcaaaaacccatgtgcaactttttttcagcactctaccattaggctccttaggcaagctgcttaacttccgtcagaagcaaaggtgtgggagaacaccattcacctcagtagtaacttataaaaaccgtttaaagaaggaaaatgggccccagcccctaggatccctgacttcctgatattctaaacatgagagttctgtgactttaactgagctctttaccagaagtaacgtgttgatgtatattatctttccaccatgctttgaccaaagtacattcacagtaactagagaaagcagatcatccatttctggataggtgaactacggcaaggtaagaacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtgggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagttacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttattttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaatttctctctgttttccaacagtttgctgactcctttgtcactggtgaatggtttgtgtgactgtttttctctcttggtttcttgaattcctgaacatagttccccttaggactaattttcatatggggttagggcaaacagactacagtggtgaaatttttaaactatcctactaagttaaaagaagtttaaatggcttttatcttcaggtaatatgtgaggtgtgactctaaagcaatgggattgttgtaacaaatctttcttttactcgcacaaagaatctcaaatattacaaatatgaggtgaaatgatgtgtccaattacattttggagaggtggacactgctatcactgcatacccatgccctgtgagggaacataggacttttctgcagaattcctggactaattattattccttatatatatctaggaaagattacaaaattaactgaccctaagatgaatatacccacaatgcaaagggaaaaataatttattgactaaagcatcaaagcctttcatcttactttggtgccacaaactctgttattactatatttctgtgtaggctaaatcagaatatgataatatggagtttccaggccaaagtcaaagataggatatgaatatataagaatcactagatactcaacaccacttttacaatttgataatacatactcaacatttgtatgcctatagtattttatatttttccaaatatgtagcatctcagaaatatgtagattaatgagtcatctcagtttgttgaagagacaaagacctcactagagcagcagtccacaatccccggtggttctaggaagccactctgtcttgtatccatcctagacatatccagaagaatccttagagttttagtgacctgcatctttatatggataacttttagtcgatattttttaaggttatgggaataatgacctattttatactttatttcttaagagatggggtctttttctatgttgcccaggctggcctcaaactcctgggcacaagtgatccccaaatagctgggagtacaggcatgcaccaccatgcctggcttatactttttgattgacttctttttctagtgtcccaccttttcccttagaagaattgtggagttcctgtattcttaaaaattaatatgtgtttattgagtatgtgttaatcctatcatatgctaggcattactttaatacttttagttgaagttggttttattatcgttagttttatggagacaagaagggaaaggtgataaaattatttctaaactacatacttatctgaaaccactgccagaaaagctagaccgtcctcttactaggtatcactgcctcagggtaatctgaattttctatctcaagttagagattactcttcaccccttcccaagcagatattaaagtctcttattctgtttttttcctttaaaaagtatcagatctgtcaagagttgtttcttcagaatcttctattgccaaaaactgttcttataatctattttatcattcactcactttgtcactgattaacatattagcaccaaagttcaaccaatgcttacctttataaaatgaaaatttccccttatttaaataaattttatattaattgcttagctgaatgggaatgatagtaatagtattctgccttgctctacctagagcacacctatggcttccattctacctatgtgaataatcaaagtcaaggtatgatatttggcgatacatgtactatgctactctgcttccttatggtcagtttctaggttaaggagaaaaccaagtaactcaagagaacaggcaggtaacagaagagaaccaaggagaagcatattaatactaattcccaaaccctctccccttttactaaatttcaaattatcatgtattctaaatatcacaatattttatgttgtgtggttgaagtaaacaaatttgcttatttgtggttactcaaagcctgtcttctgactagatgggccaatacagtttttaaagttcagttaatcagggcttttgtatccctttggcaaggaaatacacaagataatttagaaacatcagttcttcaaatattattcctgtcgactgttggatttaaactttttttctacactttcatagataccgtaggaaattttagcccctccctaggcagccgtggtcaaaagacttgccgggctggatgtgtgcctgctgctagctattgaccgtccatgaggacatagcctggtttccttctgtggcaatgccctagtcttaaccagcctgcaaccctaataggaacacagttcagaggaaaggagacatcctttttccaaaggtgctccactgtcagcaggaggtcacacaaaatcatattgactaaatgttttaatgcctggtaaatagttggggcctaaggaatatttgttaaactgaaaggtaacttcaggagtctatcagtagatgagctgctgagtaaatttaggaggttatcagcttttttgatcaactgctgcctctaactggtgcttcatcactggtggacttgccaggctcctcactttgatccttgtgtgaagtcaggttgtttgaaaacttgattccaatgctgccctcaccagtactgcaatagcaggtgcttcttcattctgtggactttgttttatcccagggtcagtgtaatcacagctgacccttcctggctgctgcaggggagacacatctcacattagtgcatgtcgtgtggtgcccatcccgtgtatagaggagaaaagtaactggctctggacaccaacaattactgaacctggaggaggacccaaatctaactagctccgtagcccacatactctctcccttgaaaaaagaaggaagggggaatttttttttttttttttttcctgcttggcagacaagactaggaagtgccttgtgaattactccctttttttttttttttttttttttttttttttgaaacggagtctcggctcactgcaggctctgcctcccaggttcacacaattctcctgcctcagcctccgaagtagctgggactacaggtgcccgccaccacgcccggctaatttttttgtatttttagtagagatggggtttcaccgtgttaagccaggatggtctcaatctcctgacctcgtgatccgcccacctcggcctcccaaagtgctgagattacaggtgtgagccactgcgcccggccgaattactgcttctttctaaagttatgcctgcttgagtctgaatataaccattttaaagaaaatcaaagaacatccccctccctcccacaaatgcataaatataggtttctctaaaagcctgggtcgcactgactacggctttttggaaatttgtcctctgtccctccatggaagacaaatctagcattttgtaaaaaattaaacagtaacaacaaacaactccctattggctgcttttcacaggatgcctctcccttgaagcagccaccctctttccctaagcgcttattttccctcccctcccctccccttccttccggttgttaaaactttcaccagtgagaggatggtgtactgcagtaaggcaagcacttgcagtgtgtcaggcatttgagatatagggaggagacagtaactatggggcaatgagggtggatggctattgctaagtgccactgatgcctcaagaaggataatgaacatcagagagcaagtaccaggcaactggaagccagatgtggaagcccgaggaccactagttgcatacagagaatctctcatctgcagtggaagggaagagaaagtgaggactaagcccagggcttaatagagtggcagaatttcagacagttaaaacacccaaccaaggcaggtctgatatgtaaggtcaaggacccaattgggaaaacctaacacatgagatggcaatatctgcttggatcccccccaaagacttttacttcctgaacccctcagaacattctgaacctatacatatgcctcccccattccttgctagcactctccattcccaatattacactggcccttcttgtgcaagacaatgtatgcacctttcagagtcctctatgactcagctggggacatgctgggcttgctaagggagaatagggactatactgaactgtaagatgtagtcagcatggactgacaggagctggaggagattctgagagcacttgaagagggggaccagaacataaggtagaagagaggacaatttttgacttgaaagggtttttctaagatacagaatttaactccctagcataagtatcccaggtgttggtgtaaacttgctgctagcatggcttctagaaagctggaaaaagtgatggcccatgttgaacaaagttaaaattccagaatttctatgggagacaatggaggaagggaaggaaaggagaggaaaggagggagggagaccatattgtggggagacagaggaatatagactattgccacatcctatgcctcttctctccactcttgtttaattgaccacttgggcccctgaagaaactggatgggttagggagggtcattgtagaccatcacaagctcaatcaagtataatcccaattgcatgctgccagatgtatcttcattagaccagatctatactgccttaagtatatgggtatacagctgttgatttagtgcaggcattcttttctcttccagtcagaatcagaaacagttcacattttcatggaaatgataatacacattaacagttttgctccaaggccatgctaagtccaaagaagtgtggaccagctggacatccacagaacatcacattgatccattacaacaatgccaccatgttgattgggctggatgagcaagaagtggctagcacactgcagaccttggtaagatatgtgtttccccgagggttggagattatcctgagtagattcaggagcctgctacatctgtaatattttcaggagttcagtaatcaagtccagtagccgtagacatcttctccaaagtaaaagacaaattatcgcaccttgtacctcctaaggaagaagaaagcagagtgcctggaagcctcagtttcttaagtcagcatattctgcacctggggatactactacaactcatatcaggtgacatgacagactgccatttttgagtgggtcccagagcaggaaagggctctgcaaccagcccagggtatcaagcaagcaatcctgtggcttaggctgtatgatctgacagactctatggcagtatcagtggtgggaaaagatattgtgcagagtttgtggcaagccccagtgggtatcagaatgcaagccgctgaggctctagagaaagaccccgccatcttcagtgaagaattgcatacctttgaaaaacaactcctaccctgctagcgagccctggtagaggagaaagagtgtctgaccatggtcaccatggacaatgtggctagaactgtccaaaaagtactgtgtcctatcaagcccaataagtcagatggccccagcaacaatccattgtaagatggatgtggtacctccagaaatgagcacaagtggggtcagaggacacaagcaggctgcatgagcagaaaacccagaccccctgtcatctgctacattgtaccacagctcccctttcagagcacacctgtggctgtacgggggatcctataagaccagttgaaagaggaggggaaagcctgagcttgtttcatggatgggtcagctccacatacggatgcaagctgaaatcagatggtagctacactgcagcctcacaagggtagtcttgaaagacagtagtgaaggaaaagcttcctaatgatcagagctttgagtagtgcacctggtcacccacttagtgtgggaaagagaagtgatctaaggttagaatatatagtggaaaatggcctggcccagatggtcagaaaaaacagatcagggataaggaggctggggcagaggcacatgaatggacctaagggagcgggcaaatctttgtatcacatgttaacaaccaccaaagagcatccaccattgacaactaaacagccaggcagtcgggtgactcagcctaccaacttcagccagccaggctcgccagtgttggcatgatggcaacatgaacaaagtggcagagatggaggctcttcttgtatgggccaacagcatggagtctcaatcaagataatttgtctgctgcttcaaggcccaaactacctgcaacagagaccaacactgagtccccaatatggcacccattcctcaagaaaaccagctacttgatggcaagttggcaaaatggggcttttccgtcctggaaggcccagtagtttgttcttacaggaataggcacatatggagggtatgggtttccctttcctaaccatagagtctcaactagcaccaccatccaaaggctcagagagtgtttgatccgctagcgtgagattccatatatcaccttagaccagaggatcaacttcacagcaaaggaggagtgggagagaacccaagaccatgggattcattaatggtagcgcataatgcatcacctagaagctgccaacctgaatgagcattggaatggtatgctgaagacatagctaaagtgccagatcaaaggcaatactccgtgagcatgggtgacatcctccaggattcagtaatgcattggatcaaagactcatacatgctactgtcccctaaggacacatgggaagaaggaatgaaggaagagagggagggagggagaaaggaaaggaaggaaaggaaaggaaaggaaggaaggagggagggagggaggggggaggaagggagggaaagaaatgaaaaggaaagaggctacctttttggtgatttgtaaggatctagcagccataatcgtcaccgctgctctcctaggagacagagacaagtctcctgggcccagctcccacggctgctaccacagtggaatggggcattggtggagaggtctaagggacagaaatggattggagaggtgattctgtgtgaacagcatattggagagaaaagtgaacacccatgaacctttcagatgcagctgctgaatgagggttgtgggcccagtggggcagggcgttacacatacaatataaaaccagagctctgaagagcttgaaaaaccctcagtgtgtgtcactcgggaaggcttctaagcaatttgtggaagacacattggggatccctgagcccactggccccccagggctctgctctgctcggcacagtaaaggtggcacccagcaccccgtctcagctcgtggacacccttccctaatatgctgtgacaagaaccactatgttgcagccacttaagacattaaacacccactctgcatgcaacccccgtcgtccccaggggctccttgggagagcagctgcctcagcagaccctcacctccttccggccccttcacccctccatgcccctttttttttttttttttttttttttttttgagacggagtcttgctctgtctcccaggctggagtgcagtggtgcgatctaggctcactgcaagctctgcctcccgagttcatgccattctgcctcagcctcccaagtagctgggaccacacgcgcccaccaccacgcctggctaattttttttgtatttttttaatagagatggggtttcaccatgttagccaggatggtcttgatcttccgacatcgtgatctgcctgcctcagcctcccaaagtgctgggattacaggcatgagccaccgcgcccggaaccatgacacttttaaactggttttgcagctgatttcctgagtcaacagctccttaccatttcattgccaactgacccttttatcacttccctgaaccctatgtttttaaagattttgtctaattagccagccatatttattgcataataattcttgtccccatgacaaccaatgttatcaaactgagttgatacaacgccagtcagaagcaaagacatttctcatggcaaacatataatttccattagacttctttaaatgttggaaatcgcttctgcccttcttcccattaggcatccagggaccctggggtgggaatttctttctgagggttacctttgagtgcccaccaaatctccatggttctcccttttcacagatgggcaaaccaagctgttttgacatgagttagcttaaattgacaaagaatcagagtggaaacagattttttaaatctccccctttttggtccctaactcctcagagcactattgtttccaaaaaataaaaataagaaagctgcaatcagctgccaccattccctgagggagccttctctgggcgccgcctggcccttcccccaggatcttgggaatcgctggccagcagctgcctcagctccctgcagctagagtgtggagtaacgtggcagacagagcctgagaggttatctggtctaggctgtcccaagggtgtttcctgggatgctaattgctattttgagggaaaaggcttctgtggtcatttacttatgagaaagacagagttaaacaaaggtaaactggttgagtttagtttttgttttgtttttacttcaggccttcccagagcctttaaaatgcctttggtcccaagtctctgacaggagggtgaggtggctccattatctccacacttattggacctgaatgctctttttcataggaaagctatgaacaagaggaacgtggtttggaaatgtttgtcccagccaccatgtccagatgaggaaacagaattccatggaagtggaatgaccagcacttggtcccacagctggatgtggcccagccagggctgaagccagacggtggagtctcagcctggactgttcagacttgggtctttccctccatccttcacccaccacacaccttgatttaacccaggaaaaaactttccagtggaccacagaaatggagcagattctgctcggatagagactgcttctgaggttcatctgtgtcttcagcagaatcccccaggctggtggaggcaggagggagcgaggaggcaggagtccccacggacatggctgcacagcctggggccacagggcttccaagagggagccagtctgcagcagaaaagcccagagggcagcttccgcacacacacaagcacagcccccacccccgacactgcagacagggcctcttccggaaggcgctcccccaagctcatgtcccacagcctgggcttgttggaggccatctggcctgcagatgctggtgagcctccatggtgtctgtccccactgtggcagggacaaagtccccaagaggaagagaggacctgactgctcttcagagcttgacacacagcacccccagccagaagctgacctcccacttgtttgaggcagtgttcaaggggctgtccacagcaagagagatgggactgggctccatctccaaagaggcctccctgagccagcacagaggaaggacaaagaaaagattgaaaaaagcagagttggggctctctggtgccattgcgctgcctccattcagctaagatgccctgcctctccttccacctaaagcagcttctgccacttaggagacccccctctccccaaacactgaatggcacgggttggccagcttaggaactccgttgactaagccagaccttcctcctttccgcctgcccctagagtgtgagagggcacagcaagcagctgtcctccctgctggtggtcaccacctccagcactggctctgtttccctttgaacattaattagcaggtgggttctgatttgagagtgaagcattctttgggggtgcccagctgagagcagtggtctggtggagcagcgtgcaggactctctggaaggctcacccgttatagcagagctggaaatgtgatttccaggcctgagtcggatggtgggggagggtcgccctccagcctggtgactggaggtgaattcccggatctcctgggtcttggcttcttcctctgtgaactctgacttgggggttgttgggaggtgatttagtgctgttctaacatatgctggtatctgcccttcacaacgcggggacagaggcggatggcagtgttttcactgctgtccctgtggacatggagggtgctatgtggggagaagtgccacaacccaaaatctcagcacattagtcctgagtggaaaacctcctctgacagtttcttcagcaagcaaagtgcatttctactgtgctgatcaccctcatcccacttgatcatgttcatacccagacctgagctagaccctcaaccaaattagtccccagccaatctgggacctcttggagaccgtagggtaaggaaaagtggtgagggacatagcttacttgagcttaggattcctttggttcctgaaggtaaggagggaaacacttgggctgatggagggcctatttcaggtctcaccaacaaagaagggacaggtgaaataagaatacatgaggccaggcacagtggctcacacctgtaatcccagcattttgggaggccaaggtgggcggatcacttgaggtcaggagttcaagaccagcctggccaacgtggtgaaaccccgtctctactaaaaatacaaaaattagccgggcggtagtgacatgcacctgtaatcccagctactcaggaggctgaggcatgagaattgcaccactgcacttttgagacagagctagaccctgtctcaaaaaaaaaaaaaaatacatgggccacatgaacaaacaggctctcttcaaatagaagctggttggtcacatcaccccattgacaagatccctgtctagctagagatagccttccgagacacatgaccagcctttgaatcctgggaccgccacttacaactgggggaccttgggcaaaatagttggcctctctaagccccagtttacccatctataaaatagggatgataaaatcaactcttagcgttgccttgtgaatcaggctaagtggtgtaggcagtgttggcccaattccaaaagctcaaggctgtaaccaatgaaaagagcttatggactcatgaaagagacaaagaaacccacccgtcaggagttgcaggcagtgagtgctgttggaacatcagaaatgggtacttcactctggctgggggtgatccgaagcgccccccaggtggggaaggagggaaccatccaggtacgggctgcacatgtgttcatggaactgcaagcagggtgggggatgaaaaggaagcgtgaggtatatacagaatgtgggaggaggtggattgagaagggctcaatgccctgagccaaagctgtgaaccacatttcagtgatcacaagggctacaagctgggaaggcacgatcacctttgggttttagaaaggttatttcgccagctgtaagagaaggaggcagggcaccctgaaggcagggaggccaggtagtaggtggttctgttctgtggtggaggatcctgggctcggaactgaggtagaggcagtggagaggtggctccaagagctgggacttgggcggtgtcactgtggaggctgaaggagagggaatcactcaagttgctggcatgggtggttgatggtaccattcactgggagaggattcagagaagggaaaggtgacccgttcagttcccaacatgtcaaaattgaagtgcccaaacaaatagagatactcagttacacagcacatagtaggaactttataaatacctgttgaatgaatatggttggggtctaggctgcagctcagcagggatggcagcccaaggtgacaaagtacgagtcttcacacacgaggatggacagcgtggagctcttgggttcagaagacgctccttggccaggtgcagtggctcacacctgtaatcccagcactttaggaggccgaggtgggaggattgcttgagcccaggagcttaagaccagtcttgggcaacatggaataaaccctacgtctacaaaaaatacaaaaaaattatctgggtgtggtggcatgcgcctgtagtcccagctactcaagtggctgaggtgggaggatagactgaggccacgcggttgaggctatagtgagccatgactgcaccagggcactccagcctgggtgaccaagtgagacctgtctcaaaacaaaaacaaaaacaaaaacaaatctgttgtaattttttatcggaatgcatttaatcctgttatgggttgaattgtgtccctccaaaattcatgttgaagtcctcagtgtctcaaaatgacattatttggaaataggatcattagagatgcaaaaaattaagatgaatatagtggggtgggcccctagtccaatactactggtgtccttataaaatgagggcaattgaacgcagacactacagagagaatgccatgtgaaggctggagtcacacttccacaaaccaagcaaagccagctcttagcacggagccctggaacagatccttccctggggccttcagaggaagcatggccctgccagcatcttgatttttcggcttctttttatatactgactttgtatccagatccctgctcaatttagttcttaattttgagagtgtggagatgtttttggattttcctacatccaaaatcatgcaatctgcaaataataacacttttttcttccattttttatactttcccccactttttctagctttattgcactggttagaacttctgtgacaacgctgagtagaagtggcacactgaacatcctttccctgttcctgaacttggggaaagtgtctctattagtcagttttcatgctgctgataaagacatacctgagactgggtaacttataaagaaaaagaggtttaatggactcacagttccacgtgactggggaggcctcacaatcgtggtggaaggcaaaagctatgtcttacatactggcagataagagagaatgtgtgcaggggaactcctctttataaaaccatcagatctcatgagacattcactgtcatgagaaaagacccaccccagtgattcaattacctcccaccaggtccctcccaagacacgtgggaattatgagagctacaattcaagatgagatttgggtggggacacagccaaaccatatcagtgtccaatatttcaccactgaatatcatgttagctataggctttttaatagctaccctttatcagatgaagaaaagttagggtctgtttttatactctctattatgtgacattactctggttgtttatttttgtattagtttctattttaattactataaccttatgatacaattttatattttatagaataagtccccttccatatttcttttgcaaaactgttatgaaatatttttgccgatttacgggattttttttttttttgagatggagtctcactctgttgcccaggttggagtgcagtggagtgatctcagcttgctgcaaactccgcccccctgggttcaagcgattctccggcctcagcctcctgagtagctgggattacaggtgcacatcagcacacccggctaatttttgtatttttagtagagatggagttttgccatgttggtcagactgatgtcaaactcctgacctcaggtgatctgcctgctttggcctcccaaagtgctgggattacaggcataagccaccatggcctggcctatttatgggatcttgactgaaattgcactaaattttttaattaatttgggggaaaatttcacctttgtaatatctaataaatatccaggagcactgaataaatatttctccatttacccagattttctttcatatacatggtgatatggtttggctgtgtccccacccaagtctcaccttgaattgtaataatccccatgtgtcaaagatgggacaaatggagataattgaatcatgcgggtggtttcccccatactgttctcatgatagtgaatgagttctcacgtgatctgatggttttataaggggttctcattctctctcctgctgccatgtgaagaaggatgtgtttgcttccccttctgccatgattataagtttcctgaggccttcccagccatgtgaaactgtgagtcaattaagcctcttttctttataaatgacccagtctcaggtatgtctttattagcagtgtgagaatggactaacatacatggtaaagatttttcatgtgatttccacattctaaaaaattatgatctgttatgtatacatataagatatttatcctgtacatatatttatcaatatatatctctcacaatgttaagaagaataacatgaacacccacacagtcatcacccaacataggaaggcattgcctttgcctttggacccctccatgtccttctacccaatttctatcccccttttatcttcccgccttcagtagggcactactgtctgtgttaataattctgttgctttttattgcagtttcactccaaatgtatgtgtcccaaaataatgcatcttttaattttgtgtttctttttgactcgctttgcttgttcaacatgttagtgataatcactgatattttccctgtagctatattttattttatttatttaatttttttttttgagatagagtcttgctctttcacccaggctgacaggcagtggcacgatctcagctcacggcaacctctgccttccaggctcaagcaattctgcctcagcctcccgagtagctgggattacaggcacccgccaccatgcccagctaatttttgtatttttagtagagacggggtttcaccatgttggccaggctggtctcgaactcctgacctcatgatccacccacctcggcctcccaaagtgctgggattatagatgtgagccaccacacctggcctgtagctatattttcattgctatgtaatattccattttacaaatatgccacaattatcctttctaccatcaatggctatttgagttgttttcaattattttgtattataaacaatgttgctattaacatgcttgtaaatgtctttagtgtgaaggttttttctaaatgggctattatttttctggctgaggttttttgttctttcagttctgtcttctatttgattaatgctggtatttaggaaaactagaacttttttcattttttatttttttgtagaaacagggtctcactatattgaccaggctagtcttaaactactggcctcaagtgatcctcccacctcggcctcccaaagtgccaggattacaagtatgagccaccacacctggcctggtaaactagatttgaacatttatcttgtgtccaatttgagtacaatttacttgggtttttcatcgtaaacaataatatcatctacaaagtataatgattttggcaactcccttttaataattatacatttcagaatcccattgttaaattaatatggtgatgcgaagcattccagttttgttcctaactttggtgggactgtgctgaagtttcactaggctgtaactatgttggctgttaaatgttggctttgagatataatatttttattatattaaggaaagcttctacttctaggtacagtgttgaattttgtcaaatactttttttagcttccattgaaatgatcataattttttattgaactattgaggtgagaatcatgctaatatatgttttcatagtctctcaagccaatcattaatataatatagacattttctgtttttctcaagattgaaaatggtcacaaacatgacttcaggtcttagtcatcctccaagatctttctccctgagtctcttttcatttgtagctgagaaaattgacttggccaagctgacagtgactgttgacagacaggttaaagccgggtgacctccctcatactgatgatggccccctgcagagcaagcatggtagactaggagggagagtattaaagtatttcccggctggacacagtggctcacgcctgtaattccagcactttgagaggccgaggtgggccgatcatgagctcaggagttcgagaccagcctggccaacacggtgaaaccccgtctctactaaaaatacaaaaattagccaggcgtggttgtacacacctgtagtcctaggtactcaggaagctgaggcaggagaattgcttgaacccaggaggcggaagttgcagtgagccgagatcacgccattgtactccagctctgggctacagagcaagactctgtctcagaaaaaaaaaaaaaaatccctaatcccagtcatttccctgtgattaggattatgaaatgaaaagctgcaactggagtcgggcatgaaaacagatgcctggcagagtcaagagttgatgcagagtgagcgggcagagacagtgaagtctgcagttaaaatccctggccagggtcctggtcccatcccagtgggcttcctgcctgccagcctgggggagtggcgtgggctgaccccgaccaggtaagagccacacgtctcttctcctttgggcatctgtagattcagggtggtgcagtgcccagagctgatgtgtgcgagtgtgtgtgcccgtgtgtgctgcagcatgcagagaggcgtgacaggaagaccggcggctgcagtctggaggtgcccaactgtcctctgacagcatctctcctagtgttctctcccagcctgtttttgcacttttctctcattaccttctcttctcccccacccccatccatttcttcttctgataggcattttatttccaaatttccaggctcacttagaattgaagtgtaaggccaatgcttctgtcggtgatggatggcattttggggaagagaaaagagggaagggggccacgggcaaggaggcctgggcatcagacgtaagcagggctcagtcaggaagcctgggcacagctcccggccctgccaaaggctgactttctcgcagggcctggggcaggactggccatactgagtggacgaaccaaatccttcggagaggaccttgattctcttagcaagctgtggtccctctctctctcaggcatcgctatctgatagggattttttcttttatttaatcacctggcatttggtccacaccttttttgtggtgggcacctcttaggggccagggacacaggaaggatcagacacggtgctgcttgaaagaagtctctgtgaagtgggagacacacgggcttagatgtgcacaactgtggacaagtgctctgatagaagcaggtgatctgacaggtgagggctgtggagggagtgggggaaggcttccctgaggaggtgacatgtgagctgagtgtggaaggtctaggaggagacagccaagttgggatggggatgtcagtctgctcgggctgccataacaaaacgccatagactgggtggcttaaaacacaggaaattatttccacggttctggaggcaaatgtcgggggtcacatgccagctcggtggagtgctggtgagggctcccctcctggcctgcagacagctgccttctcattatatcctcacatggtggtgagggtgcacagggagagagctctctggggtctctttttgtcaggatgctaatcccatcctgggggcctcaccgtcatgacctcctctaaccctaatcacctcccaaaggccccgcctcctaatactatcccacggaggggttagggcatcaacataagaatttggagggggccacagttcagtccacagcaggatgtgtgtgtgtggagtgaagcaggtacttcaggctgaaggaatgcctgggcaaaggcaaggagacaggactcggtgccaccagtcagggaactagaagcaactcaatatgttgaggaagcagggcaggctctcggggctgggatgagagatgaggctggagtgacccatgtgccatgcaaaggcttttgagttttaactcgaggccctgtgcttccccagactgaccgggcctcaacatcacctgggaatcctggaaggaaacaggttcctgggccttgctccaacctaaggaacccgaatctgcataggtgaggcctcagaatcagccttcccagcagcgcggtggggagtacaggggagccgcgggagggttttgggaggggggaagcagctacatggtagaccctgcacgcgccctcgctcctctgctggaggaagtgatgagggcaggcctggggctggcaatgggatcctcagcagttgctgctcagatcagttgcctccttggaccatgttcccatgagcaagacaggagccaccaggaaatgcaggtttccatttggacaagctcctttaggctggacagtcgagggatggtagaagtgtgcccccaccccatttctgccccactttgctctaatggtgtgagttggaaggaccatctccctcacttttcccttcatcctgagtgaaacctggtttccacagctcacatggcgccgtatttccaacgttcagagcacattggaaagttgggaggaaggatgaggcttgtgttttcactcacagtaagtcaaaggggcttcttgggatggtccatttccctagttgttcagcagaggaaggggctttgtgatcactgtttacattgtatttgttttcctcctagaactccctccagaagatgataatgaaagtgtctgacgcataaggaaataaataagatggttatgtgcccagctcaagggctaaggtgttggtcaagaccacacccgaggggctgccagtcacagggtggggtccaagctcctcaccagacccaacctcccctgctctgcaacctcatccttcccctgtctttcctgggttaaattttacacttagtaacactgaaaccaggcagtttcacacctccgagcctgcatctatgctcatctctttacctgaaacgtcttctctcacccctccccctctgtctggctaattcctgctcattctccaagacccagttctccgtggtaccccttctcacccaacacacacccctcaatctagccttttctgtgagcaacctacaccaccttatgctgacctggttgggagcacatatatagaaagtttgtgtgcctgcccctccccaactccccagttcctcaaaagtagggtctgtggtgctaaattttgtctctgcagtctctgacatatctaggagctcaacatatatctgctaaatcaaacagaatccagatgaacaagaatgccctcgacatgtagatgtcacaattcaacagcattctaagggtttgctcgtgctcatgggtatctttaggacaggtggcttttaaggcctcaatatagatgtaacaccctactcccctcgcacaaaaaacaaaaaaacaaaaaaaactttaacccaaataaactgaaagtgattatttgcatctcaaaagattggggggaggcaggttttctttaaacattaaacctttgctggaactttcagaaactttccttatagatcattaacttctgggggagggtgggagcagaagccgtggagtctgaattcagaggtgcctctataaaagaggaagcaaggcagaaaatcttggaaccagacagagctgggttcagattctagctatactagctgtgtggccttgggcaagctacttaacctctctgcagctcgatttctttatcactaaagtggagatacactatacctattttgcatggttgttgtaaagatgcaaaagatcctatgtggggtaccttagctcataggatgcccccaataatagtaacagtgttgctgctgtcaggcttaacactgggcatgcaggagaagaaggagtcttgaggggcttttaacttagacggcaggaataagaaagccaggaagggccaagccactgtgccagcacattttcagtatcacagcacttcatgatttttttcacaaatcttttgatttttttttaaactaaatctttccatgttgaacaggcagatgctggcgacagcactgtgcagtgtactggcatgagggcctggactctaggaggctggactgcagcttacccagctgtggatcctggggcgttcacttacactcagtgtctatagaaaggagacaataggccaggcgtggtggctcacacttgtaatcccagcactttgggaggcccaggcgggcagatcatgaggtcaggagatcgatgccatcaaggctaacacggtgaaaccccatctatactaaaaatacaaaaaattagccaggcacggtggtgggcacctgtattcccagctacttgggaggccgaggcaggagaatggcgtgaacctgggaggcggagcttgcagtgagccgagatagcgccacagcactccagcctgggtgaaagagcgagactccgtctcaaaaaaaaaaaaaaaaaaaaaaaaagaaaaggagacaatagccactgcctacttcttaaggctgaaatacgagataatgaatttaaactgcttagccaatgcctggtgccagtatgcccactgcaaatagtgcaggcaccactctgtgaagcgatcaatactaaaaagcaaaagcagtcaatgctttgttaaaggaacttcttgttctgggaacatggtgagtttcggggagggaagaggccacccaggaccctggagaccacctgtcaccagagctgtgtaactgctacaggagaggtgtcccaatccagaccacaagaaagggttcttgcgtctctcgcaagaaagaattcagggcaaggctgggcgtggtggctcatgcctgtaatcccaaactttgggaggccgaggcaggtggatcacttgaggccaggagttcgagaccatcctgggcaacatggtgaaaccccatctctactaaaaatacaaaaagtagccaggcgtggtggtgcatgtctatagccccagctactcaggaggctgaggtgggagaatccatcgccccactgccctccagcctgggcaacagagcaagactctgtctcaaaaaaaaaaaaaaaaaaaaaaaagcaaggtgcgttcacagtgcaaagcaaaagcaagtttagtaagaaagtaaagtggtgaaagtacagctactccatagacagaggagggagttctggaaagtacgaggaggaacgcatccaccctgggtacaatactcgcttacacaggataaaaaaggatcatggggagatgtgctgtgctacaagggtttgtgataaaggattaattttcttagttactatattttgcaataatcgatattattaactttaaagcataattacaaatgagtctgttctcaagatatcaggatatcaggacactcctaagtctgggtctgtttagcaaacgttattaatttgttctcttaaccgtaaatatctagaagctgggtatagctaactcactgggaatgtggcccagcaagtcccagcctcattttcctcgccctcacacaagatggagtcgctctggttcgaagcctctgacgtaaccttgggcctgtactgtgacacagagggtttgcactggataatctctcaagctcctagattgccaagacgccagtccactcacagctccccaggctccgctctcctgttgccctgccagacgccccttcccccaccttgtgcagagtaaccccctcctgactcaagaggcagcccctctagaaaacttccttcccctcctcccctgccccggtacatattgcgcggcccttactgttgctgtgtctgtcctgtcatctggaggtgcacaactaccccatgcttcacagtgaagccagtcggctgaaggaaagatgaacgggcactttctctttgtagagatttccggaatctcctgaggccacttttattgcttcccgtctttgtgaaaaaataggcttggaaataggtgaggctcggtcaccccctctgggtggaaggagaaagcaagctccgtcggtttgggccgcggctgcagggaatgcccctggttgcgacccccgtcccgcgctggggaaagtgatctgctcgagagcccccaggaccctgagaaccggtccccacccaaggcggcggcgggcaattccggcaccgcggcagacgggatgcgcggagcgcgttccctccgggtttccctcacgcctctggagagcgggaaccaacgaccttgacctcggaggaaacggctctacggagcgatggacggccccacagagagggcggccggctcctctggaaaacttgtccacacaaaaggcattcctcagcttccaccccgaaaggcgagccctgggtgtagggttaccagcggcgcgcggagcccgccgagaacgtggtgcgcccccagctcctgcccgcgctccccggcctccgtgcgccccgcgcgcctccgctcttgcgcccgctttcccgcggggaaggggccaccgccctgcgaggctggcggccgccccgtcgtccccaagctcggggccgccctggacttccatcccgcgcctctgacggccggggacactcgctccctgggccgcggctcaggagaggcggccccgcggggctccgggcggggtgggaggccgaggcccggctcctccagcccctcccgcggccccacctctccgcgctcggctccctctgcccagcgcgggccgggaaggcgcgggcttggccgctcttcccctccacggcaaagccgtgaacggacagctgatgccacttccttccctgccagcgccctccctgcccgaccccgcttcccgtcctctcgccgggagggagtgcggcccgtggggcgctgcgccggccagacccacccggggcccgggggctgccagcagagccgggagctggcccggcctcggcgccgtcccggacccccagtcggccgcgccccgaggggcgaggcctgcgggccgcactccctccggccccggattcggggctggaagtccctccccgaacccagcagctggcctgggagggagaaggggctggagagggcctggcctctccgagggatggaggggacagaggcggcggcggccaaacccgcgggcggcagcccccagtgagtatagaggaggcagcgccgggccggccgggcgggggtggcggaccggcggggcggaggagcggggagcccaggtcgccccggccactgggaagcgggcctcccacgggctcggagctggaagggtcgtggggaggcccgcccttcacgtccatcttcgtttggcccctctgagttaggggaaatacatcacagtgcttgggccatagaaccaggcagctccgagctgaccgatcttcccgaaagcccgtgcccaggggactccagtgggagggtctcattctttaaggtctctggcgtgctgttccagagtttacccatcaacaattcttactttaattttttggagccagggtctcgctctgtcgcccaggctggagtgcagtggtgcgatcatggctcactgcaacctcgacctcccgggctcaagcccggcctcctctggcttcagcctccccaaaaacaaaaagttattttaacttaacagaaattgctcatattacattctaatcccctgttttctggattggactttagaggagaagaaggagatgcaaagagaaacttgctgcattctagattaactcatagaacaaattatttctgtcctcctaaagataatccttaaactttactggcttaaaactggtgtgacatttcgcattatatgtgtattttgctttataaaatatgtgcattcctgaaagcttgtgtataaattgaattgtaataaacgactacagagagacttgccatttaagagaattttatggtgaatacttggtccgtgttacgaagtggataactcctaatttgtagtgtatacacataaggatttttatgcacaaagtttacttcaagggggggggacatctagatgtgtgatattaaagttgtatttttctcagaaggtagaatcaatattaaaacgctgtggcatgtagatatgcatgcaacaccctgagtcaaacccctgctcaccttcattccttgtgaagggataaacatcagccatgctgctaaggatctgtgcagcgctgacaagccacctagcctctggggatggaacattatcatttacagaataaggggagtagggttaagtgatcactacatgttttggaaaaggcctgggcttggaatgagaagctttggtttccaaactgggcctcctcttagcacctgtgtattgtaatctgtgcctcagtttctccatctgtagaagtatataataaagccattctttcttttcttttcttttcttttttttgagacagagtctcgctctatcgcccaggctggagtgcagtggcgggatctcgcctcactgtaacctccgccttctgggttcaagtgattctcctgcctctgcctcccaagtagctgggactacaggcacctgccaccacacccagctaattttttgtattttttatttttatttattttttttatttttgagacagagtcttgctctgtcgcccaggctggagtgcagtggtgcaatcttggctcactgcaacctctgcctcccgagttcaagcaattaccttgcctcagcctcctgagtagctgggactacaggtgagcagcactcctgacctcaggatccacccgcctcggcctcccaaagtgctgggattacaggtgtgagccaccgcgcctagccaattttttgtatttttaatggaggagggggtttcaccatgttggccaggctggtctcgagctcctgacctcaagtgatccacccgcctcagcctcccaaaatgctgggattacaggtgtgagccaccgctcctggtcaataatgccattgtgttagggacaggattattggggggagtgtgtttgaaagcacttgcagtcccgcctggcatagagcagatgcctaatcggcgttcctgactggtcaaggtctccctttgagctcaaccccatgctgtggtcctgtggcttgtgcatcaggggtcaggggtgaggttggatgcagcaccttctactggaggtcagatcctgcttggtgtcttcctgatgtctatcatcctcattggctccccttggagagggaagagcatgttgcctgttagcagatgcgggcatcctccactgaagctacccttcagcaaagtaagaggccagggattgggaaatcaccctggttttcactctggtccacatttggcataggattagttgtcctctgaagcttcattttgcccgtctataaaatggggatagaaaaactagaacactactgagacttggaagaaaaaattcaacaataacttatttgcactcttcaatgacttgcatttttttaaaagtgctttcacgttatctatagcagggctccccaacccccggggccacgaaccaatagcggtccacagcccatagcagtctgtggcctgttaggaaccaggccgcacagcaggaggtgagtggcagcgagcaagtgagcattaccacctgagctctgcctcctgtcagaccagcagtggcattagattttcataggagcacaaattttattgtgaactgcgcatgtgagggagctagggtgcaagctccttatgagaatctaatgcctcatgatgtgaagtggaacagtttcatcccaaaaccattccaccgcaccccgcccccgatccatggaaaaactgtctttcatgaaaccagtccctctggtgccaaaaaggttggagaccactgatcaagagagcatcccctgctctgtctccaggttactttcatctggacaggactcaacgccaagacactttggggccccgggaggttgtgggggttagtcctgtgctgggtcttaggaactctgtctgttttctcctccagagggcccaagacagggagtggaacagccagccccgtggaggggacctcagctgtggagtggagtggtcctgagccacagctggataacggacaccccccaagaccctggccttgccctcaggaaaacagaacatccagcccgatggccccccagcctcccagggtatggggagtacagctccagggcccctctgtgctggaatccaaggtgagggctttgaaggagaagatgacagtggccaaacagggagtgagtccctgctctgcttcccaagagtggtcatcccccaagaaaccccaatgcagacgaggcaaggcagggagagccgggactccatcagaggggtctttcctgccaggtgctgtggtggctcctcgtacccaaaacctgcctgatgggcagctggacggcagcatcaatgaggagcaacccgccagggatggaggccccaggcttcccaggccgcctgcccctggacgtgagtactgcaacagggggagcccgtggcctccagaagccgaatggacacttcctgaccatgacagaggtccgctgctggggcccagctctttgcaacagagcccgatccatggagttactcccggacggcctgggggtcctggtcattgtaacaaaatcatccacattcccagcccaaggacaggaaggtcctacccttttccagatggcgtggtgacagaggcagatctggatagcacatccctgacctccgaggaggtctttgtccccaggacggccctgctgggtgagcgctggagagctggagacctggaggctctgggcgctgggagcagtgtcttgtccctgtctgatcgggtggagagaaaccgcctgttgctgcaggagatgctcaacgtttctgggcagagcccccgcaaggtgggaacccctgcctggactccatcctgggacacagctgcaccaggtgaagctcactgtgtaggtccaggtggtggggggagcaggagggaatccagagggaggaaaaggggacgagggggtcccacagagggagtggggcaggaaaggagggagagcctgacagttgcctgtcatcaaaatcatcaggatggcctcttgtccttggctgtgacagattctttgcagcctcacaggcagcctgtctgccgaagccccccatgaccctgcagaccaataggaggccaccctgcgtgcttggggttagaggccactatgatgtcttctttgcggcttggattcctttccggagtggctttttgcctctccctcaagtgacatgccctcaccccttagtgagggccctctggtggcaagcagacaggaatcccttcctaaaaggaggctgggcgttctagcagctgggctgagctcagacggtagcaccaatgggatgtacaagtgtccaaaccctagaggacagcctctttcccctcccgccttctcattccaaaatctcacaagctcattcatcaccgcatgcctgagcccaggcatgtggtcctctcagcatatgggtgtgcccacagcagtcatcgtgacaggctcagcctccaattttcaggcaaagtgttagatttatctggggagtaagttgcttctggagaaactcttctcctcagtgttcactaagtggcagctgagagccctgtttctggctctgtcctgatctctgcttctgttctggatcctagagcgaccagtgggggatgtggactgggcctcgggcacctccttgcaggactccggccagaacaggtaagagctcagagcccacattttctctccctccctcctcaccatggtccctctatttactcagcatcaggacagtaagagacctcccaaagtgagagggcaggcagactcctgcaccagcagaccagtggacgtcatcatccctgagaccctgcagaaattgccagtaacccccaccgccacatcccccaggctggtgcctccctgctacttgagcaaaaccaccagggaacaaagcgcattgctaactacctgctccatgtccatggagccatttcccttgcccaggcctctttatctttaaagttggggaaatagcatctgtctggttcacttcacaggaccattgtgaggccgaagtgagatcatcgttgtgaaaatcactggggaaaatgtacaaagccttaccccaattccgttcccagtcaagaggttgtgctgggatcatgtcaaagatttcacctccaaccttaccatgctatcccacggccttcgctccagcccctccaccaaatattttggggaagctggacccaccaaggtgtagcgggggaattggggctgcctgtccttcatggcagtgtcctgagccaggcagagtgagaaaagtacactcaaggtgggagtggggccatcggcaggcctgactgcagctggcacctgcacagaggttgaacccagcctcagtctttgcgaggctcctggtccacaaggctgagaggtcctggagctctcgtttccccagctgtctggtgttgtcagcccctgcgaggccttgtggtttctgcggagggcagaggtcgacacggttgctgctccggtgtaaggcggctcctgcacaaatcccactcagttagaaccacctccagaaaacgtggacagacctctgtcttagtctatttgggctgctataacaaaaagcctatagaggctgggtggcttactaacagaaatttattgctcacagttctgggggctgtgaggtccaggatcaaggcacaagcagattcagcatctggtgagggctgctcttggttgattcatagatggtgccttcttgctgtgccctcaggtggaggaaagggcaaggcagccctctggggcctcttagaagggcactaatcccattcatgagggccatgccccatgacctacttacctcccaaagctccacctcctgacaccctcacactggggatatggtttcaacctaggaatcttggggagacacaaacactgagtccaccgtagtcctccacccccgcacctgccttaaccaagcgagggcagcccaggttcatgtgattgggcttctgcttgcctaagggcctgatggagagggggatgtctggctccttcatcctttgctatttatgatttggaatcacagttgcctccccttctgccaggaatctcttcccctacctccctggccgctgtttccagaccctcctctggtccccagctggccctgccacagtgttgaggagcgtgactacagaaaggcctgtgggcctcagccggctctgctcccctgtctgcgccctgttcaagttgccttctgtctttttccctctttctgtgcggagccctggaggagagggctggggcagatgccctcttctgcagaggtggtgccgcctctgcctgcagctgcccccaccccctgcacacttcctccctcgatgagggaagggcccagtggggagatgcagccactggggattctgctcagtggccactgctgaaaggagaagccaaagctcctgacagcccgttggatactaaggaataaggccccctcattttcaaggaggagacctcaaccatgggggaaggaggggctttcccttagtgctgtgaggagatggtatttgtgtagaatcctcaggactggggtttctgggccattgtttaacctgccaggcccccagcatccatgggctgcatttcagagttcaggcagggtgtgcgtacctgtgtactgtatggtgtgtgcctgggtgtgtggagagagagagaaggtctcttagtgagttttaggactctgttcaaagactgttaacaaaatgtccccttagagtgcctggcgatcagggcaaagagtgttgtggggaaacacgcattgtttgggagtcattccaagtaccctgctggcctcgcttggcgctctgcagtgaggtccctgctgagtagacgcccaggctatagggccatgtcttgaagcccctcagatagggttccctgtctggctctatccccgagtctcctgggcagacattaaaggtggtccccaagaccctgcagggctccctctctccccggagcaggatggagtgattgatgttacttctgtatcaatgaacttcccaagagacctctggagtaaggcatgcttccctcggctctatgccccgggagtgccactcgaagccagggtcctggggcttagtgtctgttctaaggggcttaggactttggggagagaatgctgaggctgtggcagaccatttgatggccaccccgaagggggccccaggacatcagtcaggacgtgctctggcaggaggaaagcgcaggacctcactcatgaggtcatgagccccttggatcttctgagggtttaaggtgctgcttcacattcagtcaagtgttgcaatcaaataaccattacaaccaagttaacctagcatgcatctgatggtgtccgtaatggttactgctctgcaggcaatgggacgagtagctcatgacatgatggtgacagcagagctcaacacagcaggcaggctgggggcgggctgggggcgggctggggctggcctggcttgtgtggggcagtcaccaggagtcagcctgggaggcaacgacccaggaccttaaaggctaagggtcagatgcggaggagacccccggcccccaaccccagggttgtcccccacttaatgaggggcaagagaaggctcagttgcagaggactggagcctcctagtggtaggcaaaagcccatgccagcagctgccatttttgagctcttattatgtggcaagagctatgctaagtgctgttccttctttcccattttatcctaataacaaattgtatttttcacgcacgtccgtgtgaaaagaccaccaaacaggctttgtgtgagcaacaagtctgtttatttcacctgggtgcagaagggctgagtccaaaaagagagtcagtgaagggagataggggtggggccgttttataggatttgggtgggtagaggaaaattacaatcgaagggggtttttctcttacgggcaggggcggggggtcacaaggtgctcagtggaggagattttgagccagaagaaggaatttcacaaggtaatgtcatcaggtaagataggaaccggccattttcacttcttttgtgattcttcacttgcttcaggccaactggacataaaggtgcaggtcacaggggatacgatggcttagcttgggctcagaggcctgacagtatttattgttcctgtttcactgacagagagacctctgtggcggggggagttaagggacttgcccaggtcctctagctgccaagtattggagccaggttttgcactcagggctgccggccccaagggctgcgctcttgccatcgtgcagcactgccacaagccaccctgtccctgcccccacaggccaccccttgggctagggatctgggggtctccttcccctcccagcctgctctgttctcaggtgtgggcaaagaagggcaggtgatggactccatgggatacgcttatttttctcctaggtcactattaggatgattcaggaaatggggtttggattttgggggagaggatgaggtgagacgttgggcctcacagagggcaaaagggatctgtgcctggaaggactcataagagagaagtgggaggacattgaaatagggggccgcgctcaggctctctctgtaccagctctggccccttcccttccttgagcctctgagagacatactgggaacgcagattgccttaggatcccggtaacctagcgcaagtgaaagggtgtgacagtgaggagcacagcaatcagggcaacgctggctccagaccccacaccaaatccacttcggaggctcaggagcccgcgccagggcggccagcccgaggccctcggcctcctcggccgtctccatagaggcggtgcttctgcatggcccaggcacaccctggtgcaaatcaggaccttctctgtatgtgtgatttgggaggccccaggtgctgagtgtgtctgcaggggctttagttacagggagaagggagcagagaaggtctcggttttgttttatgtgtgctgtagtgatgagggaagcgcagggaacatcctaggttgtttattttcccctcatcgctgtgatggagtcgtgcccctgtggggatccacaaacccagtccctggtgtacacacccttcaggaaatccctgtgagtgatcgcggaccaaaacacttcacacaggcgaggggaaggggagggcgggtcccgatcttcaggcccctgctgggattccttggggggtaaaaactccctcccctcaagcagtttctagactctaagttaaagacaggcagccctaaagaatttcaggggcttggcctgtggttcaagtggtcaggccctcagctgtgagaaaaatctcaggcttttaaagcttaatatgttaattagcatttttggaaactgagataggaaaaaaccaaaatgtttttcctactttcacacactcaacacagcacagagcacttcacctcaagccaccagagcgtgtgcagatgtttcccacccgccaagcaattctccggcagaccccagctggctgccctgtgattccactcagttctgacgctgtctacctgcagataggatcgggccccacaggttgagggctcagttccacaagactgcgcccacttcagatgccaattgcaagtcccaggttgtgacctgcacttcggaccaaccagctataaatcggggttcccactgttccttccttgggtttaattttataggacggctcacagaacgcaaggaaacactttacttgcatttacccatttcttatgaagaatgttataaaagacacgaacagccatgtgaggagaggcatggggcaaggtatgggagatggggcaccaccccccagaaaccttcacaagcccagctgtcctgaagctgtcctgccagtcctttgggtgtttgtggaggcctcattatgtaggcatgattgattacatcattggccactgcgagtcagctcaaacttcagcccctctcccctgacggaggttaggaggtggggcttaatgttccaaccctcaaaatgattggtgtttctggtgaccagcccacatcctgaagctatctagggactctcagccaccagccgtctcattaccatacaaaagacactctgctcattcctgagattccaagggtttaggagctgtgtgccaggtgccaggagtggggaccaaatccgtatttattagatcacagaagcacagagctcccctgcgagctggccactgggtgtgatccagtgcaatttcacatggaactggccacttttgctcttactgtgccctgcaccggctgcagccatagctggcactggtgtatctcctccctgagctcctggggcaagaactgtgctgttcttgtctccgggccccagtgcctgcaagtgtgtgcagggaaaggctctcagaaatgtctggcagaggcacgtcgtaaagagtgtgagtaagggctcagcaaggaggcatggggagtcccggctgagtgcgggagaagagacactcccaccatcccagcaccaccccagcatgcccagggctgtagagttggctgagaacaccccagggcacgggtgtaaccaagaacggaagaatgcctgagcccctgcctgtccttaccaacccccagctcccatcctgccccactgatatacacgcacaaaggaaagcccccttaccactcccagccccaccgagactaaagcaaaagaaaaaattaaatgtaaccacccaacagtgttttaggatacttaacacgctcccagtgtctcaccctgggtggagaaggaagccctatcacaaacccagtgccacctggatcctccagataccctgtcccatgctgcgtcattgccacacccatatacacaccacacatgaaaatctcatgatggtcccaatctttaccaatcaaggagcttgagaaagtcaatttacccaaggcaattcatctggtgggagccagtctgaaattctaggaaaggaagccctctcctctgcctgccagagttgaacaggccactggtcccccatcggagggcatctcagacacctgcctcctctgtggccacccaggtcccacacctgaggccaagaggttctcaccaaaggggcagcccaaagcctccttctggggctcagcagggaatctgttcatcttcaggaaggcaggggcagggtggctctgctctcctcagaagtcagcatcttaggcgtgcactgcaggcctccacacagatccttttgaaggtgttgaaggaggtgggttctcccagctgccattcctaaggactcccactcctccttctccattgacaggagggcctattgactgtctgggagtcagctttcctccatgaccaattggccacctcctgttttctatcctatggaagccaccttttctatggagccctgtcaagggcttttcaaagtccagagcaaagccaccaggtcccctccagctacaagatggtgtttgtcatttcaaacatgccttccccttgctgacgacaaagtgatctcatcacaggtgactttagtacatattcggggattccatcctttgcttagtaagggggtgagagtaatttaacaaaacaatggtgctaatgataaaataataataataataataataaatgctaacatttgtggactcttaccaagtgcccagctctgtgctaatctcttttaaaggagtcactctcacttatcttaacaactgagcccttatttagcagatagggaaactgaggctcaactcctaagtaacctgccagggtgacacagctaggaagtggctgtccagggattagaaccccaggcaggctgcccccaagccacacacttccccgccactctaggctgtgtcctgtccatgtcctgcagacctgggaagaagggacctgtgcaagcaagcatgacagtctgagactaggtccctgccctcatggagcacatgacccagaatcagttccaggtgcaccttttccacttcccctcattcagaaaattgcacacagaatcacagtaggagagctctatccgtggtcatcagaaagctttcaaatacgcaaacatggaacaaatgctaagcagaaaagtttctctatgttctgtacactccatattctccctctactgggtgcatcctggaatctgggaagcggcagatccctctacattcccagttatttccccatccatgtacctgagttgaaagggttaaacacagactcgctgagcttattattttaatccaggattatgatggctgcagaagaaggccactctgtccccttgacctccttggctaggagagcaatggtggttctcctgccccagctggctggagggagagcaaagccttagctaagcctgtccctccaccaggaaactggccgagacgggagtgcccagagcaggaggggaccacacgctgccctttgtccttgtgaaccagtcgaggacacaggtggctggaggggtgggggaagggccagcatactctagtggaactctagttttccccaacaatgagctctttataggctctgccactcggtcagggccaaacatctgtggtgggaactcccccaaggggggacctcgaaatcccacaccccaccttatggcatatcagactatgtggccaaagatctgggctcacagggtagcactgtgagtcctctcccctctccagcccccactgcttgcagatggggaaactgaggcccagggaggaaaagcactcagccactttattcctatgctccaccctctgagctaatgagctccagaagtgcagactttcaagacagtggcaaaaagccgtctcttcttaggcaggaattgcctctgcctggccatggcactgaccaccccaacccttctaggaattttccagagcaactctgggagctgggaggtgggcagtgagatgggacagactcagcacccaccccattttgcctgcttgttccctgcctcagagaaagaccaccttccctccacagggctggtcaggccctcgcttcaccagggtgcacgttgaccttggctgcagtctgtgaaggtgactgccactcctccatgctcagtgtggtactgcatggatgcctctaggcgcctaaaaagccctgcttttctaatcagtggagaaccagctttgtctgccaggaactgaagcaagacagctgatgagaaaaaaaaaaaaaaaaaaaagtaacagctccaagaggagggagcagaaaggaaatagcaaagctggaaaatggctttaaaacctgggggcaaggctgatcctggcagcatctggccagttgcctgggggccctcctgcctgcccaccaggtcttgtgacaaatgccctctgacagccgtggaaccacagctgtcaccggaaggctccgagtgtgcgggctggcagccagaggcccacggctgcaggggcgcctctccgggctggtaacctcattatctctgctgtcagagcaggagccccagggagcacagctgctctcagccgccttggaggagctgtctgctggggaagctgtgcagagggaggcctctcctgccaaaggaggcttcacggggcagcgggcctggagattcgctttcacatcactccagtaaagccctccttgttccaaagccatgcctgggccctgccagggttcacaggcacagatggtgcctttcttctagcagtctcctcctgctccccagcagccccaaaacagggttggatgcaaatagtgagaagaaaaagaaaaggaaacaagaaaagaaatcatagtctgcccagagtttgtccaaggatgtccaaggaagccttccttggaggcctcagagctgtgccatttccactcacatctctgtcacccaggaaactgcctggtcccttcccccagtcaggaccatggtgaggggctgcaggtctgagatcaggacctgctggagccctgtggaccctcactgttgaggacagcccagcatatgtgacggcgaggacaggggcagccagtggggatgatgaagttaccccaaagagcgcatctgcccccagccacaaacatcctctgcctgccctgagacccaaggcaggagaggacagagggtgcggaacgatgctggagacagtgggctggctgtcgtgtgctctgctccgcttgcaattgacgttcgaccttgaacaatgtgccagcgttcttctctgctctggacaccctcatctgtcaagtggagagaacacctgccctcggccagcctggctggggagagcaagctccgtggagaacaacgtcttgtcagtgggagattgtgggttgctgttatagctgtaacccagcgcgggctgtatgtcactggctgagagacagctttgaaaacggactgctgtcattttctgccactctggactggccagggaggcagcacatctggtagggggtgggggctggtggaggacccttattattatgaaagtcgagccacttgctggcttggtttgggtccagcttaatttctctcagccctgagcctgtgagccctgagctggtgcctgatggttttggattgggactaaggcaagaaaacaccaggatttataaaaatgccattcccccaaagggcccaatctatgctggacagagccctgattctttgcatctgcagtgggtactagtgtggtgctgtgtgtgggtgcagagagacagaaggagagagaggtgatgcgtggagagaccatctgtctgggcacaggcccagcccaacaaccccgggccctttctccctcctcctcccagatagctcctgctgtctgcctggggaaggaacaatagaataatctggagactctcctaccctttctagatcctcttgaggtctctgcctccagtgcctgagcagatgtccaaggccgggccagctccccagcccccatccagagccacgcagggccatttcccagccccaggccccaggccccaggcccccaggctgggttccctgtgcgtgggtgctagaggaggaaggctgcacatgcagggctttttctggcacagccagtgcttgacactgctaaagccctcctaatctgcgttattttcttctaatccctcccccaccaccctggcctgtgtgccacgctgcaggaccgttggtcccaacccggagcctgtgctgagccccaggcatgaggaagccacgcatctgctgcagcgtgcccgcatgaaggccaggacccggcccctccgtgccagccatgacatcgtgcccaccattacccagggcagccggtgagtgggacctgggccaggctagcctgggagggccatagcagggaagagtcagcagtgggaagaagtgggatctagccaaatgctgctgctcgctccatgtgtgtgtgtgtctgtgtgttttccatataaggctcttgctttgattatttagtcagtcaacacacctttcctgagggcctacagtcaggcactgagatacaaagatgaatgaaacatgatctggatccctgggggatggaggtcacagtctccagggagagaagcaaacagatattcaattatgtggactgtggtgtgagagaggaaaagtgtgtgtgctgaactggaaactgttaactccacctggaaaggacaggtgaggctcttgagagaaggtgacttcttagctgaggcttgacggaagtatagatatgcactggcaagcagtgcaagataggcactggcaagcaggcttagtgaggcgacagaggagcgcaacacctacagccagaccatgcgggcttgacttctggttctggcacttagctgggtgcctctgcggaagtctgtgtgcctcagtttcctcacccacaaaatgggaactgtaacagtgcctgtcttacagggttgctgtggagctatgtgagctaatacgtgtcaagtttagaacagcgcccgccatgcagtgagtgctgcaggactgtgagctctaatgactccttattttgttgcaggggtgtgggaggtgtgagaagggaggcatctggaatgagcccagggttctgactcggtgtctgtgtgtttggtggggcctcagccgaggggtgaggcctcagtgcagggtcaggcattggagggggaggtggtcccagaacatccactggaaatgcccaccaggcagttggatacaggatctttagaggaggagagatcagaactgaagatttggatgtcatccctgatttcataatgctacagccgtggtaaggtaggaaaacaacaaggtcaaggacattcagaccagcacatcacacacatgactgccccctgagcaacacactgcatccccatcttcctgcctgttccgccgatggtgcactttgaagaatcacttacatgtggacttcaccaccacacagagctgtcttccagtcatgcacctgggcctgagatgaggccaccaggctatgccaggtctcaccaggcccaagcaagaccacttctgcagctagcaaagcctgtggcttcactggcatggtgggcctgctgcatcagcctgtttgaatcaccacgtggcagtggagggagcaggggttcttagggaacagggatcttggtggaactggaccacatgctctttgatggagggtgccgaactgctcattaaaggctaaggaccttcatggaaccactgagacgactccttcatgagcagaggtcattgtgacccttaggagaggggctcagaagaccataaatcctggcaaggggtgccaaacagactgcccttgtatttccacattttgggccttgcctctctctctagatggagggcacttgttaggaatgggcatggtgggctgggcaccgtggctcacgcctgtaatcccaccactttgggaggctgaggcgggcggataatgaggtcaggagatcaagaccatcctggctaacatggtgaaaccccgtctctactaaagatacaaaaaattagctgggcgtggtggcgggcacctgtagtcccagctacttgggaggctgaggcaggagaatcacttgaacccgggaggcggaggttgcagcgagccgagatcacaccactgcactccagcctgggcgacagagcaaaactccatctcaaaaaaaaaaggaatgggcatgacttcttcagggcatcctaactattcttcttcacgtatataaatatatggtgagaaatcttagacttccaagcaactctcctgttctactttgtagaggcatttaggttaggtcggatagcctcaaaatagtcaagactatctgcaaaacagattgcattgtgtaaaggtcctcttggacacttcttcctcatgtcactctagcagctcacaacaaccccaatcactaactttaacgtaggctcccttttgcaggctgtctccaggccatagaaatgctatagaattgcaaggtgacccactttagcagctgctgtgtccagaaaagaattactgtgacttggcagcgctggcgaatcctcagagggtatagctgaaaaatcaacgccagatggcttgctgcagatgcttctaaaggttacgctccgtcaaatcaccctggagggccatgctgagttaacatggcaatggcacacaggccccaggcctcagttagatgcaggaggccccatccccagcccagatgcatcacttctaaagagcagcttggtgaaaggtgatggaagaggaggggcaggcagagcagtctcagagggccttctttatcctaggtctggctagaggcagctggggcaagcctgaacagacagggactccaggaggtgaagaggtagcagcagctgcatttttctggaaacaaattaatacagaaatggagcagctcctggaagcacaagattttgccattttggggatagacatgcctagattggtgttactgatggcaggaggacaggacatgtcagcaagaggcagggctgggagggtgacactgtaagtggtactgtcctgggtcagagagagtggctgtgttgagactgcagagcttgtgtacatcacattgattgtgtggttaggggagcaatgctatggaaagtgggactctggaaaggggtccctgtgaagccatatgtctccaggactgcagcgggatcctcccctagaggagtgactactggagcttctgtggagcatcaccttgagaacttggcaggtgtgggatttgctcaacgcttagctgcctcattcgtcctgcacttgtctccaaaatcttcatcctgcctttatgcacagttgctgacactgctagtggggctttctgggtttgaataattgggctgaaagcaccttatgtgattaagcgctcctcaatttctctttttagaacaaaaatgtctgcctctgcagtgaattccaggattgctcaattcaccaccctgtgtgtgaaagttaagaccactgatgtggctcatgggacctgggctcccttgttagattaggaccgcactgcctttaaagctaggctcttttcctccctagaaattacagcccacatcctgccagcggacagggcactagcttttggggcctgtggaggggtcgttgtgtgaagctgtgtgcagaatctccctgtgggcctttgcctgcattgggtcggctgggctgggagggcgtcctttctgtgcagtgggctaggctgtttctctggatggagtcttctttttgggggctatggggagggaagcatgcttctgaagagctcaccatgagctccacaggaacagggaccccacagctgacctagatacaagtacaggtagggtccagaatcctcgtgtgggttctctggggctcagagtcccagtgctttacaatccccaaaagaaaatcatcaccaccatagttattaatatcagaggggcctcccgacgaccatattgagatgagtagtgagatcctgcaccgtcttcagcagcggggtgtcctgctcagtagcctacatctctcggctacaaatccctctctgaaagcagggctgcaatatgactttcgggggccctaggcacttttgccttcgtgggcctctttctccataaaaaaaaattaaaaaatatatatttcatgaccatgctggttgaaagataaatatgtcattctacattaaaatcttttctttgacccaaaagtttattttcttctgattttaaaagaaattacaacattttcctgggcccctgtccatattgtgcgtccttggcatagcggctgttgtgcctgatgaatgagtagccctggctgaatgtgagttccagaaaacaggctgaccgacacctcttcagtgttccccagagcagcctttttaagcacaggatctgctgaaatctcaaagcaggcagatctacttgcttaggaggagtttgtgtatgttttttttggttttgtttttgtttgtttgtttttttcgagacagggtcttgctctgttgcccagtatggagtgtagcagcacgatcttggctcaccacaacctctgcctcctgggttcaagcaattctcatgcctcagcctcccaagtagctgggactacaggcacgcatcaccactcccggctaattttttctatttttagtagagacagggtttcatcgtgttgcccaggctggtcttcaactcctgagctcaggcaatccgaccaccttggccttcaaagtgctaggatcacaggcgtgagccactgcgcctggccagcaggagttctttttaaaaaaaatttcgttctggagcagtgcttatggggggaaatgactggagtcaggggtaggagcaggtgtggagcccccattgtccattgccttttgcattccagtgagcattcagcatctaataaatagaagtcaaatgctactaggctaagaagaaagatccaggaaatgaggcaggagggttgcatgaggtcagggaaggaggcctggaggccctgaaggcctgggagtgtaagaggaagcaggaaggaatgtggggagcctgcattttccctccaaagtgtatgcacttgaccctgtgccctcttctgggttggtgtgataaaggctgtgcatcagttggacctacagacaggaggcagtggagaggctggataagaggccactgcaggggtccagtgtgagtgataaagaagtgataaatgaaagaaacaagagatggaatcccaacacttagcagtggattggtggggaggccactaccaggaaaagaaagggagaactatggtcctttcttgggtgccttctgatagaaaacggcctgtggacctgggtccatttgcatagtggcctgaaactcgggttacctggctccaggtggccctggtgtgagatgtgtacaggtgtcttccggaactgagcaggacttgactattcgccacagtgtctcccagagccaaagtggatgacagatggacagactccccagcacagcagtgccatccccagcaaaagcaggacgagagtgtgtgtgagggctggggagggacagtgcctggagtgggggttggaacagtcaagactcaggggccaaggagaaacatcactgttgccttgtctgaattatgcataagcaaggtgatgtggaaccctgtgtggaaacttcgggagcaattgcttagaaaccctgactttaaggccgggtgcggtggctcacgcctgtaatcccagcactttgggaggtcgaggcaggcagatcacctgaggtcgggagttcaagaccagcctgaccaacatggagaaaccccgtctctactaaaaatacaaaattagtcgggcgtggtggcgcatgcctataatcccagctactcgggaggctgaggcaggagaatcgcttgaacctgggaggcggaggttgcggtcctgagatcacgccattgcactccagcctggacaacaagagtaaaactccgtctcaaaaaaaaaaaaaaaagaaaagaaaagaaaagaaaaagaaaccctgacttcaggctgggcgcagtggtgcacacctgtaataccagaactttgggaggccgaggtgggaggatcacttgcgcccaggagtttgagaccagcctggccaacatagtgagacctcatctatacaaaaaataaccaaaataagccagatatggtgaagcacacctgtggtcccagctacttgggaagctgaggtgggaggatcacttgagccccagagatcgaggctgtagtgaaccgagatcatgtcactgcactccagcctgggcatcatagagagatcctgccactaaaacaaacaaaaaaaagaatctctgacttcagttctcacacagcctctcctttaagtggaaacttaaaatatcctgttcccgtgacagcattacagcaaatacatatttccacaatcactaccaaaaatacatggtggtcaggctcacttcctctccctaacagacacacacacacagacgccgcaccaccccagcaaca

SEQ ID NO: 12418 - DNA, 52457 bp, Human
tgaaatgggagcagatgtggaggctgaccgcagagagggagctcatgggcatgctctctacatccttagctgaccaggtgagtggccaggttcgaaggtgcagctattcctgagtgtgcttggtgctgtttctcaaagaaacttaaaattaaatcgatctgaatggttttctacgtattgtgtgactctgtgtgctctgatacagctgccttattcttgccagtctaagacaacagctcaactccttagtgccttccctttgttcattcatttgttcattcggcagactttcactgagtactgtgtataccaggagccaagttcagaaaaaggatgacagagatagacgaaggatgcagcacttgccctcatagagcttagcgtctactgacgcagactcataagtagatgtcggtgccctcttcatcaccaggtggagtgcacagggcctgctctctgggaccccagaatgccacagcatatttcccaggcaaggtttcactggcctccctggcaaatagagtctaacctttaatctgagccttttgcttagatgctgtcctagtgtccctttactcaagggaaatgcacttaaatagaaagaataaactgcaagaaaaccaccttgctatgcaggcagcctcagaaactccttgaactctaccaaactgttagcaaatattcatttttattattttattttatttttgaggtggagtctcgctctgtcacccaggctggaatgcagtggtacagtctcggctcacggcaacctccgcctcctgggttcaagcaattctcctgcctcagcctcccaagtcgctaggattacaggcgtgcagcaccacaccaggctaatttttgtatttttagtagagatggggtttctccacgttggccaggctggttttgaactcctgacctcagatgatccgcctgcctcagcctcccaaagtgctgggattacaggcatgagtctctgcacccagccaacaaatagtcattttttaaaaacctattcctcattttgacgtcctaggaaaggcagagggctccagtctgactttgagtctaccaggatcactcatttaaattttcatcttcctgtggcactggtagctgtcttcaggcacgaagatgatttctctgagttttctgcatttcaccctttccttttcatccaaagagccagctcactctgcatgtttttgttcaaagtgcaatttcctggttcgtcgaatgcctgcaaagtttcataatacggaggaaacaagaaaccctgcatgattactttactattttttaaagtattattattcagtatttcccaagcagccagaaactgatttcctttttcaaacatgagatagagtataatgaatgagtttaagaaaaaaaataatacccaggtagctgttttaaacctgaggggaaaatcgtccaccagcctcatatttcaagtcgggtcacagtgacttgagcatgtcccccaaagctagcaattgtatgcccatgtccagtaaggatagtttattcagccatcttctgccacgaaggcccataattcacctcccggcgccacctgtcagcagctagttaataagtatggcctggtgcaacagcttggagaagagcccaaaaaaggtaaaacctccctagacaagtcagggttggattttgaaacggggagtgcgtatcctgggcaccatgggctgcagaaatccaaggagcatccatcactgagtccaccgcaggccccaggaagcactgctgaaagggaggatctgtaatttgtctcagtccctgaatgagtggggctacttgtcatcatgcagtttcctctccaggaggctcaggatgggtaacacagggctcctgcctaggaggccagaggggaaggagacttcgtttttcatatgccagtgagggtagggaagacaccccatgtctgcacatgtgagctcactggatagggccttatgagaccagcaggactctggagcttccagtcagcctgggacattcccccgtctctatccaaacattattgcttggttcctagagataacaggcaagagagatgcctcacagtgcgagccagcctgtgttcagagcaggaggttcaagagaagccctatcacaggggatgcagtgccttgagagccaaaatgggcagctggaccatccgactgtcttgactgtgtctttggctttcatcccccaggatattttcaatgccgtcatcaaacaaaaccccttccttgtgtaccagctcccctgcttctggaatgtgcagctgtcagaccacacccgctccgagcagtgctacagagacgtgtctgatctaaaggtagggtcaacacagggacatccctggaggtagggtgaggtgggccgagaggacctcccaggggcatggatggctgggagatttatgtgcaatgtggtgagagagataagggcacaggagagcagaatgagtatgcttttcatctttgtggggtgttggtttttttccacccttatttgggctttctggaaagcctaaagcctcctggcgtaagaaccagcttgtgtggttattattcttgccatctgctgctggctcttttggttcatgccagctccccaaatctattcattcaactcaagcaaaaacatttattgagggcctactctgtgccaggtgctatagatgtggatgtgaataattaacctgcttccaagtcatgtatgacttggaggaggagagaaatgtgcaaagaagtaagtatttaaaaaaggacaaagtgctatgacaggtgtgggtgggtcagtcggggagatgcaagcataaatgtctcattcttcctcacagagggcggacaatgacagaaaaagctttcatcaccactctgtaggtaccaaacactgtgaatgaacctggctatagaaagaggaagaagacagggtatattagtcatctactgctatagataatgctgcataacaagctattctgatagtggcctaaatcagcaaccatttatatagttgatgagtttgtaggctggttggatggttcatttttttactggtttaacagagtatttgtggtcagcttcagatgggacagctggtgactggggcaacttagatgtcctctgtcccctcagcaagccagtatggtgttttctcatggtgaggcagaggtggcagaggaagccctaatacacaagaggaaaccttgagtcattgttgctaatatccctcattggccaaagtaactgtatgactaagcccgtatgattactttgagtaaggagtgtgagttaaggagtgtgttagaattccctccctacagtggaaggagtaaagaattgaccacaactattcaacagaacgaagatttcaacacaggcctgtctgacagcaagggcttttgcctctcaggttgtatcacagaggattagatacatgcatccttaaagaatttgttccatataaagtttatatccattgcaagttttaaaaaggaaaaaggattgcaaagctagcttttctaataaattagtcttttgtacttggcttctgatccatgtccccatgtgggtattatgtcttatttgtagtcataacgcatgttaaatgtggttttctgcttttcatttgttgcatatcataagcattttctgggtgagccacatggtgttaatgaacatcatatccaatagttagtctgttacctagccactcccttgaccttagttgttttcaaattttcataaatataaattatatcttaattaacagctttgtccatgaagcccttccatccaatattgttgtagcttgcctttccaggaatgaaattatagcattagaaagaaagaacttttttttaactgcacttgaaatttatttcaaaatattagaaaggatttaaaacagaggtgcctgcaacattcattccttccatcggcatttattcagttccttctgtatatcatgtgcttgttagaaataaggaaaagagaagaaacagacaggaatattgtcaagaatatcatggattaaaaagtttggagagggggcgaaataaaaccaactgtgtaaagaatatgtaaaaatgctggattaaaaaatattttacatgctttgaaagcataattgatcggttcataaagcaagtaaagaaagcaaaggccagaaacaatgacagagtgaatccaaaaagataagcaaagagcaactggatgtcacctttgcccttggaagggatgatccctagtggcagggagcctggtttaaaggtgagcctggtattataagaaatctatttagtctttgtccctggttcctggaacagagctcctaaaacccttgaaatttcctgagtgataagaacagcttttattgtgtatatgagcccctttgggttatacctgagtttatgctaatgaggtgtcttagagtagggcccctagagagcctcaggatggaaagaccaagtgatcagagggttagaacttccccactgatcaattcccacctacgagtgagaacatgcggtgtttggttttctatccttgcaattgtttgctcagaatgatggtttccagcttcatccatgtccctacaaaggacatgaacttatccttttttatggctgcatagtgttccatggtgtatatgtgccacattttcttaatccagtctgtcactgatggacatttgggttggttccaagtctttgctattgtgaatagtgccgcagtaaacataggtgtgcatgtgtctttatagcagaacaatgagaacacttggacacagggtggggaacatcacacaccggggcctgtcatggggtgggggagagaggaggaatagcattaggagatatacctaatgtaaaggacaagttagtgggtgcagcacaccaacatggcacatgtacacatatgtaacaaacctgcacgttgtgcacatgtaccctagaacttaaagtataataaaaaaaaaaaaaagaaagaaatcactcagcaaatataaagctttgcctgtgtgacttctttcataaaataaagactttacgacactcaaaaaaaaaaaaaagaacttccccactgaaagttccatggacctctgggaaggcaggagggtgtgctagaaatcaagctctttaaatgctcttgaataacaagatttgatgaacttctgggttggtgaacactattgttgctgcagggtggtgtgcccagagaaggcatggaagctccataccccctcaccccacacccccatattttgccttatgtacctcttctctctggctgttcccaagttgcatccttgataataagctagtaaatgtgtttcccagagtttcaggagccattctagtaaattatggaacccaaggaggggatcataggaatccttgatttacagcaaatctgtcagaggacaggagactgggatttgcaactggcatctgaagtgggcagcctcgtgggactaagccactaacccatagagtctgatgcttttgtcaaggaggtagtgtcactgttgtattaaattatagggacccagctagtgttgaagaactggtcattgtaggaaaataaccccacaatatctggcatcagaagtcttctgtgtgagagtatagaaaaacagtggtttttctcaataggtaactgtataatttattgttcaaacaagcgaatgctatcatgggatacagagggacaataggccaacaggcaaaacatataattattctgttgaaatactatacacaggaccttaggcccacaagaagaaagacctcacataaaggcctcacataaagtcaggatccacaaagagtattatcctcagcggataaacagttaataaaactcagagtgtagaagaagacagtagaggttgttgtctgtttcatccttggttttaggtagaatgagggagaaatgtttcctctgagattttattttaagcctatgcccatattattttgggggctgaaattacatgtgtgggagcaaaaatggaaagaaaaaaaattaaaaatttgccaggcacttggcagaaactaacataaatctgatctagaagaatattcttaaaaacaagtcttcagaattttttaggggaagttacaaggaaagcaaggttctcaggaatcacaaaacacacaaggaagtaagctaccctgagaaagtgcaaaaactgaagactggagttaaatctgaaagactgcaaatattggacttaccagatataaaacataagtatttttattacatgtagaaataaaaaatgaatattgaaagtaggatgaaggaatagtagattctcaaaaaatgaatagccgtatttggattaaatagtatttttagaagtgaaagatatgattattgaaattaaatggatatgttaaacagcagcttaaacacagctgaagagagaattagtgaactggaagaggtataagaaattacccaagatgcaacacagaatgaaaagagatagaaaaactgagaaagaagcaaagaaattgggatatgtctcattggactatcagaaggagataatagagaaaattggaagtgaggcatatcttaagtatgccaagaaacaataacaggttgtatacctagaagaataatctttcaagtataagataacaaagagaattttctgcaaacatgcaaagaaactgctaaagtattgtcagccttaataatgaagagatcctctctaaaagaaaattatatttattctggaatagtgcattgcaatgggaatatacatgccatagcaaactatgtgcatacccagggaggtaaaggaagataaaggtttttaaaggaaaaatgaagaggattttataattgtttggagataattatctttggccaaaggatcagtaacaaagttgacaccagtccaagactggacaggcagttgctgggcagacgtgcctgcagaagtttttattttgtgtgtgtaaagttacgatggcatttgtgcaagattgtggttttcacggagtcttttgtaatcattcttgttatcagacacttgtggaagaaaagcctctttccatggcattcctggttctatttgtcagggttttgttaacacaaatgactccatttttattttggcaacattcatatttcacccttttgatcaagatgtttccccaaaagtgtcactgttcagtcatcctttagttaggttttcatgtctctcagtgccaggatggacctctcccaggtttctggtcttgtttcacgttggagagaatgaatggcagctaggagtcagtgtcaaaacctttttaaccacatttgagcaataaggaagtttaagtggggtgctcctcgtctgtctacttggagtctgtaattaagttcaattttgtctgttccataggcatgtgttaccatctcaaagtgctgggttagcattatactgttaggattcgtacatctgtaaaaaatttgaacaagtaacagatacaaaattaaagagaaaaatgcaaagtaaaattaatagtgatgtgacaagaacagtttgcataaggactttgagcaataaacctaggctttaaagacagccaattgaataaacaaaatgaccattatcctaccaagtgaaaaaggtaggctttgttatatcattatgatatagagccttgttctgacatcttgaaaaaaagctgtctacagcatgaaaacaatcaactctcgtcctggtttgcagtttgaatgtctctggtgatggcatgggacagtttggtgaaccttgtgtggcccagacatcaggcacgagacttatttcttaaaattcatctagtttcatcttatagggcttccaaaacagagaaattcccatttgtggtaactgcatagaagaaagtaggattgtagaaatctagaagagttctataggcaaataacaaatagcaatttgctctataggcaaataacaagaacttgaaaacagtgcacacagctatcatctaataacaggtgtattctagctttctttagaaatataactcgtgtccgcatttttttctttaaatcatagccatatgggaaattttctattttgttatggttctcttttattgatgggcatgcagtgagtgtttcttggaaatggccaatttttattaaaatatttctggaagaaaaaaaagaacagaaacataactttttcttcctacggtgatattggcttttccaaaaatagagtaagacaaatttgtttctaaaataaatttagtttttatcaaatattgcctgcaagaatagtgatttgaccacatagtaatctcagatttaaaaacctttcaaagctaagctggtggcaagtgcctgtagttctagctactggggaggttgaggtgggagaactgcttcaccccaggagcctgaggttacagtgagctgtgattgtgccactgcactccagcctgagtgacagagagaaaccatgtctcaaaaaaataaataaaaaataaacataaataaaaataaaaatttcttgaggttaataagataacccaagacagactttaggttatacttacagtcctaatgttcctgcacctgccaggaattgataatttttattcatctactctaaggctgagaaccctagaagtcaggcagtttatacatattctcagatatgacatttcagtcaaagccttgatgatataaccaattgttgccattgtatcctgctatagagagagagttaattttttttttatttttaggagagacagagtttcaccatgtatgccaggctggtctcaaactcctggcctcaaggggtctgcccacctggcttacagacatgagccactgtggcaggcagagagagcaaatgttattgaacttgtataaataaccatattaccgtaaaaaataagaatactcacaaaatctctccaaactttggagagagaaaattggaagaaggaaatgcttctaccttgttcacaaatatatagtttaccaaatcattgtgcactatagacagcttagggaagaaaatttccttaaatctggaaaacaaaacatttaagtgaagaactaacagtgttttaaataaaagtcaaaaacattatcagttacttaatctcatgcaatttatttttgttctgcttgagcttgattagtagtttcatgaattcatgtttcttcattggagttctcaaacatttgcatttagtccattgatcttaaagtttttattaacctatatctaagagtacttgttagagtcgcttccataaatttgcttgcaaatgcctttaaagaagaattcaaaacaatagctgtggataaaaacttagaatagccatggctaaaaatctgatgggagttcattataataagcaattaacatggaaatttagttatttttgtgccacacaacataatgtctagaattttaactaatgtcatattagatttttaagaattttatataatttgggtagatacccataaatgtaatgcaaagaagatctagtatcacttattatttgacagcatttagcatgcagttcacaaaataagactaatcatttaatatttctacaagatgagagatacattctttgagactctccagagtctctggaaaatccaaaagttaatttcaggtcaataaaacttaagttagaattttgattcatggaaacctgccaaagattttaaaaggttgaaagcacttgataagaagttactgtgaagtaatagtcattcatgtaaccagagtgattatcaaaagacgatagagaaacttacgtggaatcttagtgctttcaaaactccattttcctaagtaatcaaatactgaataaagataacacaggaaattatattgataacatataaaatgtttgtttcttaggccagttattaaaaaggtaagaaacaacttcagcaggttgattgcttctccttgtgagaagccaatgtataatagataaccaggtagtcgacctgatgaaaagggtacttgaatttaatctgacatagaaagaatgagtccaaggttaggaatgtataccatattatacaggaatgtaaacaagaaaactagcaccttgagcaggggaatacatggtccttagtaatagcacgggaagtttcttggttacatgggataattccgacatgtcaagaaaagccaagagtacaaaatcaaggtatactggtggaagacattgcctttgtaggccttcaagataaactttttttttttttttttttttttgagacggagtctcactctatccccaggctggagtgcaatggcgcgatatcggctgactgcaacctccacctcccgggttcaagtgattctcctgcctcagcctcccgagtagctggaactacaagcgcgtgccaccacacgtggctaatttgttgtatttttagtagagacagggtttcaccatgttatccaggatggtctcgatctcctgacttcatgatctgcctgcctcagcctcccaaagtgttgggattacaggcataagccaccgtacccaagataaacatttaatggacaagccataatagcagagttagaactgggggaaaaaaaacagttacaggaaggaatggaaaacttaaaggagagagttatcccaggccttctcaagggtagaaagacgaagagcagaaggcaatgatgtatgacctgaaaatcacatgcagcaagatatagcaaaagttgaacttctgagacatgaatctgaaaagcttccagaggaaacctctgcctcaagaagtgaaattaccattctaaatgaagaagacagcatttctaacccaaaactagggaaattaaatggatctcaggaagaaattttgcagaaatagaaactgcagttcagaagatggcagttaaacagatttcagaattaaaaattatgatctcttatggttttactaagagcagatcagtacttcaagaaaaccttgttgttctaacataggggatgaaaattttagttttgttttagtgtatttttaatagcaaagctcaatctttaggaaggcttataaataattgccttctaattacaggcaacttgatcacacccacaatttcttttataaatttatccttcataaactttatcgtgacttactcagaccttttacaacatgcttaaactttctgctttgtcctttactttctctttattaaataaccagtcattttactttaagacaaaaatttaccacataagattgtttctcataggaaatgctcttttctttttaactatccttaccaaaaatacatccttatatccataactttcttcatattactctcctacttatggattcctgtctgtcttgtttctatttccattctaaatatacttttcgaggcaacctttaagtaacctctgaactggacaaaattattctattttctcagtaagaaacatatttttatgccttgtaatttcattcatcaaaacacatcttattttggtatactttgtgatatgatttggctgtgtccccacccaaatctcatcttgaattgtagctcccacaattaacacatgttgtgggagggacctggtggaaataattgaatcatgggagcagtttcccccacaaatttctcatggtagtaaataggtcttacgagatctgatggttttataagaagtttcccctattgcttggctctcactctgtcttgcctgctgccatgtaagacttgccttttgccttccaccttgattgtgaggcctcctcaaccacgtggaactgtgagtcccttaaacctctttttctttataaattacccagtcttggatatgtctttatcagcaacatgaaaatggattaatacactttgtatacagaattatatataaattaattaggattttattcttagtaaccttaatttctagtgaaaacctaggaagccaaaaattttgaattctctgtcacatatcagcattttgtaataagaactattttataatttttagaagcatgttttaatagactcaaatatatttaagaagctgaaaacaacttatatttatgttcagcaatttgttcttatttttatggaaatgacccagacatttgatgagtgttttttatttaatgtaacatagcataaccttatgattttaaagtacatgaaaagttattttataaacatttattccacattccatttattccaaatgtttattttataaactttttttttttttttgagatggagtctcgctctgtcgcccaggctggagtgcagtggtgcaatctcagctcactgcaagctctgcctcccacattcacaacattctcctgccccagcctcccgagtagctgggactacaggcgcccgccaccatgcccggctaattttttgtatttttagtggagacgaggtttcaccgtgttagccaggatggtctcgatctcctgacctcatgatccacccacctcggcctcccaaagtgctgggattataggcgtgagccaccgcgcccggcaaacatttactccatttacatttacctaatttactgatttttaacaattcacctagattacttatgaaaactgaaatattacacaaagcgaatcatcatttcaagttattgtcctgttaaccatttttgtattttgtgaatatcaggtgtttgtttaagtaagagcctgaaagtaaaatacacaagtattttgcctgtaactcagaagctacaactgtttttattaaaccaatattaaattagtcctacttatcaaggagttacacaaagattattctgttttcaagttgacttcatagcttcatgactttaaaacatgtagcagaaacaaatacaaaacccagccaaaaatgtatgctgccagtttcgaagatatttccatttttattttaccaatgatttaaaaaccatcttatttatcaaagttttatttaagtcacaggatctaaaaggcatttgggttaattactatatattttatatgtgtgataattcatctaagccaatcaaaataaaatttcttaggagttttttttttggccaactattccacattttactatgtagatacagcataacatatattatctaacataatgcatgttatataatatgtattattcatataacatgttattctataacatgtattattcgtgttctatgaatatactatgaatattatatttcattatacattttattttacatttcttagattttactatgtagacataacatatataaaatgataaatgttatatgtattattcatgttatgttatatgaatactattcattgttatatccattaatattcaataattattgaatattattaatttattaatattaatatcaattatttaatttaacagtgttaaattattgatggtatttaatgatttgataatattaatatttataatgcaataataatgttctataatataatatgtattattataacacctattccagattttactttgtaaatacaacataacatattatataacataatacatgtacatgttggtaaccacacctaaacacatagacatacatacacaaagatcttactgcttttattttagaattttagccatgagatagtaatacaaactcacccatttataaacaacgattgcattcaaattatatttctctcaaaattgggacctttttacatagctaaacttaaatgctaatctagtgaaggctatggatcaaagttttggataaagcagtttgattttttaaaaaacctcttttacctttttttgtttcctttcttcagcttcaaatgagtttacattttagctgggagtgacgaattgtataagaaaaacaaaatctccagtggccttgaattagtaacacatttatctttgttcactgatcccctttgctagtcaatggttatggggaagcatcttaacaagagttttgttttccagctatttttttttaacggcccctgtgtggcagacacaacagtttttatgctggaaagagataccttatattactgttctgacctcaagattttgacctgagagcctaaccttcataatgatttatctaatttttattattttaggctatcagtccccttagttaactgctctagcatcctaagcaattggtagccaggcaaacccaaatttacatttgcaaaagatgtctaggttgttggttactttggagctgttgtaatatgtaaagccatttatttaaaagccctttaagacttttttttttttttaatcttggctagaatgccataagcactgaattttatctcaacaccagcagaaaagtcaactgatttaggccaggcacagtggctcacgcctgtaatcctagcactttgggaggccaaggcaggtggatcacttgagttcaggaattcgagaccagcttggccaacatggtgaaaccccgtctctactaaaaatataaaaattagccgggtgtggtgatgtgcacctgtaatcccagctactcaggaggctgaggcaggcgaattgcttgaaccctgcctggaggcagaggttgcagtgagcctagatcgtgccaccgcactccagtctgggctatagagcaagactctgtctcaaaaataaaaaagaaaaagaaaagtcaccagatttaaagtaggcagtaaaaaaagtagagatagagaactaagaaggctctgttatctatataatcacaaactcttaatttgggggaaaaaaaaccaagaaaatagaaaaaagaagcttggggagttcaaataatctgtgttgtggctgttgatccaaaaacatgcatgaggaaagccttgtaattagctggagtctctgaaaacctggcacaccttcatgtgggagaatcccattctatttcttatcaatctcttgagagcaaagaaaattccataaatcctatctgagaatgtcaggattttggacttgtgtctcttcctgtgacattttggtaatgttcattgttattatatctgatttaaaatactacataaacttagttgataaagcaggggcaggatttgagaagattggctccaattttgaaagaagttctattgtaggtaagaattatcaaactgcatcaattgctacagagaaacttttcatgaaaggaagagtcgatccatgtgggaaacttcattgttaccttattttaagaaattggccacaaccaccccaaccttccaacaaccaccaccctgatcagtcagcagccatcaacaccaagacaggaccctccaccagcaaaaggattgtgactcactgaaggccaggtgatcattaacattttttagaaataaagtatttcttaattaaagtacgtatttttttagacataatgctgttgtacacttaacagagtacagtgtagtttaaacataatttttatatgtatcggaaaaccaaaaaatgtgattcacttcatgtggtattcactttattacagtagtctgaaaccaaacccacaatatctccaagttatgcctgtatatatatctgtccaaatacatatacacaaacaggcacacacacacacagagctcattagaactccagggagaaattgataagtccattttcatcttggaatatttaacatattttttcttttttccttttttttttttttttttttgagaaagagtcttgctctgttgcccaggctgtggtgcagtggcatgatctcagctcactgcaaccttcacttcccatgttcaaacgattctcctgcctcagcctcgcaagtagctaggactacaggtgcccgccaccacgcctggctaatttttgcatttttggtagagatggggtttcgccatgttggccaggctggtctcaaactcttgacctcaggtgatcggcctcccacctcggcctcccaaagtgctgggattacaggcatgagccaccgcacccagcccatattttttttcaaatgttgaaatatcaaaagacaaaaattactaagactatagaagatttaaactacacagttaacatgttgacttattgggcaaataaggaaccttgtacctaatgatctgagagtatacatccttcttaggctcatatggaacatttattaaaaagaaaccaagtactagacatcaatacatttcaaagaatgatattatactatagttctctgaagaaagcaaaattaaataagaaggcagtaacaataaggtttttaaaaatctatttgattacaattgaaaacatacttttacattactcatggttctaaacataaataatttaaattgaaaactacttagagcctaaatgaaaataaaaataatatgtcaaaattagtgggataaaataacatgtaaggaaatgtatatccttaaatgtttatattaaaaagaagaaaagttgaaaattaataagccaagtttgcaactcaagatgatatattaatataaacaacgttagagttggccgggcctggtgactcatgcctgtaatcccagcaacttgggaggctgagatgggaggatcccttgagttcaggagtttaagaccagcctcagcaacaaagcaagacctccatctctaccaaaaaataaataaatggggggatgggagtggggcagtggtggtagctactcaagtcccagttcctagagaggctgaggcaggattacttgagcccaggagctccagactgcagtaaactgtgattgcaccaccgtactacagcctgggtaacagaatgagaccctgtctctaaaaacaaaacacaacagaacagaacattaaattcaaatgcaatcaaattgaagttggtcagcaaattgatcaataaagtcaaaagtttgaaagggaccaataaaatagacaaacctatggcgagactcatcaagaaaaaagaaagtgaactcaccaagaaatgaataggggcacctaattccagatccacttactcattctctcattgtttttgagcaagtgacttctgagttctagatatacagcaaagataaagcaaacagtctcagttggtggagctttcaatcaattagcagaattgaaaaaaaaaatagaatactgtgaacaacattatgtgaacaaatttgagaatttttgttaaatggacaaattcctagaaatgtgttacttaccaaaaccgatttaagaaaaaagtataaagtttagattatcttctagccattaaacctttttaaaacagtacccctagacggcaagtagaaataagttctaccaattttttttaatccaaggacatttccaattttaaataaacttttctagagaatatgaaaagaggaacactttttaacccattcagcaaagccaggatattatcaacaccaaaatcagacaaaaaaaaagtgcattagtctgttctcatgctgttaataaagacatactcgagactgaaactaggtaatttataaaggaaagaggtgtaattgactcacagttccacagggctggggaggcctcacaatcatggcggaagacgaaagagaagcaaagtcacgtcacaaagacaggaagattgcaagccagtctcactcatgaatatagatgcaaaaatcttaagcaaaatatttagcaaaccaaatctagccatgtataaaatagataatatatcattgccaagttgggtttgttccaggaaagacaagagtgatttagcattgaaaaatccacgtgtcattcagcatgttaatagattaaaggagaaataccaaataatcatataaacagatgaaggaaagttatttgacaaaattacgtgctcattcatgataaaaactctcataaatagtaactagtgaaaacctacagtaaactattgctgagcatttgctcagggccgtgcaattagttggaaagaggagagcgtgcaagagcacacacacatttatgaaagcattttggtatatgaagaggcaacatacctgatcattgaagaaatgattaagttttccataaactgtgctgagacacctgattatccacatggaaaaaatttaagtggatccctgtctcataccatgcataaaattaattccagacggattagaaacttagaaagtgaagggccaaattaaacttttattttttaaatgaaaagggaaactggccttaagacttcagaatggagaagtatgtattcaacaagacatcaaaaacgcataccataaatgaatgaatccgtaaatttaatcacattgatatcaataactcaatcaaacaggcattaaaaagagaaaagcaggccaggtgcagtggctcacgcctgtaatcccagcacattgggaggccaaggcaggtgcctcacttgagctcaggagttcgataccagcctggccaacatgtgaaaccccatctctactaaaaatacaaaaattagccagacgtggtggcgcatgcctgtagtcccagctactcaggaggctaaggcaggagaatttcttgagcccgggaggtggagaggttgcagtgagccgagattgtgccactgcactccagcctaggcaacagagcaagactccatctcaaaaaaaaaaaaaaaagagagaaaagcaaaagatacttcaacacatgtaactgacaagagagcactaaacaaaatatataagcaactcttaatattgaatgataaatctgtaaaacatgtaaacagtcctttcacttggttgccaggcaaatggccaataaacacatgaaaagatatatagcctcgctgttcatcagggaagtgaaaattaagaccacaaataattttatagccaccaaattggaagagtgatactatcaagtctcagttgaccagtggtctgttatgtcacccataggagtgtgtatggatacaccaaattggaaaacactttggcactatattgaaaaattgaagtggaatataccttacaatctgggtcttggatgtaataggtcacaaatggagaagtggatgactttctaaagaaagtcaggttcagccatcagtgagcgaattacaacagatagaagtagtgctttggaaggcctgtgtcctcctgatgaatgacatttcttgaccaggcagggcacaggagacttctaaactctcaagtctttttatatcaaaaataaaaacataaaaataagtacaactaaaaactttggcaggccttgaaaagggataaaattctgaaggtcaggcatggtggttcatgccagtaatctcagcactttgggaggctgaggcaggtggattgcttgagcccaggagtttgagaccagcctaggcaacatagtaagacccccgtctctacaaaaaataaaaaattagccggcatggtggcatgtgcctgtagtctcagctacttgggtggctgcggtgggacgtttgcatgaacccaggaggcagaggatgcagtgacctgtgattgtgccactgcactccaacctgggcaacaaaacaaaaaactgacatatgctataacttggatgaactttgaggacattatgcttagtgacctaagccaaacacaaaaggacaaatactgtattatttaacttaaatgacttatgtaaagtggcatgaaacatgctacttaaaatggcatgcaatttaaaatatgaattatttctggaatcttccatttaatattttcagacagtggttgacctctggtaactgaagtggagaaaagcaaaaccccgagtaaggagaggctgttgtactcccaagggaagaacataaaaaacagcaattaggaggtccttcgtaaacgcggaacgggattgaaaaaacaaaagatgggaggaagcggagaaaaagaatgaaaataggccggacacagtggctcacgcctgtaatcccagcactttgggaggccgaggcgggcggatcacgaggtcaggagatggagaccatcctggctaacacggtgaaaccccgtctctactaaaaatacaaagaaaaattagccgggcgtggtggcgggcgcctgtagtcccagctactcgggaggctgaggcaggagaatggcgtgaacccggggggcggagtttgcagtgagccgagattgcgccactgcactccagcctgggcgacagagcgagactccgtctcaaaaaaaaaaaaatatatagcaaagatgcactttgaccaggactctgagacccagattggcctggtgggacagacggtgttcttgggtcatccctgagggctccacagaaatgtccaggcaccaagaggacccagagggtctcaccatcccgctcagtcccacccgggaggtgaatcatcccttcatccagcatctccatgctgtctgcactactggcctgtgaatcacttagtagccatctcagttatcagattgactctctgggatcgcaatgcttgtgttcaagtcgccctaattttacttcgtcatggctccaaagtgcaaaagcagtggtgctgacgtattataattattcagttttattataatttattgttattaatctttcactgtgcctaattatgagttaaactaatcataagtatgtatgtataggaaaaaacatggtatggagttaggtacgtgatacggtttggctgtatcaccacccaaacctcatcttgaattgtagcccccataatccccatgtgttgtgggaggaacccagtgggagttacgtaattgaatcacgggggtgattttccccatactgttcttgtggcagtgaataagtctcatgagatctgatggttttataaggggtttcccttttcccttgggtctcattctttctcttgcctgttgccaatgtaagccatgcctttcaccttccaccatgattgtgaggcctccccagccacacggaactgtgagttctccattaaacctctttttctttataaattacccagtcttgggtatgtctttatcagcagcgtgaaaacggacttatacagcactattgcatggtttcaggcaaccattctgggttttggaatgtgtgcagatactactgtagacagggggaccctgcctctcctggtctccctcagctcacactctgctactccaaaggagagtcaacctgagcagccccctgtgggaaaagcgggagccccatgctgggtcagatgattgaaaatgtcatttaaagcgagaatcataaaaatattttaaccttgatttgctttcttttcatccacaggccaggttttttgatctgctaattgagtgctgtattatcttgcataaaccaccctcatgcatcttctgtggttatcggtgtcctttcattcaaagtgaaacaagaacttaaggactcttccaaaacaattggaggacggtcctgggttagttctattttcccccctttagtctcacccacacctaacacaaaagcaaatttgtttagggacttcttttcattgagctgttgcaaagcgtttagtttgcctttcagggaaacagcaattctttgtagttacataccataaactcaaataatatttaattagatttccaattgcattagaaacacaagatagaaaaacaccttcggtaataatcacagctcactcttgctgagcacagagcccatttgtaggaacagacatcctctgacatcctactagcgagaggcttaccagccttgggcatctactttgccctaggtgtccatggagaactttgtgctaagtagaggttggttaagagaacttctaaggggagaggtgttttcactgaagaggcaaaagtgtatatcctttgggagccaagcaatcttgtaaattctgatgacagttttgcttcttaccaactgaaggacttgagtaaatcacttaacctctcccaggttcagttacattattgagaaaattgaggccattattctttgccccattctcagccatgccccttgagtgctccatagaaatacacttgactttacctcagtctttgtgtttcaggaccttcattgttatctctttagtccttacgcttgatgactcagccttccctggctgagtcttaaattaaaaagagaagggaagggcccaagggagcatctttttatcactttaccagtggcacaaactcttaggagaccagagtgtgtagtgtgctggtttacagaaaggagcatgagagaattctgtgaaactttgctctagttcttgagcctttgatggaccattagagaatgaagctctggccagaatcagttggtaatgaccaggaaagggaaagcagagggtctaccaatgggtctctctaggggtttctagagtcccagagctgagtgagccatggttcctgctctcagaaaagtctctagtgagacctaattggtgagtaatggaaaattccaatagagtctgctaggtgctgtgatgtaaggaagtgagggagcctaacagagcaagaggagggactctaaagaggagggactctaaagaggagggactctaaagaggagggactctgagccagttggggagtgtgatgcagaatctgaatctcaaggaattcagattcagataggaaacctgagctgaatcttgatatccaaactcccagacacctgaactctcttccttccccatctgctgccctcacactacccctcagccccaaaacatccttgctgcccctctccacagtcctgtgaaaactgctgctcctcccctgctcatatctccagagcagggagtaagtgcaaggactacacgagaaagagtggaaacccaaatgcaagttaagaagaaatagatgcacacagctgggccattgcttcaaaaatgtttatgtagaatgcattgagctctttctggaatcaacaggaagtacatttcagaggaagttgttgtgtcaaacccctgtgaacctcattaggaaagtcatcagctccaagaggctgaagaagagacccagagacagcaaaccagaaccagacatggtttatttttatttttatttatttatttattattattatttttttaaacagtcttgctctgtcacccaggctggagtgcaatggcgcattctcggctcactgtaacccccacctctcaggttcaagcaattctgcctcagcctcccgagtagctgggattacaggcatggtggtgcacgcctgtaatttttgtatttttagtagagactgggtttcaccatgttgggcaggcttgtcttgaactcccgacctcgtgatccacccgcctcggcctcccaaagtgctgagattataggcgtgagccactgtgcccggccgacatggggttttatcgggattacatacaggggagagagtccagcggcagcaggctggacaggagagctgccttatgtacagaaagagtccagtggcagtgggctggacaagatacctgccttcgtacagcccagtggcggtgggctgggcaggaaaactgcaattatctgcaaacatcacgcagtttatatagcattttcacttaacactctcccactaatgaccttgatacggtttaaatctgtgtccccctccaaatctcatgttgaagtgtaatccccagtgctggaagtggggcctgctgggaggtgcttggatcatgggggtggtttctcatgaatggtttagcaccatccgcatcgtgttgttcttatgatagtgttctcacaagatccgattgtttaaaagtgtatagcatctcctccctctttctcttgctgctctggcccacataagacatgtgtaagtttctgccatgccccttctgccatgattgtaagtttcctgaggcctctctagaagcagatgccactatgcttcctgtacagcctgcagaaccatgagccaattagacctctttataaattaccagccctcagggtttttttgtttttgtttttggagacacagccttgctctgttgcccaggctggagcacagtggcgtggtcttggctcactgcaacctccacctcccaggttcaagcagttctcctgcctgaacctcccaagtagctgggactacaggcacacgtcactacgcctggctaatttttgtatttttaatagagacgaggtttcaccatgttggccagactggtctcaaactcgaacctcaagtgatctgcccacctcagtctcccaaagtgcagggattacagatgtgatttctttatagcaatgtaagaatggactaatacagaactctaactggcaaccttcatttaacccaaaactcaggactttggtcccatatatgggctcagatgttccttatagacaaggaaggaatctctgggttggccactcctagattgtctagctcagaacacacgttaagatgagtctgctggctgggtgcggtggctcacgcctgtgatcccagcactttgggaggccgaggcgggcagatcacaaggtcaggagatcgagaccatcctggctaacacagtgaaaccccatctctactaaaaatacaaaaaaattagccgggcgtggtggtgggcgcctgtagtcccagctactcgagaagctgaggcaggagaatggtgtgaacccgggaggcggagcttgcagtgagccaagatcgcgccactgagctccagccttggcaacagagcgagactccatctcaaaaaaaaaaaaaaaaaaaaagatgagtctgccatacagggtcgttctaagggttgcttaagttgctgctctcaggtgtgtttatcctacagaagtgagctgtcacagcttcattgtgggcctcaaaagatgaaaaggagttttccaggatgattggctgggaatggtgttccaggcatgacctcacttaatcttcccaagtctcacaaggtaaatcttttttcattttataagtcagaaaatgaaggatcacacaggttaagtcacttttcttgcccagtcacacagctaaatatgacagagctgagattccaactcacatctgtctgattccaagtccgcagcattttcctctgatacagcaatgagtttctacctgaaaatattttccaatgaaaacatgatatataacataatgactgtatagaactattgtatgggactgtatacagtccctcttgtgtagggctattctgcatgaactctgtttggattaagtgggttttagagggttaactccagaacagagccccttaataatactatatccttgaaaggacatttgaattttttttttttttttaagatggagtctcactctgtcgcccaggctggagtgcaatagtgcagtctcggctcacttcaagctccacctcccgggttcacaccattctcctgcctcagcctcccgagtagctgggactacaggtgcctgccaccacacctggctaattttttgttgttgttgttgtattttaagtagagatggattttcactgtgttagccagggtggtctcaaactcctgacctcatgatccacccggctcggcctcccaaagtgctgtgagccactgcacccggccaggacatttgaattttaaacaacagactcagaggctgaattttagaccccagtccatttataaattggtaattgagtacacctaaaagaaaaatcctaaagcagaagagaaaaaccaagagaaaagatgccagccataggaggaaatgatatatcttcttaggggcaatttatagcatttgcataaaaaaagtagcccataactcaagcattgaaacattttataatagttagagttgtgtcagtttctacatctttgggggaagatgaggggctaccatatatcagcatactgaacatgtcacagctaagcagactacagtgaaaaatgaggcagggaaaacacagggtaataagaatgatgaatgttaaggttgattttggaggattgggatggatcaaggaagaaaaaaaaaacagttggttttgggggagaagatctaaaatctcgaattactaccttctagtcagacttctctttcacttcaggccagtgccggtttcatttctttcattgtatgacctgcgtccaagggctgtcagtgttttatgatctctttgtgcactgctgtgaccagtaaactcaaggagtcctcaggattaaatatgaggcagctggctcctgtttaagtaccctgtcctttgggactattgccctgtggcttgtatgcgggatctctcattcccccagcagacatggcagagcacccactctgggccaggctgtcactgagttctttaactcaccctaaccaagtcttttcatctgaaaaactaggaacttttcctcatgagtctaaagtcatcctcatgactttatagaagagatggaaagattaaaagggacaatacataaagcagtacaaggctttgagacattgtagtaaacctattattcttttttgtataatttttttttcttttttgcgacagtttcactcttattgcgtgggctggagtgcaatggtgcaatctcggcccccctcaacctctgcctcccgggttgaagcgattctccttcctcagcctcccaagtagctgggattacaggcatgggccaccatgcctggctaattttgtatttttggtagagatggggtttctccatgttggtcaggctggtctcgaactcccgacctcaggtgatctgcctgactcagcctcccaaagtgctgggattacaggtatgagccactgggccaggcatcttttttgtataaatttaagtggtacaagtgcagttttgttacatggatatattacatagtgatgaagtcggggcttttaggataaccatcacccaaaataatgtacattgtacccattacgtaattactcatccatctcccctctcccaccctctcacccttcagagtctccaatgtctgttattccatgctctttgtccatgtgccctcactatttagctcccacttaaaatgagaacatgtagttatttagctttctgtttctgagtatttcacttaaaataaggcctccagtcctatccatgttttcattccttttcatggctgaatagtattcatatatatatacctacactccacattttctttctacgttaagccattgatggacacttaggctgactctgtatctttgctattgtgaatagtgctgcagtgaacacacaagtatagctatcttattgttacaatgatttcttttcctttgggtagatactgagtagtaggattgtgagattgaatggtagctctgtttttagttctttgagaaatctccatgctgttttccatagagatactaatttccattcccaccaacagtgtataagcattctctgggaatagtttccatttggctagtgggcagacacataaaaaggcactcttcctactcctctgttctgtcttgtttcttttgttttctcttctctttctttcttttctttttttctttttcttttttgatatggagtctcactctattgcccaggcacagtgcaatggcatgatccccgctcactgcaacctctgcctcctgggttcaagcaattctcctgcctcagcctcccaagtagctgggattactggcacacaccaccatgctggttaatttttgtatttttagtagagatgggtcttaccacgttggccaggctggcgtcaaactcctgacttcaagtgatccgcccacctcagcctcccaaagtgctgggattacaggcatgagccaccacgcccggccaactctcttatttcaaagaagggaaatagagacacacaaaggttaaacaccttgcctaaggttaaacaccggttggtggcacagctgggatagtacctgaccttcacatcatgtgtccttggatcatgccagagaatggcaggctaagcagacgggaccttgggtgacttaagcttgagtctgttgtcttccctcagcactcatccattttttgctcctggataattttcagaactgaactcttttgagttttattgatttcagttgtccttcattggctttttacacatagctgataaacttccaatgcagttattgctagaaacaacaagattcctagaagcaaagtgatgtctctggaaattttaccctatgacagcattttccagagtgtatgtccaaacagttctaagagctgttaattggacttatttaaaatgggggaactggggaggaggatggggagagcggagttctatgtactacataccaaatactgtattaggaagtcctgcagccagaaaatctgattgattttgttgatccccagcatttcccacatctattttatatcaacacacaggaaagactcccctttgattacagaatgcctggtaggacaagttccttagaagcccacacttccttacataaatactggctctattaagaagaacacaattttgagcaaaggaagcaccattgtaaagattctggaaaagaccataaattgaatggatcatgggttcataacttggccgtgatcagagaagagtaaccaaggtgagcaagagacaaaggtttaattttccagttatcacgaaggggacaggcaggtagcatatccaggtgtacatttgaagatccaaactatccttgaggaaagggctgcaaaacacatttcagcctagcaagctacccagtattgagtgcccgttgtatgcaagggtttgaagacacttagtgaagttgaggatatagagacaagttcatcataattcctgccctgaaagagccttacaaacaggggatacagaagtttcaactgctaatttccacataatgtgaacaatactgtgcaatattgcttagaggtatccaggtcagaaatgaaggtgctacataaaaagggatagtacgaatgaacacaggggcctaaaagatcatggtgtccagaaataacaaggagataagcagagagttcaggctgtgtactaaggagcttggaatttaaactatgggtcacagtactaaaatatttctgatctgacctattccaatgcaaacatatttttactgtggtacatgaatacactataaaacagaaaagtttcattttattatatgtttgagtaattttaagttaatttagtaataataaacccttttgctcttatgaaaaacataagtattcatatgtttaaacatagcaatattattgaatgtgcttcattatttttgaaatgttggtttagtactttgtgacacagtgtttcatagtcttagttttaagggcatgttatacaaatactagaatttaatggctatgactgcaaaaaggatccctcctaaaattcacagatccaaatggaaaaaaagtacatcattggctggctgaatacattttatactcattgtttcagtttaatccaaaagtcatacaaaaatatttgtagcattcagctattatatttaagtctctcttgatgaccatcatttgcttttgataatttattaaatattctttagcattttgataacacattcaaaacccaccatacaataagtcctcacttaatgtcatcgataggttaacggaaactgtgacttttcagtgaaacaacacactatgtgccatagaaacttaattcttgtttatatcaactaacaaggtaaattgatttctttatagtgtatataatttcacttgaagttgcagcctccaagaacttatcaaccttaagtgaagactgtaattttttttatttgcaagttaattttcaaagttaaatctattttgaagttttctaagtatatagaaatgagggctttgataggtaacatcatttcttggcctcacaatcccataacgatggaaacaatttcaaacatttattttctaaaagctctatcctgtttcagagtttctgtctgaaagcacaatatttactttctcatttgtcacctttccaccgaagggtcagatttaaagtgtgtgtgtgttttcaaaagtgtgagatagaatactaccagcaaccatcctttcttcacgtgtgccatctcttacatgtcctttgctttgagttagccagcaaagctgtgtgttacagattttcattgccacctctcatgtcattagaaagtattgtacaattgtaatgctatttttagtcttgcctttataaaattatctaaatcaatggcatctagcagcgcttgtgcctgctggcctcaggtactctgttgcaggcttgcttagcaatgatggagtcaaggaattcattgcatggtgctgactctgtgaccttactccataattcttttgttattccagttaaagcactgtacctctaatgattccacatactctcttttcataaaatatcgttatcattaaagtaggaatttactgctcagtgtataactctgcaggacagctttcctttagtgctcacaaaaaaagtcattctttctgtctttcattctctaaacagaatctatcacgtagcgtaagcctacacacagtactctgtactttgatttaattccatagcaaatctcccatgtaattcagtctaatactagttgcttccatccttcagcgtggttttctctgactcttcctgcaatatttgctgacaaaggaacttacttcattttgttaccatattatctttgtgtatttttacagccatttttgccaaggcaaaaaaaaaaaaagaaaaaaagaaaaacaagtattctccttactggactttattgtcctttattctgatgaaagaaatctctaaagcaacttctaacctcttttcacagagttcagtgaaacgttgtcaagcttaagaccgactttcacaagactttaaacatcatccagaaattatggtgacttcatctgcatattctgaatgctttgtttttaaatgtcttgctaatcacacatctttgtactaacattaagtaatatatcaaggcataatacacagtttgaagttcttcctgaatgatagtggttgtaaattcatatttcaaatagtcttgaaaatttacattttttgccagtttcttgtcagatccaattagggagtcatttctctactttgtaatgtagctaaggaagagcttatactgggaacagaagtgtcagctcagctgttttcttgctattcacatcagcttgtcttattggtattctcaatctgtagctcctttgtagaactcccttttttaattataaacttttatttggaaggatgttagacttaaaagtttaaaaggtagcataaagagtttgtatatatctgtcattcggtttcaatttcccctcacattaacatcttttttttggtgggggtcggggaatggagtcttgctctgtcgcccaggctggagtgcagtggtgtgatctcagctcactgcaacctccacctcccaagttcaagcaagtctctccctgcctcagtctcccaagtagctgggattacaggcgcctgctaccacacctggctaatttttgtatttttttttaagtagagatggggtttcaccgtgttggccaggctggtcttaaactcctgacctcaggtgatctgcccacctcggcctcccagagtgctgggattacaggcatgagccaccatgcctggccagcatcttctaacagttgtacattcatcaaaactgacaaaccaacatcaatatattgcttttcaagtaaacttcaagctttcattgtatttcactcaatgtttccatttaagctttatttccttagtctccttgggtctgtcataatgtcacagtctttcctggtttttcgtgactgacctcaatagttttgtggagtactggtcaggtagtttctaaaatgtcccttaagttggtttgtctagtatactttctcacgattagactgaggggatagatttttggaaagactatcacagatgtgaagtgccctcctcctcacattgtgtcaggaggtacatgatgcccacatataacattactagggatgttagccattcttatgtagtaaaggcaatgtttgctaggtttctccactataaagttactaatttttgccaggccttgggggctcacgcctgtaatcccagcactttgggaggctgaggcgggtggattatgagcgcaagagatctagaccatcttggccaacatggtgaagccccatctctactaaagatacaaaaattagctgggtgtggtggcgcgcacatgtaatcccagctactcgggaggctgaggcaggagaatcgcttgaacccaggaggcggttgcagtgagccaagattgcaccactgcacaccagcctgggtgactctgtctcaaaaaaaaaaaaagtttctaattttccctttgatactttattttttgaaagtgagtcattatatctaccctgcaatggaagtggagggattaagatccatctcctcgcaaagggggtagtagtatctacatatattattagaatttctctgtaattaaagattggtcactttttctcatttatatttatttattttaaaaataatttatgtctatatatactcatttattttatactttgggttataatgcaggactcttctttaaggcattattcattttgtgagggttattttaattcaatattagtaattataaaataatattatgaaatgcactaaaaataagtaatagtatggttggttgacagaagactttgccagattcatttaaaccccagaacacctcaatatttgagagcgccatgccaccatatcatgccttctgcattgatgcagctacatatgggtgctcacatgacttagcctctcccctctctccctctctgcctttgcttttctctgttatggcagggtggcttcctgaggcctccagccagtaggtagagcttagtcattcaacagatattaattgcacacttgctatgagctagacactggttacacaatagtgaacaagacagtgcaggcctttgctcttcttgaacttacattctagtgcagaatacagctatcacacaagaaaacaaatgatcaattgtcatttcaggcaaaacgtgcaatgaaaacataaagaaatctaaggctaatggaagagtgactagcactcatgaacccaaattgaagagagaagccccttttctcttaatgtctcctcaaaaggactctgttgacccttcatgggacaggtatccatgcaagaacccatccctgtgttcttaggaatggtcaggaatgactcactggtcagctggagtccgtgtctgggcttctggctggtcaggcatgactgacagccccattagagtcatgggaagaaggcctgatctacttctgcaaagggcggtgatgcggggcagacaaaagagcaatagtgggcctcacggaaggtgcctgctgggaaccaggaagcacagctgcctctcccagggtttccaagcagcgaatcctacggtgcccacccccaagggcatgactgaaattcggccaagttagcaacatcccacgggactcaagccagctgctcctccacccaccttggtcaaattcctcagctaaggatcccatgccaacctctagaggtgggatctgcttccttctagcctgcctgtcctccagtcacacccccgaggaggacactgtggggaggctaaaatgtgaatacagtcttagtaattaattccatagagacaggaagaatacgggctggttatcactcctggtcttgtgtgggttgtctgcagggaagtcgcataaaggcagcagtcattgaggacacttaacactgtttgcatcttttttcatgtcctgctatcaagacagcatcaggaattctttgcatgtaacagaatccagttcaaattggtttttacccccattttatagcataaaggaacccaacacattgaacatgatgaacattagagaaaatacagctgaattgtctcatggattcatgaccttcccagccctgagtattgtgaaaagtcttcattttcctgttgtccttttatcccctccttagcctctacctccttgggcagggaaaaataagaaatgttacagagaacagaataagcaatgataggatataagacaaggcctgggattcatgcattggcctaagtgtctacattttccaagtgagaggactaagtcatcaatgagttgggtctcttttcttcccctttcctggataatgatgtgtttttgtctgggaagaaatttttcttttcttttttggctgagactcctaaaaaccaaaaggcaataggaatctgtgtgacaggagccaaagagttatgagtaccaggaccctagactgcactgtggcaaaacttccatggctgaaagagatgtcttggtataaagggcaccatttttatttaatttttatttaatagcagtacctgataattgtcaggaattggaaaggaaaaggaagggggatgaaagggaagcttcagcagctcatggggagcataaaaaagctgagatacaatccatggggagtcaacaaacattgaccaagcctccttttgcatgcaaagttggatagaacacagctcttgcattgaaggatccagcagtccgggatgttggacagtgtcactttagctagtgctgagcctccctcagagagaatcatgtgggaatggagcgtgtatattccacagacttgattcacatcacaagcactgagcatggatctgctgcaggctccatggtgaacacctatattagattctccagagaaacagaaccaataggaaatagaatgtatatgtatctgaagatactaattatgagaattgacccatgggttatggaggcagagaaggcccaccatctgccatctacaagctggattcccaggaaagccagtgttataattcaatctgagtctgaaggcctgagaaccaaggaagctgatggttaaatccctgtattcgtccatcttcatacttctatgaagaaatatctgagactgggtgatttataaagaaaaagaggtttaatggactcacagttccacctagctaggtggaggcctcacaatcatggcagaagacgaaggaggagcaaaagcatgtcttacatggcggcaggcaagagggcatgtgcagggaaactgctctttataaaaccatcagattttgtgagacttattcataatcaagagaacagcacaggaaaaacccaccccgatgactaaattacctcccaccaagcccctcccacaacacctggagattatgggcactacaattcaagatgagatttgggtggggacacagccaaaccatatcggttccagtctgaaaggaggagaagactgatgtcccagctcaaatagtgagccaaaaaaaaaaacaaaaagcaaatttctccttcctcagttttttgttctatcagggcctcaatggattggacgatggctccctgtactgggaagagccatttgctttgctgagtccactgattcagatgctaatctcatttgcaaacaccctcacaaacacacctagaaataattgtttcaccaaatatcagggcacaccatgatccagtcaagttgacacataaaattacctactacaatgccattacagcttttgtttcattgatcctatgcagcaggtattattattttattttaagaggttggaaaatagaggttcaaatatagtaggtagtttggagtaacagaaaaggcaatggtttgaacctaagtcttaccagatcagtgccttgcccctgcccaacagcactcttgatctctgcctagtactttttttttgggggggggtgggtgggggagcggggacagagtctcactctgttgcccaggctggggtgcagtggagcaatcttggctcatcgcaacctccacctcccatctgcccagtactttaaacccaatttaaagtgcctgtgtttcagaatagtccccttttcgggtcactccttgaagtctagccaggaggacctgcccttggcctggcttcctctctgggctgtgttgtctgtaccttccctgtccttgcccctcaggttgtgtgacaatctgcagccccatatttaaaatcttgtttcttactcctccttcccccatagaggttctgttttcatccagccttcttcattggtaaggtgactctttcatgaagtctaaaccagatgtcttttataactgaatgaacacatgcaatatacctttatctccatcatttcatctgtcctgatattgaccacaactttgcaaagtacttgtggttctttgcaaagtacttaggttcaaacaccccttctacagatgaggggctgtctctgtgatattaggcaactaggtgcaggttacatagcaactaagtgcagctcagagctggagctgggtctggcttgtaggtttgtctgctcctccttttctctcatgtgtcataatcccgaagatgacaaggaaaaggacttgtgaaaatattgtccttctctttgaaaatccaaacaaggggataacagcgggagcttaaactccttcaagaaaaaatgacaagctctttgtcccttagacaaagaaaaggggaatatgtttctccattccaaatcccacattagtagagcttttatcactgatttactgtagacagacaaaatgtgaggattattgagaatgtcatcatcatgatttccattcttgaaccaaagggcagctactgaatactaactgcgtgccaagcactgtggcactccaaaagaataataagtcaagttctttaccagcctggaaattcacatcccaatgctgccaggtgcaggcatgtaaataaataattacaagaagcatgcaatgagttctctaatagagctacctgcaagagcctgtagagcactgaagaaggacctagcaattgcctagggtgttatgttaggaatgcttacaatgagaatcagaaaactcaatatgcagtggcttaaaataaagtagggggtttgaatttcttacctgagaactctagagtaagcaaacacagacactggctcataggagagcaatgtgttgacctctcatggtcacaagatggctgtcatggttctagtcatcacatctctgtttacgatagaaaggtgagtgaagtgagaagaggacactagccatatgtgaacctttttattaggaaatcgaatgcttccctatgtaactttttgggcattcctaggtcacgtggccacccctggctgcaaggtagtctgggaaatcagagacttggatcatcatgattggcttggatcttgggtcatgatccattcacaggggcaggggacattgcaactacaaacaaagttagtgttctgttaggaagaatggggtggagggggagacacacaaggaggtgtcaatgtgagtgttcaggaaaagctttgcagaacatgtgcatttgagctcagccatgaaggatgagctggcattggtagaaaagaaggtaggaggccaggcgcggaggctcatgcctgtaatcccagcactttaggaggccgaggtgggcagatcaactgaggtcaggagtttgagaccagactggacaacatggcgaaacctcgtctctactaaaaatacaaaacatagccaggcgtggcggcgcatgcctgtagtcccagctactcgggaggctgaggcgggagaatcgcttaaaccggggaggtggagattgcagtgagctgagatcgcatcattgcactccagcctgggtgacaagattgagactctgtctcagaaaaaaaaaagaaaaagaagaaggaggaggaggaggaggaaagaaagagagagagaagagaggaaggaaggaaggaaggaagaaaggaagagaaaagaaggtagggtattgtagagagaaaataaggacattctagcaagggggagagcacagggaaaggcacagcatcatgagagacaggtttaagaaatactaggattgccttttagcctggatatagagctggaatcataagtgggaggcagtttgcatcaggcctacctatcaggctaggtgttattctgtgggtcatagaaggtcagttggagtgttgagatggagacccattttctaatgcctcttatcccagtaacttggaagagataagatccatgttcttattcacctggccatttgcacacaggctctgatttcttcactgttttgcaccattaattacttttatgaaccctctggggtctaagtgcatcagaagtattggctggactctttccacagccttgtccttgcactgaggtcttgtttctgcctttgaactgctttcttctgtgcccttgatgggtgatagagtttctcgtgtctcctttaatcacatggacttctgctgccttcccagatgatgtttaagtttcctggacagtaatcaatttctgtcaattttctctggctcagtagaggccgactccaagtcggcacatatactcagcctttataggcatttcagatccaatcagatcacacccatggggcccctgatgcttggcagctcctgcagcccacctggcatgcaacttccatgcctccctctctctgcttcctgccagactggaggctctgcctgtgtatctgggaaatcctaaatcatcctgcagccttagtatcccaggggtgggtattagaaggggaaagtaggtttcatttctgatcctgtcatcttttgtcaatctcatgttcatttaatgatgacagatatgggagaaataagggacacagaattctaatttttctatctgcttgggttcaaatcctgactctcctactttctagctgtgtaacttcaggcaacgtgctaaacttttctcatctgacaggtaacatagtaagagcatcacttgtctcatagagttgtgtaaagagtaaatgagctatcagaagcaaagttttcagagcagtgcctggcatacagtaagtgtctgatacatgttagctgctaataataattattattattactacttgataatgtgcctcagaaagtggaacaagttatcacagattttcatcacaatccttgtagatccacatgcacttatcagctccttacaaaaatctattttgggtgcattctccagtgtcactctgtctcagatgtgaaagcctgtcaataaatgcctacaccaccagcttttcctgcccccaagccagcaatgatggctgatcctttccctcaagggaccaggacaagacattctttagcagtcaccagcttgctgcccccaagccaacaatgatgggtgatcctttccctcaagggaccaggacaagacattctttagcagtcaccagcttgctgcccccaagccaacaatgatgggtgattctttccctcaagggaccaagacgtaacatttcttagtagtcagacaagcactgataaaaatatatatatatatcagcaacacagatcctgagtcagattttcagagtgagagatgtggtttagtggaaagagcagtggcccaggagacagaagctggcctctacttctacctctgctgtgtgactctcggtaagtcactttccgactctgggtcttggtttctttccacttaatgcgcccttcccaggaaaaatcaccaacagcctctttaaatgcacgttatcatacttgtagtttaaaatggacagttttgtgataccttcctctctatctaagttgtaagtttcaggaagagagtatggtctcttgtgtgtatctctgcattcacagcccccagatcagtgtctggcacaaaatcagtgctcatcttactatctgttgaataaataaatgagatataatagaaagaaaatcatttctgagtgtgatggttaaaactgagtgtcaacttgattggattgaaggatacagagtattgatcccaggtgtgtctgtgagggtattgccaaaagagattaacatttgagtcagtgggctggagaaggcaaatccacccttaatctggtgggcaacatctaatcagctgccagcaaatataaagcaggcagaaaaatgtgaaaaggagagactggcctagcctcccagcccacctctttctcccgtgctggatgcttcctgccctcaaacatcagactcagttttgggacttggactggctctctttgctcctcagcttgcagacagcctattgtgggaccttgtgatcgtgtaagttaagacttaataaactcctttatatatctaccctattagttccgtccctctagagaaccctgactaatatactgagcaagacagatctgattttgttttaagcttgagcatgtactcacttagtgaccctgggctagtctgaggctcagactcatcctctgtaaaatgaagataataatagaaatcaccataccaggttgttttgattgaatgtgatcccacaatcacattcatgaattttgagggagagtgggagacagtccattacatctactaagctattcaacccctgcaggagagagtaaggacagtagggggctactgaggaaacgtgagagctattttgtttcctctataatcccatgatcacattcaatgtagagaagtaaataataggtattatgtatttaatatcatatatatatatggatacatacatacataaaaaaccctggcctggccggatgcagatgctcaaagtgctgtaatcctagccgtttgggaggctgaggcaggaggctcacttcagtttaggagtttgagaccagcctggacaacatagtgagacctaagctctacaaaaaataaacaaaattagctggacatggtggtgtgtgcctgtagtcccagccactcaggggaaggatcacttgagtctgggagattgaggctgcagtgagcccagattgcaccactgtactccagcctgggtgatacagcatagaccctgtctctaaaacaacaaacaaacaaacaaacaaaaaacaccagcctaatgtctagcatataatgggtattgaatacatggtagctatttaggttggtgcaaaagtaattgcagtttttgcaatttttaatggcgaaaaccgcaagtactttttgtaccaaactaaatattatttatttagatcctagcacaaggtaatggagtattctatgtcctgatgattaaaaactcaggtgcaaaatgtaaacctgaatataccttaacagatttttggatgggcttgccgatcagagggagctggatgggaaagcactcttcagaaccgcctttgcttgcctaagacctcgccatccactcccccatcttccttcttatgtaacaccagcacttgcctgtagtgaatacacaaactagacagatgcagagcgggatgaggcttgatgagctaacagacggcttgcggtgggttgtggggcaccaggagacctgggtcctagtcccaaccctgacttggcacagactcaccatgtgatgttgggcagactcatttctctgtaaatttcactctcctcatctgtaaaatgctcagccctttaggactagatataatagtagttaagaacctcaggtttgggcttcagagttgacttccagtctcagcactgcaacttaccagctgtgagatacaggcaagtcacataccatctccataaagtggacagtgggattcaaatgggcttgtttggaggatttaatgagaccatgtctcttaagtacctggcagatttgtgcacaatccattaagctttgtttgcggggtccataggccagcccttcttttcacttagtttaagtttctccctgttgaagaagcttaacatttcctcagtcagatccacatccatcaaccttcctgctggctcagcacttggcaagcaccggaatcattcgcaaagacgacacgatccccccactgggtgtgagtgacaccagcccacatgcaattattttaatgcatggcccaggatcttatgcccagatcaaatgtgttctcaggggagagtcttccctctcctacccttcaaaaggcacaagaagaaaagcacatattgcacactcatacgtccctgaaatgtaagcctcatcgaatagtttcatccctgccagccgtctctactctcctgaatgcggagtgcttgctttctgactgatggcggcaggaaggagaaaggagggcagaactccttccctgccccatctttgagagggtaggaaacccacacttatggaaccactctaacatggaagcactgagctaggcatttgtttaaccctcttacctacttgctgatccccaccttgcacttgaggaaacaggttccaagaagagaaacgagttgttcaaggacacacacagctaagtaaagagcatagctggaattcagacctcggctggtctgaggttcatagttcttactctggctactgtatcattcgttgttggttatgggagttcgtggggatgtggtttggaccaaataggtttccccataattcactgtgccatgagagagaaaactggtcttctagagcagtatttatccagccaacttcaatgggtattgctattgcacattgccaaaatagaggacagagggagctgggtcttccagtcctctcttcagatggcaggctctggaccctgctgcagactctcatagatggaacccaaccaaaggagggaaacaagaagtgactgagctgtggatacccagttccttccctcagtgtcgtagtccagtctggctgcttgatgtttatttctcagtttctggaggctgggaagtccaaggttagggcgctggcagatttggtgtctggtgagggcatgcctttcggttcatagtcagcaccttttccatctgtcttcacatggtggaagcaagcaagggagcactttggggtgtcttttctaagggcgctaatccactcacgagggttcttcccttgtgacctaatgacttctcgaagatcccacctcctaatgtcatcaccttggcgattaggctttccacatgtgaattttgtgggggaatgggagatagtccattacatttgatatactgttcaacccccacaggaggagagagtaaaggtagtagggggctattgagggaaaagctatttcatttcctctataatcagacaaagcatgaaacagaatgttttaaaagcttggcttctgtcctccacagtgtataggaaagaatgtgggcttgggaatcagacatgcttgtgtttgaagcctagctcccatgtttaccagcaaggtggccataggcaagtcacttcttcactgtttcttcccctttacgattgcatgccttgctagggtcattgtgaggactaaaagaagccaatgaatgtaaaactgctggtgaagtgttcaacccatgggtgagccccccaggagaaggctcccagtcaagggcatgagcagtggccactcagtacaggcttccctttcccgtcacaggtgtcccatggagggttctctggggactgtgctcaggtattcatgccgttgcactgggctgagccttgccttggtgtctgccaaggagcattgagaatatgatcatatatgaccagggccacctcacagtgcagtcctcatggggtctttccctggcttagctgtttttgatggtgtgtgatttccctcacctggactcaacctgtccccttggaccctctgcctccacccatcattcagggttcagcttatgtggctcaactgtgagaggccatctgattggcccagccatcagtctcctgggtccctgtgtgctgatctcagacacagtgcaagcccagtgagtagttaagcaggtggactctggaaccaggcttcagaggttccaagcctacttttctgtgaccacaggcaaattacagagtctttctgtgcctctacttccccatctgtaaaatggagttaataatcatgctgccccataggcctgttgtgcgtattaaataaactaatacaaattatgtcttgctgatcatggttattctatagtaataatgaatcatttttaatactaacaatgaatgccaccagatattaataataaattaaggtgctttcttagaataaattttagtactattaaatattctaggccaggcgtggtagctcacacctgtaatcccagaactttgggaggccaaggtgggaggatcacttgagcccaggagtttgagaccagcctgggcaacatggcaaaaccccatctctacaaaatacaaaaacttagctgtgcatagtggcatgtgcctggtcccagctattcagagggctgaggtgggaggatcacctgagcccaggaggtcaaggctgcagtgagccaagagtgcactttgttatgaccatgtcataaacaaataaatattttataaatattttattgcttttcccagatttttttttcttgtgcatatcttgtctctccaatcaaactgtctacaaggccttctgtctcggctggaagttacagcggactcttaaccatcatcctaggctctagttttgcatctcccatcctgcgacttgcatcttcttcattatgaatagagtgatctttctgaaacctagagttacggatgttcctcctgctgaaaatctgcagtacctacagtctgagtgctgaccatgggcctctcaggtccagggcatgaccccacgacgccactaccaacatttttccgccccttgtgcggaaagaccccatatctttccgccccttgtgctccagctagagcacttgagttctcatgctccaaatgagccaccccaccccaacacaacacatcttccctctgtcccaggccctgtctccctcaagctccagcacaagcatcttcttctttgatgcttctctgatcattcttcagctctcatttcttcttcttctttttttttttttttttttattttttgagacggagtctcgctttgttgcccaggctggagtgcagtggtgcaatctcggcccaccgcaacctccacctcctgggttcaggtgattctcttgcctcagcctcctgagtagctgggattacaagcacctgccaccacgcccagctaatttttatatttttggtggagacagggtttcaccatgttggccaggctggtcttgaactcctgacctcaggtgatctgcccacctcagcctcccaaagtgctggcattacaggcatgagccaccgcacccggcctctcatttattcttgatcgtctctccattatcacattcaaattacctgtttgtggacacttttccccaactgaccatgagtgtgccaagggagggacccagtgtcctatgtctctggctgcttcccagccctctatactctaggcactcagtagtcagaaccagcatctactgagcacttaccatgtgctaggcattatttacatgctttataggcatgaacttgtttatttttcaaaaaagctttatgagacagtgtatcattcaacgtcctagctggaggcagaaaccacagcaattatttgaacagagaatttaatctttaaaaatagttataaggcataaagtgttcacttggtacaggaagcactaccctagagctgaagaaataggaggaggaggtaggaatgattaaaacctggggccaggacccagacctctaggatggcatcaccaaccgattccagaggcagcatcactgggccgagaagtagggacagcgaagcgtgttctgagtgtgggaaaaactgcagaatggatgtagctgctgctaaaggaaggaggtgccactgctgggctgaaaaaatgggactagggtgatgcccacagggacaggaagcaacaggaggagcaagcgcctttctccccttccagacccttcatgtcccagtcatgctccctctgggtggcacctacaggcagcaggtggccaagcagaattagggtttgtagagtcgtggcctaagcatcacatcttagggctgagagatgacaatgtaataactggcacagattattcccatttcacagatgaggaaactgaggcacagagattcagtcacttgtgtgagattaaaggactacctagagcagaggcagggtttgatcccaggtgacctggcccccgagcccctacccttaaccactctgccaaaatgttgaatgagcgaatgagcagaccctcaaataatgcttagcccagtgctgagccatggcttcctacaggtgtgagggatccccaccccacccctgccatacctgaccacttccttatctccctgccaggtcattcactggaactcccccaagaagctccgggtgaagaacaagcatgtggagttttttcgcaacctctacctgaccttcctggagtatgacggcaatcttctgaggcgggaactgtttggctgccccagtgaggctgatgtcaacagtgaaaacgtaagtggctcgcaaggctgggcagggaaggggcggcttctctgctcatccatcaaggacctcccccatgccaggctctatgtcaggctcatggcaggacctaggtgaacacaacgccatcggtgcccagggtccaccatctagtcggggagagaggtacatcagcgggtcctttgcatgctcatcattgtggatgcagacagggtatgtttggtccagacgaggtgaagtcagaagtgagtttccaagcagaggaaacagaatgaacaaaaccaccagtgaaaggaaagatcaagtgtctctcatagccaggaaacaccaatgtttttgtggacatgatacccacatgggagaccctggattcagtgtagtcagtgcatggggaaacacaaaaagagcttttcacaagtaactggctcctttagggtgagcatgggtgaagacagtgttaggtaggtactaagtcaccgccatagctacagtctactatagctattcctgtttctctgtctcttcaccacttataatttgttcatatgctgtatctcatttgatgttcatagaaacccacttttttttttttttttgacagagtttcactctgtcacccaggctggagtgcagtggcgtgatcttggctcactgcaacctctgcctcccgggttcaagcgattctcccgcctcagcctcccaagtaattgggattacaggcatgcaccaccacacccggctaattttttgtatttttagtagagatggggtttcaccgtgttagccaggatggtctcgatctcctgacctcgtgatccgcctgccttggcctcccaaagtgctggaattacaggtgtgagccaccgcgcccggccagaaccgactttttagagttgagtaagttgaggcacagagagattaggcaggttgcccatggccccacaggaaacaaggagcaacgttgagactggttgtgagtttcttaggatatagagaagaggcactttaacagaaaaagcagggcatggggagtcaggctgacctgggtttggctttaattccttccagttactacctgtgtgatctcagataagtgactcaacctctgtgcttcattttcttcaactgtcaaatggagaataaaaacttttgtggggccaggcgcggtggctcacacctgtaatctcagcactttaggaggctgaggcaggcggatcacttgaggtcaggagtttaagacaagcctggctaacatggtgaaaccccatctctactaaaaatacaaaaattaccaggcatggtggcaggcacctataatcccagctactcgggaggctgaggtaggagaattgcttgaacccgggaggcggaggttacagtgagccgagatcatgccactacactcaagcctgggcaacaaagtgagactctctcaaaaacaacaacaataacaacaaacttacatgggatgttttgacagtagctgaaaagttgcatgcaaagcacctagcttggtgttggccctgtgttacatgcatagtcaatatttgcactctgctctttccttgacccttagtattagacacagaagtacctggttcattcctttaggcagcaaacatttactgaggaccttctacttattctgcacactaagtattcgtagatgaaaaaggactttggttcctgatctcatgatgtttatattctggtggaggagacacagttaataactaaactcgcagaaaacaatgatcagccagtggcaactgctacatagcaatatattagtgagcagctccactggtttaaggatttctatgaggaggtgacgtttagtctgaaacctaaatgacatgaatgagcctcccagagaagagcaaagggagcacgttccaggtagaggaagtagctggtgcaaaggccctgaggcaggacaggttcggggtgtggaacagaaggatggccagtgtgcctaggagctagtggggagggagggctcaggtaggcaggagccagattggtaggaggttgtatgttggatttcagattcagaattttgatttattgttgttgctgctgtttttatagttattttttatagttattttggatgtagtgagaattcttttaggctcccaatggcagggaagggcacctgtggaaggaccagaggcatgtactcgcctggccttttatcaggatgaccctggtcacagtgcgcccctgctctctgtgactgggtccccaagtcacagtggatcgccactggctctggcccttctccccatcaccctagaggccttctcagcatctgccctccttcgcatctagtgataaaggaaagaaaaccattaagcactggaactctttcagattctgggaagcacttagaggctcaacaaacactgttctttcagtttttccttcagttctctttgctcacatcagtatgtatcatcatcaagatttgagtgcccattcggcacatttttgcaaacgttaaatggaaactgttctcctacctcgtttatttcccccctccatggagaaggctcccataaaaagccttgcaggatgaagccgtcagttaatcatttgtatcagtgcattcccatgccatgctgctgctcagtgttataagaaatgagactccttttatgagtgactcaccagcttttcctaccatctccttcccctggggggatcggcgaggtgaagaagtcgtcggtggtctttctcggaatccgtgaccatacttatttgctcaggaagaatgcgtgaatgctggccatctgccaggagccgtgtagctcacgggggttgaacttagagactgagcccacccctgtatgtaagtggcctgaagcttaacagctcttagagatgccaacaggaagggccgtctgggcccaggaggcccatgaatgagaaagcagcctgctctaagcagtcaccatggctgtcatcccagtctctctcccctctctcccttgaccactatgcatgggccacatccacctcctttctgtgctttctacattctgggctcaccatagggctttcgtgcttgctattcccactggcgggaacaccctgaccctctgtgtttaaatgtctcagctgtgacatcacagaaactttgcaatcccctacccccacacaaagtaatccattaagtcactgtctatgacatgccctgtttctttttgtttggtgttttttttttttgtttttttttttttgagacagagtcttgctctgtcgccaggctagagtgcagtggcgcgatctcagctcactgtaacctccgcctctccggttcaagcaattctgcttcagcttcctgagtagccagggctacaggtgcacaccaccatgcccagctaatttttgtatttttagtagacacagggtttcaccatgttggccaggatggtcttgatcatgatcacctttcatgatccacctgcctcggcctcccaaagtgctgggattacaggcatgagccaccgcgcctggctttttttttgagacggaatctcgcactgtcgccccagctggagtgcagtgccgcgatctcggctcatggcaacctctccctcccagattcaagcaattcttcttggctcagcctcccaagtagctggaatcagaggtgcctgccaccatacccggctaactttttttgtatttttagtagagacaggttttcgctgtgtcggccaggctggtctcgaactcctgacctcaggtgatccacccacctcagcctcccaaagtgctgggattacaggcatgagccactgcacccagcccctgttttctttttgtcagagcatctactcctgtttacaattacctggttcatatgttcgtttcctacattttttcataaatgtaataccaaaacataagactcttaaagactttgtactgttcacctctgaggttctccgtcctaacataggatagaaccaagcacataataagcacctaataaatatttattgagtgaatgtactaagtaaatttaagaagtaagaatgaattaccaccaagtaaagggaagagcagatgaagaagtgaactgttaaaagagaacatgctggaagttcatgtaccagagcacaggcatgttgggggcatggctaggaacaaagctgaccaggaggcgccctgactgtgctgagaagcttggagtttctcctcagggcagtgaggagccactgaagggttttggtgatgggcagatttatattagagaaaaatcactcaaggtagaggatgaaatgaaaaagacaaaactggagggaccacttaaaggacattgccccggcccagcacagtggctcacgcctgtaatcccagcattttgggaggctgaggtgggcggatcatgaggtcaggagatcgagaccatcctggctaacacggtgaaaccctgtctctctaaaaatacaaaaaaatagccgagcttggtggtgggcgcctgtagtgggcgcctgtagtcccagctactcaggaggctgaggcaggagaatggcatgaacccgggaggcagagcttgcagtgagccgagatcacgccactgcactccagcctgggtgacagagtgagactccgtccaaaaaaaaaaaaggacattgccccatcccaggcaaaaacatgatggatggggctctgatctctaggacagttgcggtgggaatggagagagcagatggattgttttgtgggtactaagaacatgagagtaggtgcagctagcactcataagtcaagacaagcaggttcctgtacactgctccagccctgttcctctgctggctggggctggggctggggctggagctggggcaaagagagagtctgtaaacattgcactcctgaaccacagctctgtagggagtttaccacctggtcttccgcagcgcgtcaagtgttatctgcagacacaaccagagggaaagggtatgatcttggatccagcccaaagcctatgctcccagctctgtgggaagaggtcattagagctgtgataagtgcacagatggtggtgagtctgaaagaaaccaagtcaggaacctcttctttggacttgagatcctagatgggagcaggctctgatggcagtgtctaagtgacttaagactcctttcatccactgtattagtccattttcacgctgctgataaagacatacctgagactgggtaatttataaaggaaagaggtttaattgactcacagttccacatggctggggaggcctcacaatcatggcggaagagcaagggacgtcttacacagtggcaggcaagagagagaatgagaaccgagtgaaaggggtttccccttataaaaccatcagatctcatgagacttattcactatcatgagaccagtatagggggaacctgcccccatgattcagttaactcccactgtgtccctcccacaacatgtagcaattatgggagctacaattcaagatgagatttgggtggggacacagccaaaccatatcatccacccagctgataattcaggtagtcgccagacacagggctagtgttctagcaggcagcattgcagattaaagctcggctcttgcagtcactgttgagtgagggttacagacaagcagaggattattaagtagtgcggttagtgccaaaatagtggtagtgctttgagagcacacgggaagggcattttacacaactagggagagaaggtgcatcgaggaagacttcctggaggaggtgagatttaaaggttgaataagtaggagtgaaggagtctgaagggtaaacttggtgggtgggagggagcaacatgagcactggagaccaggagccaacacaagcatgatcactcgaggacctgctgggagttgagagtcaaatgaagttagtgtgagaactataaaaatggctgcacaggccaggtgcggtggctcacgccggtaatcccag
